(12) United States Patent
Nyce et al.

(10) Patent No.: US 7,034,007 B1
(45) Date of Patent: Apr. 25, 2006

(54) LOW ADENOSINE ANTI-SENSE OLIGONUCLEOTIDE, COMPOSITIONS, KIT & METHOD FOR TREATMENT OF AIRWAY DISORDERS ASSOCIATED WITH BRONCHOCONSTRICTION, LUNG INFLAMMATION, ALLERGY(IES) & SURFACTANT DEPLETION

(75) Inventors: Jonathan W. Nyce, Princeton, NJ (US); W. James Metzger, Greenville, NC (US)

(73) Assignee: East Carolina University, Greenville, NC (US)

( * ) Notice: Subject to any disclaimer, the term of this patent is extended or adjusted under 35 U.S.C. 154(b) by 0 days.

(21) Appl. No.: 09/543,679

(22) Filed: Jan. 1, 2003

Related U.S. Application Data

(63) Continuation-in-part of application No. 09/093,972, filed on Jun. 9, 1998, now Pat. No. 6,825,174, which is a continuation-in-part of application No. 09/016,464, filed on Jan. 30, 1998, now abandoned, which is a continuation-in-part of application No. 08/474,497, filed on Jun. 7, 1995, now Pat. No. 5,994,315, application No. 09/543,679, which is a continuation-in-part of application No. 08/757,024, filed on Nov. 26, 1996, now Pat. No. 6,025,339, which is a continuation-in-part of application No. 08/472,527, filed on Jun. 7, 1995, now Pat. No. 6,040,296.

(60) Provisional application No. 60/127,958, filed on Apr. 6, 1999, and provisional application No. 60/059,160, filed on Sep. 17, 1997.

(51) Int. Cl.
*A01N 43/04* (2006.01)
*A61K 31/70* (2006.01)
*C12N 5/00* (2006.01)
*C12N 5/02* (2006.01)
*C07H 21/04* (2006.01)

(52) U.S. Cl. .................. 514/44; 435/6; 435/325; 435/375; 536/24.3; 536/24.31; 536/24.33; 536/24.5

(58) Field of Classification Search ............... 536/23.1, 536/24.3, 24.31, 24.5; 514/44; 435/6, 325, 435/375
See application file for complete search history.

(56) References Cited

U.S. PATENT DOCUMENTS

| | | | |
|---|---|---|---|
| 5,225,326 A | | 7/1993 | Bresser et al. |
| 5,245,022 A | | 9/1993 | Weis et al. |
| 5,320,962 A | | 6/1994 | Stiles et al. |
| 5,585,479 A | | 12/1996 | Hoke et al. |
| 5,646,156 A | * | 7/1997 | Jacobson et al. ............ 514/81 |
| 5,858,981 A | * | 1/1999 | Schreiber et al. ............ 514/18 |
| 6,207,646 B1 | * | 3/2001 | Krieg et al. ................. 514/44 |

FOREIGN PATENT DOCUMENTS

| | | |
|---|---|---|
| GB | 2264948 A | 9/1993 |
| WO | 9310820 | 6/1993 |
| WO | 9312756 | 7/1993 |
| WO | WO 93/25677 | 12/1993 |
| WO | 9402605 | 2/1994 |
| WO | WO 94/02605 | 3/1994 |
| WO | 9640162 | 12/1996 |
| WO | 9640266 | 12/1996 |
| WO | 9811211 | 3/1998 |
| WO | 9823294 | 6/1998 |
| WO | 9960166 | 11/1999 |
| WO | 0009525 | 2/2000 |

OTHER PUBLICATIONS

Mouse endogenouse murine leukemia mink cell focus–forming (MCF) pol protein (3' end), and envelope protein (5' end) mRNAs, clone T–7.2 (Genbank Acc. No. M19049.1), see nucleotides 243–261.*

ST Crooke, Progress in Antisense Technology, "Progress in Antisense Technology: The End of the Beginning,"1999, 1, pp. 3–45.*

Rahman, M. Sayeedur, et al., "Nebularine (9–2'–deoxy–beta–D–ribofuranosylpurine) has the template characteristics of adenosine in vivo and in vitro", Mutation Research, vol. 377, No. 2, 1997, pp. 263–268.

Loakes, D. et al., "5–Nitroindole as an universal base analogue", Nucleic Acids Research, vol. 22, No. 20, 1994, pp. 4039–4043.

Ohtsuka, E. et al., "An alternative approach to deoxyoligonucleotides as hybridization probes by insertion of deoxyinosine at ambiguous codon positions", Journal of Biological Chemistry, vol. 260, No. 5, Mar. 10, 1985, pp. 2605–2608.

Nichols, R. et al., "A universal nucleoside for use at ambiguous sites in DNA primers", *NATURE*, vol. 369, No. 6480, Jun. 9, 1994, pp. 492–493.

(Continued)

*Primary Examiner*—John L. LeGuyader
*Assistant Examiner*—Janet L. Epps-Ford
(74) *Attorney, Agent, or Firm*—Myers Bigel Sibley & Sajovec, PA

(57) ABSTRACT

An in vivo method of selectively delivering a nucleic acid to a target gene or mRNA, comprises the topical administration, e.g. to the respiratory system, of a subject of a therapeutic amount of an oligonucleotide (oligo) that is anti-sense to a mRNA complementary to the gene in an amount effective to reach the target polynucleotide and reducing or inhibiting expression. The composition and formulations are used for prophylactic, preventive and therapeutic treatment of ailments associated with impaired respiration, lung allergy(ies) and/or inflammation and depletion lung surfactant or surfactant hypoproduction, such as pulmonary vasoconstriction, inflammation, allergies, allergic rhinitis, asthma, impeded respiration, lung pain, cystic fibrosis, bronchoconstriction. The treatment of this invention may be administered directly into the respiratory system of a subject so that the agent has direct access to the lungs, in an amount effective to reduce or inhibit the symptoms of the ailment.

12 Claims, No Drawings-

OTHER PUBLICATIONS

Metzger W. James et al., "Oligonucleotide therapy of allergic asthma", Journal of Allergy and Clinical Immunology, vol. 104, No. 2 part 1, Aug. 1999, pp. 260–266.

Stull, R.A. et al., "Predicting antisense oligonucleotide inhibitory efficacy: a computational approach using histograms and thermodynamic indices", Nucleic Acids Research, 20(13): 3501–3508 (1992).

Monia, B.P. et al., "Selective Inhibition of Mutant Ha–ras mRNA Expression by Antisense Oligonucleotides", J. Biol. Chem., vol. 2G7 No. 28, Issue of Oct. 5, 19954–19962 (1992).

Pasternak, Gavril W., "Molecular Neuropharmacology", The Scientist, 10(8):14 (1996).

Research Program—Antisense Technology, Novopharm Biotech—Research Program—Antisense Web Page, http://www.novopharmbiotech.ca/asense.htm.

Akhtar, S. et al., "In vivo studies with antisense oligonucleotides", Trends in Pharmacological Sciences, Current Techniques, 18:12–18, (1997).

Nyce, J.W., "Antisense oligonucleotides as emerging drugs", Emerging Drugs, 3:365–375, (1998).

Nyce, J.W., "Respirable antisense oligonucleotides as novel therapeutic agents for asthma and other pulmonary diseases", Exp. Opin. Invest. Drugs 6(9): 1149–1156 (1997).

Nyce, J.W. et al., "DNA Antisense Therapy for Asthma in an Animal Model", Nature, 385(20): 721–725, (1997).

Webb, A. et al., "BCL–2 Antisense Therapy in Patients with Non–Hodgkin Lymphoma", Lancet, 349(9059): 1137–41, (1997).

Yazaki, T. et al., "Treatment of Glioblastoma U–87 .by Systemic Administration of an Antisense Protein Kinase C–Alpha Phosphorothioate Oligodeoxynucleotide", Molecular Pharmacol., 50(2): 236–242, (1996).

Farmer, S.G. et al., "Adenosine Receptor–mediated Contraction and Relaxation of Guinea–pig Isolated Tracheal Smooth Muscle: Effects of Adenosine Antagonists", Br. J. Pharmacol., 95: 371–378 (1988).

Marquardt, D.L. et al., "Aminophylline Exposure Alters Mouse Bone Marrow–derived Mast Cell Adenosine Responsiveness", J. Allergy Clin Immunol, 78: 462–469, (1986).

Simpson, R. U. et al, "Antisense oligonucleotide targeting against protein kinase C beta and C beta II block 1,25 –(OH)– 2D3– induced differentiation", J. Biol. Chem. 273(31):19587–19591 (1998).

Chen, CC et al, "Protein kinase Ceta mediates LPS–induced nitric oxide synthesis expression", J. Biol. Chem. 273(31): 19424–19430 (1998).

Glukhov, A. I., et al., "Inhibition of telomerase activity of melanoma cells in vitro by antisense oligodeoxynucleotides", Biochem. Biophys. Res. Commun. 248(2):.368–371 (1998).

Banasiak, K. J. and Haddard G. G., "Hypoxia–induced apoptosis: effect of hypoxia severity and role of p53 in neuronal cell death (Antisense to p53)", Brain Res. 797(2): 295–304 (1998).

Lehenkaru P et al, "Carbonic anhydrase II plays a major role in osteoclast differentiation (antisense to carbonic anhydrase II)", Exp Cell Res 242(1):128–137 (1998).

Dooley NP et al, "Apoptosis is induced in glioma cells by antisense oligonucleotide to protein kinase C alpha", Neuroreport 9(8):1727–1733 (1998).

Kondo S et al, Antisense telomerase treatment: induction of distinct pathways, apoptosis and differentiation, FASEB J. 129100:801–811 (1998).

Alahari SK et aL, "Novel chemically modified oligonucleotide provide potent inhibition of p–glycoprotein (an ATPase that serves as a drug efflux pump)", J. Pharmacol. Exp. Therapeut. 286(1): 419–428 (1998).

Wu Pong, S. "Oligonucleotides: Opportunities for Drug Therapy and Research," Pharmaceutical Technology, vol. 18: 102–114.

Miller et al. "Gene Transfer and Antisense Nucleic Acid Techniques," Parasitology Today, vol. 10, No. 3: 92–97.

Stull et al. "Antigens, Ribozyme and Aptamer Nucleic Acid Drugs: Progress and Prospects," Pharmaceutical Research, vol. 12, No. 4: 46j5–483.

I. Milligan et al.; Current Concepts in Antisense Drug Design. J. Med. Chem. 36(14): 1923–1937 (1993).

S. Ali et al.; Adenosine–induced bronchoconstriction in an allergic rabbit model:antagonism by theophylline aerosol. Agents Actions 37:165–167 (1992).

S. Ali et al.; Modification of allergen–induced airway obstruction and bronchial hyperresponsiveness in the allergic rabbit by theophylline aerosol. Agents Actions 37:168–170 (1992).

S. Ali et al.; Adenosine–Induced Brochoconstriction and Contraction of Airway Smooth Muscle from Allergic Rabbits with Late–Phase Airway Obstruction: Evidence for an Inducible Adenosine $A_1$ Receptor. J. Pharmacol. Exp. Therapeu. 268:1328–1334 (1994).

S. Ali et al.; Adenosine receptor–mediated bronchoconstriction and bronchial hyperresponsiveness in allergic rabbit model, Am. J. Physiol. 266:L271–277 (1994).

D.R. Sibley, et al; Transfected Mammalian Cell Lines Expressing the A1 Adeonsine Receptor NTIS Field/Group Codes: 57F, 57B, 57O 90D (Jun. 5, 1991).

Dennis J. U., et al, "Human melanoma metastases is inhibited following ex vivo treatment with an antisense oligonucleotide to protein kinase C alpha", Cancer Lett. 128(1):65–70 (1998).

Haeckel C., et al, "Antisense oligonucleotide inhibit urokinase", Int. J. Cancer 77(1): 153–160 (1998).

Kobayashi S. et al, "Transcription factor NF–E2 is essential for the polyploidization of Meg–J", Biochem. Biophys. Res. Commun. 247(1): 65–69 (1998).

* cited by examiner

LOW ADENOSINE ANTI-SENSE OLIGONUCLEOTIDE, COMPOSITIONS, KIT & METHOD FOR TREATMENT OF AIRWAY DISORDERS ASSOCIATED WITH BRONCHOCONSTRICTION, LUNG INFLAMMATION, ALLERGY(IES) & SURFACTANT DEPLETION

This application claims benefit of Provisional Application No. 60/127,958, filed Apr. 6, 1999.

This application is a continuation-in-part of Ser. No. 09/093,972, filed Jun. 9, 1998, now U.S. Pat. No. 6,825,174, which is a continuation-in-part of Ser. No. 09/016,464, filed Jan. 30, 1998, now abandoned, which is a continuation of Ser. No. 08/474,497, filed Jun. 7, 1995, now U.S. Pat. No. 5,994,315. Ser. No. 09/093,972 claims benefit of provisional application 60/059,160, filed Sep. 17, 1997.

This application is also a continuation-in-part of Ser. No. 08/757,024, filed Nov. 26, 1996, now U.S. Pat. No. 6,025,339, which is a continuation-in-part of Ser. No. 08/472,527, filed Jun. 7, 1995, now U.S. Pat. No. 6,040,296.

BACKGROUND OF THE INVENTION

1. Field of the Invention

This patent relates to a composition comprising oligonucleotides (oligos) that are anti-sense to adenosine receptors, and contain low amounts of or no adenosine (A). These agents are suitable for the treatment, among others, of pulmonary diseases associated with inflammation, impaired airways, including lung disease and diseases whose secondary effects afflict the lungs of a subject. Examples of these diseases are allergies, asthma, impeded respiration, allergic rhynitis, pain, cystic fibrosis, and cancers such as leukemias, e.g. colon cancer, and the like. The present agent may be administered prophylactically or therapeutically in conjunction with other therapies, or may be utilized as a substitute for therapies that have significant, negative side effects.

2. Background of the Invention

Respiratory ailments, associated with a variety of diseases and conditions, are extremely common in the general population, and more so in certain ethnic groups, such as African Americans. In some cases they are accompanied by inflammation, which aggravates the condition of the lungs. Asthma, for example, is one of the most common diseases in industrialized countries. In the United States it accounts for about 1% of all health care costs. An alarming increase in both the prevalence and mortality of asthma over the past decade has been reported, and asthma is predicted to be the preeminent occupational lung disease in the next decade. While the increasing mortality of asthma in industrialized countries could be attributable to the depletion reliance upon beta agonists in the treatment of this disease, the underlying causes of asthma remain poorly understood.

Adenosine may constitute an important mediator in the lung for various diseases, including bronchial asthma. Its potential role was suggested by the finding that asthmatics respond favorably to aerosolized adenosine with marked bronchoconstriction whereas normal individuals do not. An asthmatic rabbit animal model, the dust mite allergic rabbit model for human asthma, responded in a similar fashion to aerosolized adenosine with marked bronchoconstriction whereas non-asthmatic rabbits showed no response. More recent work with this animal model suggested that adenosine-induced bronchoconstriction and bronchial hyperresponsiveness in asthma may be mediated primarily through the stimulation of adenosine receptors. Adenosine has also been shown to cause adverse effects, including death, when administered therapeutically for other diseases and conditions in subjects with previously undiagnosed hyper reactive airways.

A handful of medicaments have been available for the treatment of respiratory diseases and conditions, although in general they all have limitations. Theophylline, an important drug in the treatment of asthma, is a known adenosine receptor antagonist which was reported to eliminate adenosine-mediated bronchoconstriction in asthmatic rabbits. A selective adenosine $A_1$ receptor antagonist, 8-cyclopentyl-1,3-dipropylxanthine (DPCPX) was also reported to inhibit adenosine-mediated bronchoconstriction and bronchial hyperresponsiveness in allergic rabbits. The therapeutic and preventative applications of currently available adenosine $A_1$ receptor-specific antagonists are, nevertheless, limited by their toxicity. Theophylline, for example, has been widely used in the treatment of asthma, but is associated with frequent, significant toxicity resulting from its narrow therapeutic dose range. DPCPX is far too toxic to be useful clinically. The fact that, despite decades of extensive research, no specific adenosine receptor antagonist is available for clinical use attests to the general toxicity of these agents. Anti-sense oligonucleotides have received considerable theoretical consideration as potential useful pharmacological agents in human disease. Their practical application in actual models of human disease, however, has been somewhat elusive. One important impediment to their effective application has been a difficulty in finding an appropriate route of administration to deliver them to their site of action. Many in vivo experiments were conducted by administering anti-sense oligonucleotides directly to specific regions of the brain. These applications, however, necessarily have limited clinical utility due to their invasive nature. Although anti-sense oligonucleotides have received considerable theoretical consideration for their potential use as pharmacological agents in human disease, finding practical and effective applications for these agents in actual models of human disease, however, have been few and far between, particularly because they had to be administered in large doses. Another important consideration in the pharmacologic application of these molecules is their route of administration. Many in vivo applications have involved the direct administration of anti-sense oligonucleotides to limited regions of the brain. Such applications, however, have limited clinical utility due to their invasive nature. The systemic administration of anti-sense oligonucleotides as pharmacological agents has been found to have also significant problems, not the least of which being an inherent difficulty in targeting disease-involved tissues. That is, the necessary dilution of the anti-sense oligonucleotide in the circulatory system makes extremely difficult to attain a therapeutic dose at the target tissue by intravenous or oral administration. The bioavailability of orally administered anti-sense oligonucleotides is very low, of the order of less than about 5%. Anti-sense oligonucleotides have been used in therapy by many, including the present inventor, who in his previous work successfully treated various diseases and conditions by direct administration of these agents to the lung. In many instances, other workers have had to face the difficulties associated with the delivery of DNA molecules to a desired target. Thus, the route of administration may be of extreme importance for treating generalized diseases and conditions as well as those which are localized. In contrast, up to the present time, the delivery of anti-sense agents to the lung has been relatively undeveloped. As described by the present inventor in more detail below, the lung is an excellent target for the direct administration of anti-sense oligonucleotides and provides a non-invasive and a tissue-specific route.

Clearly, there exist presently no effective therapies for treating these ailments, or at least no therapics which are effective and devoid of significant detrimental side effects. Accordingly, there is still a need for an agent for the treatment of adenosine mediated ailments afflicting the pulmonary and respiratory ailments affecting the lung airways, including respiratory problems, bronchoconstriction, inflammation, allergy(ies), depletion or hyposecretion of surfactant, etc., which is highly effective and sufficiently selective to avoid detrimental side effects produced by other therapies. In addition, there is a definite need for making available a delivery method that will require low amounts of therapeutic agents and will be effective for the rapid and targeted access of tissue genes of mRNAs and the reversal of untoward effects afflicting a subject.

SUMMARY OF THE INVENTION

The present invention generally relates to a pharmaceutical or veterinary composition, comprising an anti-sense oligonucleotide(s) (oligo(s)) which is (are) effective for alleviating bronchoconstriction and/or lung inflammation, allergy(ies), and/or surfactant depletion and/or hyposecretion, when administered to a mammal, the oligo containing about 0 to about 15% adenosine (A) and being anti-sense to a target selected from the group consisting of the initiation codon, the coding region, the 5'-end and the 3'-end genomic flanking regions, the 5' and 3' intron-exon junctions, and regions within 2 to 10 nucleotides of the junctions of a gene encoding a target polypeptide associated with lung airway dysfunction or anti-sense to the polypeptide mRNA; combinations of the oligos; and mixtures of the oligos; and a pharmaceutically or veterinarily acceptable carrier or diluent. The targets are typically molecules associated with airway disease, cancer, etc., such as transcription factors, stimulating and activating peptide factors, cytokines, cytokine receptors, chemokines, chemokine receptors, adenosine receptors, bradykinin receptors, endogenously produced specific and non-specific enzymes, immunoglobulins and antibodies, antibody receptors, central nervous system (CNS) and peripheral nervous and non-nervous system receptors, CNS and peripheral nervous and non-nervous system peptide transmitters, adhesion molecules, defensins, growth factors, vasoactive peptides and receptors, binding proteins, and malignancy associated proteins, among others. Examples are oligo(s) targeted to adenosine receptor(s) and it(they) are typically present in the composition in an amount effective to reduce adenosine mediated effect(s), such as airway obstruction, inflammation, allergy(ies), and sufactant depletion, among others. The adenosine receptor is preferably selected from the group consisting of the adenosine $A_1$, $A_{2b}$, and $A_3$ receptors, and in some instances even adenosine $A_{2a}$, receptors. The oligo of the invention may be applied to the preparation of a medicament for (a) reducing adenosine-mediated bronchoconstriction, impeded respiration, inflammation, allergy(ies), depletion production of surfactant, and other detrimental pulmonary effects in a subject in need of treatment, and/or for (b) treating specific diseases and conditions such as asthma, cystic fibrosis, allergic rhynitis, COPD, etc. For the first time this invention provides the targeted administration of one or more oligonucleotides directly into the repiratory system. The oligos may be directed to any target and are intended for fast delivery through the mucosal tissue of the lungs for hybridization to a desired target polynucleotide, e. g. $mRNA_1$ to prevent gene transcription and translation, such that protein expression will be reduced, hampered, or completely stopped. Thus, this invention also provides a more general method for administering oligonucleotides that are anti-sense to targeted genes and mRNAs associated with any type of diseases, by direct administration into the respiratory system, e. g. by inhalation, by introduction of a solution or aerosol into the respiratory airways, and/or directly into the lung.

The present oligos, moreover, are suitable for reducing effects mediated by a variety of target proteins and genes, for example adenosine-mediated effects, including pulmonary, respiratory, and other associated effects, e.g. bronchoconstriction, inflammation, immune mediated reactions, allergy(ies) and other airway problems, which may be caused by different conditions, including cancer. Examples of diseases and conditions, which may be treated preventatively, prophylactically and therapeutically with the agent of this invention, are pulmonary vasoconstriction, inflammation, allergies, asthma, impeded respiration, respiratory distress syndrome, pain, cystic fibrosis, allergic rhynitis, pulmonary hypertension, pulmonary vasoconstriction, emphysema, chronic obstructive pulmonary disease (COPD), bronchitis, and cancers such as leukemias, lymphomas, carcinomas, and the like, e.g. colon cancer, breast cancer, lung cancer, pancreatic cancer, hepatocellular carcinoma, kidney cancer, melanoma, hepatic metastases, etc., as well as all types of cancers which may metastasize or have metastasized to the lung(s), including breast and prostate cancer. The present agents are also suitable for administration before, during and after other treatments, including radiation, chemotherapy, antibody therapy, phototherapy and cancer, and other types of surgery. The present agent is effectively administered prophylactically and therapeutically in conjunction with other therapies, or by itself for conditions without known therapies or as a substitute for therapies that have significant negative side effects. The oligo(s) may be administered by any means known to a subject, e. g. to the lungs of the subject, more generally through any and all systemic and topical routes. This oligonucleotide(s) (oligo(s)) employed are anti-sense to to a target DNA or $RNA_1$ e. g. an adenosine receptor DNA or $RNA_1$ and preferably consist essentially of up to about 15% adenosine (A), and more preferably contain no adenosine. The oligos are provided in the form of specific compositions and formulations, with a carrier or diluent, and optionally with other therapeutic agents and additives which are used for administration by specific routes, e.g. into the respiratory system, topically, transdermally, parenterally, by implantation, and the like. The oligo is also provided as a capsule or cartridge, and in the form of a kit. The oligos of the invention may be produced by selection of specific targeted segments of the gene or mRNA encoding the adenosine receptor as described below. In one preferred embodiment, the selection is made to obtain oligos that consisting essentially of less than about 15% adenosine (A). This may be done by selecting the target as done above, which includes genes, genomic flanking regions, RNAs and polypeptide associated with an ailment afflicting the lung airways, obtaining the sequence of a mRNA(s) corresponding to the target gene(s) and/or their genomic flanking region(s) and/or the juxta-membrane regions thereof, and mRNA(s) encoding the target polypeptide(s), selecting at least one segment of the mRNA(s), and synthesizing one or more anti-sense oligonucleotide(s) to the selected mRNA segment(s), and substituting, if necessary, an alternative, e.

g. a universal base(s) or other base(s) for one or more A to reduce the proportion of A present in the oligonucleotide to less than about 15%, and down to no adenosine. Similarly, alternative and/or universal bases may be substituted for adenosine, e. g. specific adenosine A1, A2b and A3 receptor antagonists or A2a receptor agonists, theophilline, enprophylline, and many other adenosine receptor antagonists known in the art as well as agonists with significantly reduced agonist activity with respect to adenosine, e. g. less than 0.5%, less than 0.3%, and the like.

The invention will now be described in general in conceptual and experimental terms, with reference to specific examples. Other objects, advantages and features of the present invention will become apparent to those skilled in the art from the description that follows.

DETAILED DESCRIPTION OF THE PREFERRED EMBODIMENTS

This invention arose from a desire by the inventor to improve on prior art treatments for pulmonary and other diseases, which technology is generally frought with detrimental side effects and by the need of administering high doses of therapeutical agents. The present invention arises from the inventor's own discovery that adenosine receptor targeted anti-sense oligonucleotides (oligos) may be utilized therapeutically in the treatment of diseases or conditions which impair respiration, cause inflammation and/or allergy (ies), constrict bronchial tissue, obstruct the lung airways, depletion surfactant secretion, or otherwise impede normal breathing. In general, many diseases and conditions are associated with or cause inflammation, constrict bronchial tissue or the lung airways, depletion secretion of surfactant, augment allergy(ies), or otherwise impede normal breathing. This treatment is selective for specific targets associated with or mediating these symptoms, and the agents are administered in up to 1000-fold lower doses than those seen in the art. The inventor, in addition, wanted to provide a treatment which would improve the outcome and life style of patients undergoing other procedures or being administered other therapies, including antibody therapy, chemotherapy, radiation, phototherapy, and surgery e.g. cancer surgery, and that could be effectively administered preventatively, prophylactically or therapeutically. He reasoned that he could further improve on this discovery by selecting oligos of reduced adenosine content, or reducing the adenosine content of otherwise targeted anti-sense oligos corresponding to endogenous polynucleotide sequences. The present invention is premised on the discovery by the inventor that oligonucleotides are metabolized in vivo to their mononucleotides. Adenosine (A)-containing oligonucleotides break down and release adenosine which, in turn, activates adenosine receptors, thereby causing bronchoconstriction, inflammation, surfactant depletion, allergy(ies), and the like. He, thus, conceived of employing low adenosine-free adenosine oligos to avoid these side effects upon their administration. He succeeded in this endeavor and is providing in this patent novel and improved compositions, formulations and methods which afford greatly improved results when compared with previously known treatments for preventing and alleviating bronchoconstriction, allergy(ies), inflammation, breathing difficulties, surfactant depletion and blockage of airways, as well as for other conditions which affect the lung directly or indirectly. In different embodiments, one or more nucleic acids of the invention may be formulated alone, and/or with one or more surfactant components and/or with a carrier, and/or with other therapeutic agents and/or formulation agents known in the art. The compositions of this invention, thus, may be incorporated into a variety of formulations for systemic and topical administration. Moreover, the inventor also provides a broad method for delivery of anti-sense oligonucleotides (oligos) through the respiratory system, as a fast means of starting treatment to address acute attacks of asthma and other diseases and conditions that have a rapid onset. In addition, the present agents have long halflives and may be administered at very low doses. This makes them ideal for once a week type therapies. In the past, anti-sense oligonucleotides received considerable theoretical consideration as being potentially useful as pharmacologic agents for the treatment of human disease. Wagner, R., Nature 372: 333–335 (1994). However, it has been difficult to actually apply these molecules to alleviating and curing human diseases. One important consideration in the pharmacologic application of these molecules has been the failure of various routes of administration to deliver the compounds to its target while avoiding invading the circulation and, therefore, other untargeted tissues which, thus, produces a plethora of side effects. Most in vivo experiments utilizing anti-sense oligonucleotides involved a direct application of the oligo to limited regions of the brain. See, Wahlestedt, C., Trends in Pharmacol. Sci. 15: 42–46 (1994); Lai, J. et al., Neuroreport 5: 1049–1052 (1994); Standifer, K., et al., Neuron 12: 805–810 (1994); Akabayashi, A., et al., Brain Res. 21: 55–61 (1994). Others applied them into the spinal fluid. See, e.g. Tseng, L., et al., European J. Pharmacol. 258: R1–3 (1994); Raffa, R., et al., European J. Pharmacol. 258: R5–7 (1994); Gillardon, F., et al., European J. Neurosci. 6: 880–884 (1994). Such applications, clearly, have no practical clinical utility due to their invasive nature. Thus, the systemic administration of anti-sense oligonucleotides poses significant problems with respect to their pharmacologic application, not the least of which is the difficulty in selectively targeting disease-involved tissues. The systemic administration of anti-sense oligonucleotides also poses significant problems with respect to their pharmacologic application, not the least of which is the difficulty in selectively targeting disease-involved tissues.

The respiratory system, and in particular the lung, as the ultimate port of entry into the organism, however, is an excellent route of administration for anti-sense oligonucleotides. This is so not only for the treatment of lung disease, but also when utilizing the lung as a means for delivery, particularly because of its non-invasive and tissue-specific nature. Thus, local delivery of antisense oligonucleotides directly to the target tissue enables the therapeutic use of these compounds. Fomivirsen (ISIS 2302) is an example of a local drug delivery into the eye to treat cytomegalovirus (CMV) retinitis, for which a new drug application has been filed by ISIS. The administration of a drug through the lung offers the further advantage that inhalation is non-invasive whereas direct injection in to the vitreous of the eye is invasive. The composition and formulations of this invention are highly efficacious for preventing and treating diseases and conditions associated with bronchoconstriction, difficult breathing, impeded and obstructed lung airways, allergy(ies), inflammation and surfactant depletion, among others. Examples of diseases and conditions which are suitably treated by the present method are diseases and conditions, including Acute Respiratory Distress Syndrome (ARDS), asthma, adenosine administration e.g. in the treatment of Supra Ventricular Tachycardia (SVT) and other arrhythmias, and in stress tests to hyper-sensitized individuals, ischemia, renal damage or failure induced by certain drugs, infantile respiratory distress syndrome, pain, cystic fibrosis, pulmonary hypertension, pulmonary vasoconstriction, emphysema, chronic obstructive pulmonary disease (COPD), lung transplantation rejection, pulmonary infections, and cancers such as leukemias, lymphomas, carcinomas, and the like, including colon cancer, breast cancer, lung cancer, pancreatic cancer, hepatocellular carcinoma, kidney cancer, melanoma, hepatic metastases, etc., as well as all types of cancers which may metastasize or have metastasized to the lung(s), including breast and prostate cancer. The invention will be described with respect to the adenosine receptors as targets, but is similarly applicable to any other target with respect to the pulmonary administration of anti-sense oligos. The examples provided below show a complete inhibition of such adenosine receptor associated symptoms in a rabbit model for human bronchoconstriction, allergy(ies) and inflammation as well as the elimination of the ability of the adenosine receptor agonist par excellence, adenosine, to cause bronchoconstriction in hyper-responsive monkeys, which are animal models for human hyper-responsiveness to adenosine receptor agonists. The pharmaceutical composition and formulations of the invention, therefore, are suitable for preventing and alleviating the symptoms associated with stimulation of adenosine receptors, such as the adenosine $A_1$ receptors. The compositions and formulations of this invention, thus, are also suitable for prevent the untoward side effects of adenosine-mediated hyperresponsiveness in certain individuals, which are generally seen in diseases affecting respiratory activity.

"The method of the present invention may be used to treat airway diseases in a subject for any reason, with the intention that adenosine content of antisense compounds be eliminated or reduced so as to prevent is liberation upon antisense degradation. Examples of airway diseases that may be treated by the method of the present invention include cystic fibrosis, asthma, chronic obstructive pulmonary disease, bronchitis, and other airway diseases characterized by an inflammatory response. Antisense nucleotides to the $A_1$ and $A_3$ receptors are shown to be effective in the downregulation of $A_1$ or $A_3$ in the cell. One novel feature of this treatment, as compared to traditional treatments for adenosine-mediated bronchoconstriction, is that administration is direct to the lungs. Additionally, a receptor protein itself is reduced in amount, rather than merely interacting with a drug, and toxicity is reduced. Other proteins that may be targeted with antisense agents for the treatment of lung conditions include, but are not limited to: human A2a adenosine receptor, human A2b adenosine receptor, human IgE receptor β, human Fc-epsilon receptor CD23 antigen, human histidine decarboxylase, human beta tryptase, human tryptase-I, human prostaglandin D synthase, human cyclooxigenase-2, human eosinophil cationic protein, human eosinophil derived neurotoxin, human eosinophil peroxidase, human intercellular adhesion molecule-1 (ICAM-1), human vascular cell adhesion molecule-1 (VCAM-1), human endothelial leukocyte adhesion molecule-1 (ELAM-1), human P selectin, human endothelial monocyte activating factor, human IL-3, human IL-4, human IL-5, human IL-6,human IL-8, human monocyte-derived neutrophil chemotactic factor, human neutrophil elastase, human neutrophil oxidase factor, human cathepsin G, human defense 1, human defensin 3, human macrophage inflammatory protein-1-alpha, human muscarinic acetylcholine receptor HM3, human fibronectin, human GM-CSF, human tumor necrosis factor, human leukotriene C4 synthase, human major basic protein, and human endothelin 1. In these latter targets, and in target genes in general, it is particularly imperative to eliminate or rduce the adenosine content of the corresponding antisense oligonucleotide to prevent their breakdown products from liberating adenosine."

In one aspect of this invention, the anti-sense oligonucleotide has a sequence which specifically binds to a portion or segment of a mRNA molecule which encodes a protein associated with impeded breathing, allergy(ies), lung inflammation, depletion of lung surfactant or lowering of lung surfactant, airway obstruction, bronchitis, and the like. One effect of this binding is to reduce or even prevent the translation of the corresponding mRNA and, thereby, reduce the available amount of target protein in the subject=s lung. In one preferred embodiment of this invention, the phosphodiester residues of the anti-sense oligonucleotide are modified or substituted. Chemical analogs of oligonucleotides with modified or substituted phosphodiester residues, e.g., to the methylphosphonate, the phosphotriester, the phosphorothioate, the phosphorodithioate, or the phosphoramidate, α=methoxy ethyl and similar modifications, which increase the in vivo stability of the oligonucleotide are particularly preferred. The naturally occurring phosphodiester linkages of oligonucleotides are susceptible to some degree of degradation by cellular nucleases. Many of the residues proposed herein, on the contrary are highly resistant to nuclease degradation. See, Milligan et al.; Cohen, J. S. D., supra. In another preferred embodiment of the invention, the oligonucleotides may be protected from degradation by adding a "3'-end cap" by which nuclease-resistant linkages are substituted for phosphodiester linkages at the 3' end of the oligonucleotide. See, Tidd, D. M. and Warenius, H. M., Be. J. Cancer 60: 343–350 (1989); Shaw, J. P. et al., Nucleic Acids Res. 19: 747–750 (1991), the relevant section of which are incorporated in their entireties herein by reference. Phosphoramidates, phosphorothioates, and methylphosphonate linkages all function adequately in this manner for the purposes of this invention, as do α' modifications, such as α' methoxy ethyl, and the like. The more extensive the modification of the phosphodiester backbone the more stable the resulting agent, and in many instances the higher their RNA affinity and cellular permeation. See, Milligan, et al., supra. In addition, a plurality of substitutions to the carbohydrate ring are also known to improve stability of nucleic acids. Thus, the number of residues which may be modified or substituted will vary depending on the need, target, and route of administration, and may be from 1 to all the residues, to any number in between. Many different methods for replacing the entire phosphodiester backbone with novel linkages are known. See, Millikan et al, supra. Preferred backbone analogue residues include phosphoramidate, phosphorothioate, methylphosphonate; phosphorotriester, phosphotriester, thioformacetal, phosphorodithioate, phosphoramidate, formacetal, triformacetal, thioether, carbamate, boranophosphate, 3'-thioformacetal, 5'-thioether, carbonate, $C_5$-substituted nucleotides, 5'-N-carbamate, sulfate, sulfonate, sulfamate, sulfonamide, sulfone, sulfite, 2'-O methyl, sulfoxide, sulfide, hydroxylamine, methylene (methylimino) (MMI), methoxymethyl (MOM), and methoxyethyl(MOE), and methyleneoxy(methylimino) (MOMI) residues, and combinations thereof. Phosphorothioate and methylphosphonate-modified oligonucleotides are particularly preferred due to their availability through automated oligonucleotide synthesis. See, Millikan et al, supra. Where appropriate, the agent of this invention may be administered in the form of their pharmaceutically acceptable salts, or as a mixture of the anti-sense oligonucleotide and its salt. In another embodiment of this invention, a mixture of different anti-sense oligonucleotides or their pharmaceutically acceptable salts is administered. A single agent of this invention has the capacity to attenuate the expression of a target mRNA and/or various agents to enhance or attenuate the activity of a pathway. By means of example, the present method may be practiced by identifying all possible deoxyribonucleotide segments which are low in thymidine (T) or deoxynucleotide segments low in adenosine (A) of about 7 or more mononucleotides, preferably up to about 60 mononucleotides, more preferably about 10 to about 36 mononucleotides, and still more preferably about 12 to about 21 mononucleotides, in a target mRNA or a gene, respectively. This may be attained by searching for mononucleotide segments within a target sequence which are low in, or lack thymidine (RNA), a nucleotide which is complementary to adenosine, or that are low in adenosine (gene), that are 7 or more nucleotides long. In most cases, this search typically results in about 10 to 30 such sequences, i.e. naturally lacking or having less than about 40% adenosine, anti-sense oligonucleotides of varying lengths for a typical target mRNA of average length, i.e., about 1800 nucleotides long. Those with high content of T or $A_1$ respectively, may be fixed by substitution of a universal base for one or more As. The agent(s) of this invention may be of any suitable length, including but not limited to, about 7 to about 60 nucleotides long, preferably about 12 to about 45, more preferably up to about 30 nucleotides long, and still more preferably up to about 21, although they may be of other lengths as well, depending on the particular target and the mode of delivery. The agent(s) of the invention may be directed to any and all segments of a target RNA. One preferred group of agent(s) includes those directed to an mRNA region containing a junction between an intron and an exon. Where the agent is directed to an intron/exon junction, it may either entirely overlie the junction or it may be sufficiently close to the junction to inhibit the splicing-out of the intervening exon during processing of precursor mRNA to mature $mRNA_1$ e.g. with the 3' or 5' terminus of the anti-sense oligonucleotide being positioned within about, for example, within about 2 to 10, preferably about 3 to 5, nucleotide of the intron/exon junction. Also preferred are anti-sense oligonucleotides which overlap the initiation codon, and those near the 5' and 3' termini of the coding region. The flanking regions of the exons may also be targeted as well as the spliced segments in the precursor mRNAs. The mRNA sequences of the adenosine receptors and of many other targets are derived from the DNA base sequence of the gene expressing either receptors, e. g. the adenosine receptors, the enzymes, factors, or other targets associated with airway disease. For example, the sequence of the genomic human $A_1$ adenosine receptor is known and is disclosed in U.S. Pat. No. 5,320,963 to Stiles, G., et al. The $A_3$ adenosine receptor has been cloned, sequenced and expressed in rat (see, Zhou, F., et al., P.N.A.S. (USA) 89: 7432 (1992)) and human (see, Jacobson, M. A., et al., U.K. Patent Application No. 9304582.1 (1993)). The sequence of the adenosine $A_{2b}$ receptor gene is also known. See, Salvatore, C. A., Luneau, C. J., Johnson, R. G. and Jacobson, M., Genomics (1995), the relevant portion of which is hereby incorporated in its entirety by reference. The sequences of many of the remaining exemplary target genes are also known. See, GenBank, NIH. The sequences of those genes whose sequences are not yet available may be obtained by isolating the target segments applying technology known in the art. Once the sequence of the gene, its RNA and/or the protein are known, an anti-sense oligonucleotides may be produced according to this invention as described above to reduce the production of the targeted protein in accordance with standard techniques. The sequences for the adenosine $A_{2a}$ bradykinin, and other genes as well as methods for preparation of oligonucleotides are also known as those of many other target genes and mRNAs for which this invention is suitable. Thus, anti-sense oligonucleotides that downregulate the production of target sequences associated with airway disease, including the adenosine $A_1$, $A_{2a}$, $A_{2b}$, $A_3$, bradykinin, GATA-3, COX-2, and many other receptors, may be produced in accordance with standard techniques. Examples of diseases and conditions which are suitably treated by the present method are diseases and conditions, including Acute Respiratory Distress Syndrome (ARDS), asthma, adenosine administration e.g. in the treatment of Supra Ventricular Tachycardia (SVT) and other arrhythmias, and in stress tests to hyper-sensitized individuals, ischemia, renal damage or failure induced by certain drugs, infantile respiratory distress syndrome, pain, cystic fibrosis, pulmonary hypertension, pulmonary vasoconstriction, emphysema, chronic obstructive pulmonary disease (COPD), pulmonary transplantation rejection, pulmonary infections, and cancers such as leukemias, lymphomas, carcinomas, and the like, including colon cancer, breast cancer, lung cancer, pancreatic cancer, hepatocellular carcinoma, kidney cancer, melanoma, hepatic metastases, etc., as well as all types of cancers which may metastasize or have metastasized to the lung(s), including breast and prostate cancer.

The adenosine receptors discussed above are mere examples of the high power of the inventor=s technology. In fact, a large number of genes may be targeted in a similar manner by the present agent(s), to reduce or down-regulate protein expression. By means of example, if the target disease or condition is one associated with impeded or reduced breathing, bronchoconstriction, chronic bronchitis, pulmonary bronchoconstriction and/or hypertension, chronic obstructive pulmonary disease (COPD), pulmonary transplantation rejection, pulmonary infections, allergy, asthma, cystic fibrosis, respiratory distress syndrome, cancers, which either directly or by metastasis afflict the lung, the present method may be applied to a list of potential target mRNAs, which includes the targets listed in Table 1 and Table 2 below, among others. The anti-sense agent(s) of the invention have a low A content to prevent its liberation upon in vivo degradation of the agent(s). For example, if the system is the pulmonary or respiratory system, a large number of genes is involved in different functions, including those listed in Table 1 below.

TABLE 1

| Pulmonary Disease or Condition | Pulmonary and Inflammation Targets |
|---|---|
| Nf6B Transcription Factor | Interleukin-8 Receptor (IL-8 R) |
| Interleukin-5 Receptor (IL-5R) | Interleukin-4 Receptor (IL-4R) |
| Interleukin-3 Receptor (IL-3R) | Interleukin-1β (IL-1β) |
| Interleukin-1β Receptor (IL-1βR) | Eotaxin |
| Tryptase | Major Basic Protein |
| β2-adrenergic Receptor Kinase | Endothelin Receptor A |
| Endothelin Receptor B | Preproendothelin |
| Bradykinin B2 Receptor (B2BR) | IgE (High Affinity Receptor) |
| Interleukin-1 (IL-1) | Interleukin 1 Receptor (IL-1 R) |
| Interleukin-9 (IL-9) | Interleukin-9 Receptor (IL-9 R) |
| Interleukin-11 (IL-11) | Interleukin-11 Receptor (IL-11 R) |
| Inducible Nitric Oxide Synthase | Cyclooxygenase (COX) |
| Intracellular Adhesion Molecule 1 (ICAM-1) | Vascular Cellular Adhesion Molecule (VCAM) |
| Substance P | |

TABLE 1-continued

Pulmonary Disease or Condition Pulmonary and Inflammation Targets

| | |
|---|---|
| Rantes | Endothelial Leukocyte Adhesion Molecule Endothelin ETA (ELAM-1) |
| Receptor | |
| Cyclooxygenase-2 (COX-2) | GM-CSF, Endothelin-1 |
| Monocyte Activating Factor | Neutrophil Chemotactic Factor |
| Neutrophil Elastase | Defensin 1, 2, 3 |
| Muscarinic Acetylcholine Receptors | Platelet Activating Factor |
| Tumor Necrosis Factor α | 5-lipoxygenase |
| Phosphodiesterase IV | Substance P |
| Substance P Receptor | Histamine Receptor |
| Chymase | CCR-1 CC Chemokine Receptor |
| Interleukin-2 (IL-2) | Interleukin-4 (IL-4) |
| Interleukin-12 (IL-12) | Interleukin-5 (IL-5) |
| Interleukin-6 (IL-6) | Interleukin-7 (IL-7) |
| Interleukin-8 (IL-8) | Interleukin-12 Receptor (IL-12R) |
| Interleukin-7 Receptor (IL-7R) | Interleukin-1 (IL-1) |
| Interleukin-14 Receptor (IL-14R) | Interleukin-14 |
| CCR-2 CC Chemokine Receptor | CCR-3 CC Chemokine Receptor |
| CCR-4 CC Chemokine Receptor | CCR-5 CC Chemokine Receptor |
| Prostanoid Receptors | GATA-3 Transcription Factor |
| Neutrophil Adherence Receptor | MAP Kinase |
| Interleukin-15 (IL-15) | Interleukin-15 Receptor (IL-15R) |
| Interleukin-11 (IL-11) | Interleukin-11 Receptor (IL-11R) |
| NFAT Transcription Factors | STAT 4 |
| MIP-1α | MCP-2 |
| MCP-3 | MCP-4 |
| Cyclophillin (A, B, etc.) | Phospholipase A2 |
| Basic Fibroblast Growth Factor | Metalloproteinase |
| CSBP/p38 MAP Kinase | Tryptase Receptor |
| PDG2 | Interleukin-3 (IL-3) |
| Interleukin-10 (IL-10) | Cyclosporin A - Binding Protein |
| FK506-Binding Protein | α4β1 Selectin |
| Fibronectin | α4β7 Selectin |
| cMad CAM-1 | LFA-1 (CD11a/CD18) |
| PECAM-1 | LFA-1 Selectin |
| C3bi | PSGL-1 |
| E-Selectin | P-Selectin |
| CD-34 | L-Selectin |
| p150,95 | Mac-1 (CD11b/CD18) |
| Fucosyl transferase | VLA-4 |
| STAT-1 | STAT-2 |
| CD-18/CD11a | CD11b/CD18 |
| ICAM2 and ICAM3 | C5a |
| CCR3 (Eotaxin Receptor) | CCR1, CCR2, CCR4, CCR5 |
| LTB-4 | AP-1 Transcription Factor |
| Protein kinase C | Cysteinyl Leukotriene Receptor |
| Tachykinnen Receptors (tach R) | 16B Kinase 1 & 2 |
| Interleukin-2 Receptor (IL-2R) | (e.g., Substance P, NK-1 & NK-3 Receptors) |
| STAT 6 | c-mas |
| NF-Interleukin-6 (NF-IL-6) | Interleukin-10 Receptor (IL-10R) |
| Interleukin-3 (IL-3) | Interleukin-2 Receptor (IL-2R) |
| Interleukin-13 (IL-13) | Interleukin-12 Receptor (IL-12R) |
| Interleukin-14 (IL-14) | Interleukin-6 Receptor (IL-6R) |
| Interleukin-16 (IL- 16) | Interleukin-13 Receptor (IL-13R) |
| Medullasin | Interleukin-16 Receptor (IL-16R) |
| Adenosine $A_1$ Receptor ($A_1$ R) | Tryptase-1 |
| Adenosine $A_{2b}$ Receptor ($A_{2b}$ R) | Adenosine $A_3$ Receptor ($A_3$ R) |
| β Tryptase | STAT-3 |
| Adenosine $A_{2a}$ Receptor ($A_{2a}$ R) | IgE Receptor β Subunit (IgE R β) |
| Fc-epsilon receptor CD23 antigen | IgE Receptor α Subunit (IgE R α) |
| IgE Receptor Fc Epsilon Receptor (IgERFc ξ R) | Substance P Receptor |
| Histidine decarboxylase | Tryptase-1 |
| Prostaglandin D Synthase | Eosinophil Cationic Protein |
| Eosinophil Derived Neurotoxin | Eosinophil Peroxidase |
| Endothelial Nitric Oxide Synthase | Endothelial Monocyte Activating Factor |
| Neutrophil Oxidase Factor | Cathepsin G |
| Macrophage Inflammatory Protein-I- | Interleukin-8 Receptor α Subunit (IL-8 Rα) |
| Alpha/Rantes Receptor | Endothelin Receptor ET-B |

These genes, and others, are involved in the normal functioning of respiration as well as in diseases associated with respiratory pathologies, including cystic fibrosis, asthma, pulmonary hypertension and vasoconstriction, chronic obstructive pulmonary disease (COPD), pulmonary transplantation rejection, pulmonary infections, chronic bronchitis, respiratory distress syndrome (ARDS), allergic rhinitis, lung cancer and lung metastatic cancers and other airway diseases, including those with inflammatory response.

Anti-sense oligos to the target receptors, e. g. the adenosine $A_1$, $A_{2a}$, $A_{2b}$, and $A_3$ receptors, CCR3 (chemokine receptors), bradykinin 2B, CAM (vascular cell adhesion molecule), and eosinophil receptors, among others, have been shown to be effective in down-regulating the expression of their genes. Some of these act to alleviate the symptoms or reduce respiratory ailments and/or inflammation, for example, by "down regulation" of the adenosine $A_1$, $A_{2a}$, $A_{2b}$, and/or $A_3$ receptors and CCR3, bradykinin 2B, VCAM (vascular cell adhesion molecule) and eosinophil receptors. These agents may be utilized by the present method alone or in conjunction with anti-sense oligos targeted to other genes to validate pathway and/or networks in which they are involved. For better results, the oligos are preferably administered directly into the respiratory system, e.g., by inhalation or other means, of the experimental animal, so that they may reach the lungs without widespread systemic dissemination. This permits the use of low agent doses as compared with those administered systemically or by other generalized routes and, consequently, reduces the number and degree of undesirable side effects resulting from the agent=s widespread distribution in the body. The agent(s) of this invention has (have) been shown to reduce the amount of receptor protein expressed by the tissue. These agents, thus, rather than merely interacting with their targets, e.g a receptor, lower the number of target proteins that other drugs may interact with. In this manner, the present agent(s) afford(s) extremely high efficacy with low toxicity. Anti-sense oligonucleotides to the $A_1$, $A_{2b}$, $A_3$, bradykinin B2, GATA-3, CAM (vascular cell adhesion molecule), eosinophil receptors, and COX-2 receptors, among others, have been shown to be effective in the down-regulation of the respective receptor proteins in the cell. One novel feature of this treatment, as compared to traditional treatments for adenosine-mediated bronchoconstriction, is that administration is direct to the lungs, or in situ to other tissues, organs or systems of the body. Additionally, a receptor protein itself is reduced in amount, rather than merely interacting with a drug, and toxicity is reduced. Other proteins that may be targeted with anti-sense agents for the treatment of lung conditions include, but are not limited to: CCR3 (chemokine) receptors, human $A_{2a}$ adenosine receptor, human $A_{2b}$ adenosine receptor, human IgE receptor β, human Fc-epsilon receptor CD23 antigen, human histidine decarboxylase, human beta tryptase, human tryptase-I, human prostaglandin D synthase, human cyclooxigenase-2, human eosinophil cationic protein, human eosinophil derived neurotoxin, human eosinophil peroxidase, human intercellular adhesion molecule-1 (ICAM-1), human vascular cell adhesion molecule-1 (VCAM-1), human endothelial leukocyte adhesion molecule-1 (ELAM-1), human P selectin, human endothelial monocyte activating factor, human IL-3, human IL4, human IL-5, human IL-6, human IL-8, human monocyte-derived neutrophil chemotactic factor, human neutrophil elastase, human neutrophil oxidase factor, human cathepsin G, human defensin 1, human defensin 3, human macrophage inflammatory protein-1-alpha, human muscarinic acetylcholine receptor HM3, human fibronectin, human GM-CSF, human tumor necrosis factor a, human leukotriene C4 synthase, human major basic protein, and human endothelin 1. Although not intended to be exclusive, a more extensive list of genes is provided below. Some of these act to alleviate the symptoms or reduce respiratory ailments and/or inflammation, for example, by "down regulation" of the adenosine $A_1$, $A_{2a}$ $A_{2b}$, and/or $A_1$ receptors and CCR3, bradykinin 2B, VCAM (vascular cell adhesion molecule) and eosinophil receptors. These agents are preferably administered directly into the respiratory system, e.g., by inhalation or other means, so that they may reach the lungs without widespread systemic dissemination. This permits the use of substantially lower doses of the agent of the invention as compared with those administered by the prior art, systemically or by other generalized routes and, consequently, reduce undesirable side effects resulting from the agent=s widespread distribution in the body. The agent(s) of this invention has (have) been shown to reduce the amount of receptor protein expressed by the tissue. These agents, thus, rather than merely interacting with their targets, e.g. a receptor, lower the number of target proteins that other drugs may interact with. In this manner, the present agent(s) afford(s) extremely high efficacy with low toxicity. In these latter targets, and in target genes in general, it is particularly imperative to eliminate or reduce the adenosine content of the corresponding anti-sense oligonucleotide to prevent their breakdown products from liberating adenosine.

As used herein, the term "treat" or "treating" asthma refers to a treatment which decreases the likelihood that the subject administered such treatment will manifest symptoms of the lung disease. The term "downregulate" refers to inducing a decrease in production, secretion or availability (and thus a decrease in concentration) of the targeted intracellular protein. The present invention is concerned primarily with the treatment of human subjects. However, the agents and methods disclosed here may also be employed for veterinary purposes, such as is the case in the treatment of other mammals, such as cattle, horses, wild animals, zoo animals, and domestic animals, e. g. dogs and cats. Targeted proteins are preferably mammalian and more preferably of the same species as the subject being treated. In general, "anti-sense" refers to the use of small, synthetic oligonucleotides, resembling single-stranded $DNA_1$ to inhibit gene expression by inhibiting the function of the target messenger RNA (mRNA). Milligan, J. F. et al., J. Med. Chem. 36(14), 1923–1937 (1993). In the present invention, inhibition of gene expression of the $A_1$ or $A_3$ adenosine receptor is desired. Gene expression is inhibited through hybridization to coding (sense) sequences in a specific messenger RNA (mRNA) target by hydrogen bonding according to Watson-Crick base pairing rules. The mechanism of anti-sense inhibition is that the exogenously applied oligonucleotides decrease the mRNA and protein levels of the target gene or cause changes in the growth characteristics or shapes of the cells. Id. See, also Helene, C. and Toulme, J., Biochim. Biophys. Acta 1049, 99–125 (1990); Cohen, J. S. D., Ed., Oligodeoxynucleotides as Anti-sense Inhibitors of Gene Expression; CRC Press: Boca Raton, Fla. (1987). As used herein, "anti-sense oligonucleotide" is defined as a short sequence of synthetic nucleotide that (1) hybridizes to any coding sequence in an mRNA which codes for the targeted protein, according to hybridization conditions described below, and (2) upon hybridization causes a decrease in gene expression of the $A_1$ or $A_3$ adenosine receptor. The receptors discussed above are mere examples of the high power of the present technology. In fact, a large number of genes may be targeted in a similar manner by practicing the present methods, to significantly down-regulate or obliterate protein expression and observe any changes wrought to one or more functions within a system, e.g. the respiratory system and other lung disease associated targets. By means of example, in the respiratory system, the targets may be associated with difficulties of breathing, bronchoconstriction, inflammation, allergic rhynitis, chronic bronchitis, surfactant depletion, and others associated with diseases and conditions such as chronic obstructive pulmonary disease (COPD), pulmonary transplantation rejection, pulmonary infections, inhalation bums, Acute Respiratory Distress Syndrome (ARDS), cystic fibrosis, pulmonary fibrosis, radiation pulmonitis, tonsilitis, emphysema, dental pain, oral inflammation, joint pain, esophagitis, cancers afflicting the respiratory system either directly such as lung cancer, esophageal cancer, and the like, or indirectly by means of metastases, among others. These functions are of great interest because of their association with respiratory dysfunction, as is the case in asthma, allergies, allergic rhinitis, pulmonary bronchoconstriction and hypertension, chronic obstructive pulmonary disease (COPD), pulmonary transplantation rejection, pulmonary infections, allergy, asthma, cystic fibrosis (CF), Acute Respiratory Distress Syndrome (ARDS) as well as infantile and pregnancy-related RDS, cancer, etc., which either directly or by metastasis afflict the lung, the present anti-sense oligonucleotides may be directed to a list of target mRNAs, which includes the targets listed in Table 1 above, among others.

The oligos of this invention may be obtained by first selecting fragments of a target nucleic acid having at least 4 contiguous nucleic acids selected from the group consisting of G and C and/or having a specific type and/or extent of activity, and then obtaining a first oligonucleotide 4 to 60 nucleotides long which comprises the selected fragment and has a thymidine (T) nucleic acid content of up to and including about 15%, preferably, about 12%, about 10%, about 7%, about 5%, about 3%, about 1%, and more preferably no thymidine. The latter step may be conducted by obtaining a second oligonucleotide 4 to 60 nucleotides long comprising a sequence which is anti-sense to the selected fragment, the second oligonucleotide having an adenosine base content of up to and including about 15%, preferably about 12%, about 10%, about 7%, about 5%, about 3%, about 1%, and more preferably no adenosine. When the selected fragment comprises at least one thymidine base, an adenosine base may be substituted in the corresponding anti-sense nucleotide fragment with a universal base selected from the group consisting of heteroaromatic bases which bind to a thymidine base but have less than about bout 10%, preferably less than about 1%, and more preferably less than about 0.3% of the adenosine base agonist activity at the adenosine $A_1$, $A_{2a}$, $A_{2b}$ and $A_3$ receptors, and heteroaromatic bases which have no activity at the adenosine $A_{2a}$ receptor, when validating in the respiratory system. Other adenosine activities in other systems may be determnined in other systems, as appropriate. The analogue heteroaromatic bases may be selected from all pyrimidines and purines, which may be substituted by O, halo, $NH_2$, SH, SO, $SO_2$, $SO_3$, COOH and branched and fused primary and secondary amino, alkyl, alkenyl, alkynyl, cycloalkyl, heterocycloalkyl, aryl, heteroaryl, alkoxy, alkenoxy, acyl, cycloacyl, arylacyl, alkynoxy, cycloalkoxy, aroyl, arylthio, arylsulfoxyl, halocycloalkyl, alkylcycloalkyl, alkenylcycloalkyl, alkynylcycloalkyl, haloaryl, alkylaryl, alkenylaryl, alkynylaryl, arylalkyl, arylalkenyl, arylalkynyl, arylcycloalkyl, which may be further substituted by O, halo, $NH_2$, primary, secondary and tertiary amine, SH, SO, $SO_2$, $SO_3$, cycloalkyl, heterocycloalkyl and heteroaryl. The pyrimidines and purines may be substituted at all positions as is known in the art, but preferred are those which are substituted at positions 1, 2, 3, 4, 7 and/or 8. More preferred are pyrimidines and purines such as theophylline, caffeine, dyphylline, etophylline, acephylline piperazine, bamifylline, enprofylline and xantine having the chemical formula

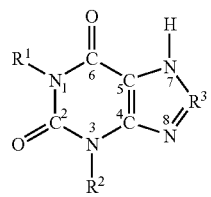

wherein $R^1$ and $R^2$ are independently H, alkyl, alkenyl or alkynyl and $R^3$ is H, aryl, dicycloalkyl, dicycloalkenyl, dicycloalkynyl, cycloalkyl, cycloalkenyl, cycloalkynyl, O-cycloalkyl, O-cycloalkenyl, O-cycloalkynyl, $NH_2$-alkylamino-ketoxyalkyloxy-aryl, mono and dialkylaminoalkyl-N-alkylamino-$SO_2$aryl, among others. Similar modifications in the sugar are also embodiments of this invention. Reduced adenosine content of the anti-sense oligos corresponding to the thymidines (T) present in the target RNA serves to prevent the breakdown of the oligos into products that free adenosine into the system, e.g. the lung, brain, heart, kidney, etc., tissue environment and, thereby, to prevent any unwanted effects due to it. By means of example, the Nf6B transcription factor may be selected as a target, and its mRNA or DNA searched for low thymidine (T) or desthymidine (desT) fragments. Only desT segments of the mRNA or DNA are selected which, in turn, will produce desA anti-sense as their complementary strand. When a number of RNA desT segments are found, the sequence of the anti-sense segments may be deduced. Typically, about 10 to 30 and even larger numbers of desA anti-sense sequences may be obtained. These anti-sense sequences may include some or all desA anti-sense oligonucleotide sequences corresponding to desT segments of the mRNA of the target, such as anyone of those shown in Table 1 above, in Table 2 below, and others associated with functions of the brain, cardiovascular and renal systems, and many others. When this occurs, the anti-sense oligonucleotides found are said to be 100% A-free. For each of the original desA anti-sense oligonucleotide sequences corresponding to the target gene, e.g. the NF6B transcription factor, typically about 10 to 30 sequences may be found within the target gene or RNA which have a low content of thymidine (RNA). In accordance with this invention, the selected fragment sequences may also contain a small number of thymidine (RNA) nucleotides within the secondary or tertiary or quaternary sequences. In some cases, a large adenosine content may suffice to render the anti-sense oligonucleotide less active or even inactive against the target. In accordance with this invention, these so called "non-fully desA" sequences may preferably have a content of adenosine of less than about 15%, about 12%, about 10%, about 7%, about 5%, and about 2% adenosine. Most preferred is no adenosine content (0%). In some instances, however, a higher content of adenosine is acceptable and the oligonucleotides still fail to show detrimental "adenosine activity". A particular important embodiment is that where the adenosine nucleotide is "fixed" or replaced by a "Universal or alterative" base that may base-pair with similar or equal affinity to two or more of the four nucleotide present in natural DNA: $A_1$ G, C, and T.

A universal or alternative base is defined in this patent as any compound, more commonly an adenosine analogue, which has substantial capacity to hybridize to thymidine, while at the same time having reduced, or substantially lacking, ability to bind adenosine receptors or other molecules through which adenosine may exert an undesirable side effect in the experimental animal or in a cell system. Alternatively, adenosine analogs which completely fail to activate, or have significantly reduce ability for activating, adenosine receptors, such as the adenosine $A_1$, $A_{2b}$ and/or $A_3$ receptors, most preferably $A_1$ receptors, and those that may even act as agonists of the adenosine $A_{2a}$, receptor, may be used. One example of a universal base is α-deoxyribofuranosol-(5-nitroindole), and an artisan will know how to select others. This "fixing" step generates further novel sequences, different from those anti-sense to the ones found in nature, that permits the anti-sense oligonucleotide to bind, preferably equally well, with the target RNA. Other examples of universal or alternative bases are 2-deoxyribosyl-(5-nitroindole). Other examples of universal bases are 3-nitropyrrole-2'-deoxynucleoside, 5-nitro-indole, 2-deoxyribosyl-(5-nitroindole), 2-deoxyribofuranosyl-(5-nitroindole), 2'-deoxyinosine, 2'-deoxynebularine, 6H, 8H-3,4-dihydropyrimido [4, 5-c]oxazine-7-one and 2-amino-6-methoxy aminopurine. In addition to the above, Universal bases which may be substituted for any other base although with somewhat reduced hybridization potential, include 3-nitropyrrole 2'-deoxynucleoside 2-deoxyribofaranosyl-(5-nitroindole), 2'-deoxyinosine and 2'-deoxynebularine (Glen Research, Sterling, Va.). More specific mismatch repairs may be made using "P" nucleotide, 6H, 8H -3,4 -dihydropyrimido [4,5-c][1,2] oxazin-7-one, which base pairs with either guanine (G) or adenine (A) and "K" nucleotide, 2-amino-6-methoxyaminopurine, which base pairs with either cytidine (C) or thymidine (T), among others. Others which are known in the art or will become available are also suitable. See, for example, Loakes, D. and Brown, D. M., Nucl. Acids Res. 22:4039–4043 (1994); Ohtsuka, E. et al., J. Biol. Chem. 260(5):2605–2608 (1985); Lin, P. K. T. and Brown, D. M., Nucleic Acids Res. 20(19):5149–5152 (1992; Nichols, R. et al., Nature 369(6480): 492–493 (1994); Rahmon , M. S. and Humayun, N. Z., Mutation Research 377 (2): 263–8 (1997); Amosova, O., et al., Nucleic Acids Res. 25 (10): 1930–1934 (1997); Loakes D. & Brown, D. M., Nucleic Acids Res. 22 (20): 4039–4043 (1994), the entire sections relating to universal bases and their preparation and use in nucleic acid binding being incorporated herein by reference. When non-fully desT sequences are found in the naturally occurring target, they typically are selected so that about 1 to 3 universal base substitutions will suffice to obtain a 100% "desA" anti-sense oligonucleotide. Thus, the present method provides either anti-sense oligonucleotides to different targets which are low in, or devoid of, A content, as well as anti-sense oligonucleotides where one or more adenosine nucleotides, e. g. about 1 to 3, or more, may be "fixed" by replacement with a "Universal" or "replacement" base. Universal bases are known in the art and need not be listed herein. An artisan will know which bases may act as universal bases, and replace them for A. Table 2 below provides a selected number of targets to which the agents of the invention are effectively applied. Others, however, may also be targeted.

TABLE 2

Cancer Targets

| Transforming Oncogenes | Therapy Targets |
|---|---|
| ras | thymidylate synthetase |
| src | thymidylate synthetase |
| myc | dihydrofolate reductase |
| bcl-2 | thymidine kinase |
|  | deoxycytidine kinase |
|  | ribonucleotide reductase |
| Angiogenesis factors | Adhesion Molecules |
| Oncogenes | Folate Pathway Enzymes |
| DNA repair genes | (One Carbon Pool) |
|  | Telomerase |
|  | HMG CoA Reductase |
|  | Farnesyl Transferase |
|  | Glucose-6-Phosphate Transferase |

A group of preferred targets for the treatment of cancer are genes associated with any of different types of cancers, or those generally known to be associated with malignancies, whether they are regulatory or involved in the production of RNA and/or proteins. Examples are transforming oncogenes, including, but not limited to, ras, src, myc, and BCL-2, among others. Other targets are those to which present cancer chemotherapeutic agents are directed to, such as various enzymes, primarily, although not exclusively, thymidylate synthetase, dihydrofolate reductase, thymidine kinase, deoxycytidine kinase, ribonucleotide reductase, and the like. The present technology is particularly useful in the treatment of cancer ailments given that traditional cancer therapies are fraught with the unresolved problem of selectively killing cancer cells while preserving normal living cells from the devastating effects of treatments such as chemotherapy, radiotherapy, and the like. The present technology provides the ability of selectively attenuating or enhancing a desired pathway or target. This approach provides a significant advantage over standard treatments of cancer because it permits the selection of a pathway, including primary, secondary and possibly tertiary targets, which are not generally expressed simultaneously in normal cells. Thus, the present agent may be administered to a subject to cause a selective increase in toxicity within tumor cells that, for instance, express all three targets while normal cells that may expresses only one or two of the targets will be significantly less affected or even spared. A group of preferred targets for the treatment of cancers are genes associated with different types of cancers, or those generally known to be associated with malignancies, whether they are regulatory or involved in the production of RNA and/or proteins. Examples are transforming oncogenes, including, but not limited to, ras, src, myc, and BCL-2, among others. Other targets are those to which present cancer chemotherapeutic agents are directed to, such as various enzymes, primarily, although not exclusively, thymidylate synthetase, dihydrofolate reductase, thymidine kinase, deoxycytidine kinase, ribonucleotide reductase, and the like.

In one embodiment, at least one of the mRNAs to which the oligo of the invention is targeted encodes a protein such as transcription factors, stimulating and activating factors, intracellular and extracellular receptors and peptide transmitters in general, interleukins, interleukin receptors, chemokines, chemokine receptors, endogenously produced specific and non-specific enzymes, immunoglobulins, antibody receptors, central nervous system (CNS) and peripheral nervous and non-nervous system receptors, CNS and peripheral nervous and non-nervous system peptide transmitters, adhesion molecules, defensines, growth factors, vasoactive peptides and receptors, and binding proteins, among others; or the mRNA is corresponding to an oncogene and other genes associated with various diseases or conditions. Examples of target proteins are eotaxin, major basic protein, preproendothelin, eosinophil cationic protein, P-selectin, STAT 4, MIP-1α, MCP-2, MCP-3, MCP-4, STAT 6, c-mas, NF-IL-6, cyclophillins, PDG2, cyclosporin A-binding protein, FK5-binding protein, fibronectin, LFA-1 (CD11a/CD18), PECAM-1, C3bi, PSGL-1,CD-34, substance P, p150,95, Mac-1 (CD11b/CD18), VLA-4, CD-18/CD11a, CD11b/CD18, C5a, CCR1, CCR2, CCR4, CCR5, and LTB-4, among others. Others are, however, suitable, as well. In another embodiment, at least one of the mRNAs to which the oligo is targeted encodes intracellular and extracellular receptors and peptide transmitters such as sympathomimetic receptors, parasympathetic receptors, GABA receptors, adenosine receptors, bradykinin receptors, insulin receptors, glucagon receptors, prostaglandin receptors, thyroid receptors, androgen receptors, anabolic receptors, estrogen receptors, progesterone receptors, receptors associated with the coagulation cascade, adenohypophyseal receptors, adenohypophyseal peptide transmitters, and histamine receptors (HisR), among others. However others are also contemplated. The encoded sympathomimetic receptors and parasympathomimetic receptors include acetylcholinesterase receptors (AcChaseR) acetylcholine receptors (AcChR), atropine receptors, muscarinic receptors, epinephrine receptors (EpiR), dopamine receptors (DOPAR), and norepinephrine receptors (NEpiR), among others. Further examples of encoded receptors are adenosine $A_1$ receptor, adenosine $A_2B$ receptor, adenosine $A_3$ receptor, endothelin receptor $A_1$ endothelin receptor B, IgE high affinity receptor, muscarinic acetylcholine receptors, substance P receptor, histamine receptor, CCR-1 CC chemokine receptor, CCR-2 CC chemokine receptor, CCR-3 CC chemokine receptor (Eotaxin Receptor), interleukin-1β-receptor (IL-1βR), interleukin-1 receptor (IL-1R), interleukin-1βreceptor (IL-1βR), interleukin-3 receptor (IL-3R), CCR-4 CC chemokine receptor, cysteinyl leukotriene receptors, prostanoid receptors, GATA-3 transcription factor receptor, interleukin-1 receptor (IL-1R), interleukin4 receptor (IL4R), interleukin-5 receptor (IL-5R), interleukin-8 receptor (IL-8R), interleukin-9 receptor (IL-9R), interleukin-11 receptor (IL-11R), bradykinin B2 receptor, sympathomimetic receptors, parasympathomimetic receptors, GABA receptors, adenosine receptors, bradykinin receptors, insulin receptors, glucagon receptors, prostaglandin receptors, thyroid receptors, androgen receptors, anabolic receptors, estrogen receptors, progesterone receptors, receptors associated with the coagulation cascade, adenohypophyseal receptors, and histamine receptors (HisR). Others are also contemplated even though not listed herein. The encoded enzymes for development of the oligos of the invention include synthetases, kinases, oxidases, phosphatases, reductases, polysaccharide, triglyceride, and protein hydrolases, esterases, elastases, and , polysaccharide, triglyceride, lipid, and protein synthases, among others. Examples of target enzymes are tryptase, inducible nitric oxide synthase, cyclooxygenase (Cox), MAP kinase, eosinophil peroxidase, β2-adrenergic receptor kinase, leukotriene c-4 synthase, 5-lipooxygenase, phosphodiesterase IV, metalloproteinase, tryptase, CSBP/p38 MAP kinase, neutrophil elastase, phospholipase $A_2$, cyclooxygenase 2 (Cox-2), fucosyl transferase, chymase, protein kinase C, thymidylate synthetase, dihydrofolate reductase, thymidine kinase, deoxycytidine kinase, and ribonucleotide reductase, among others. Any enzyme associated with a disease or condition, however, is suitable as a target for this invention. Suitable encoded factors for application of this invention are, among others, Nf6B transcription factor, granulocyte macrophage colony stimulating factor (GM-CSF), AP-1 transcription factor, GATA-3 transcription factor, monocyte activating factor, neutrophil chemotactic factor, granulocyte/macrophage colony-stimulating-factor (G-CSF), NFAT transcription factors, platelet activating factor, tumor necrosis factor α (TNF α), and basic fibroblast growth factor (BFGF). Additional factors are also within the invention even though not specifically mentioned. Suitable adhesion molecules for use with this invention include intracellular adhesion molecules 1 (ICAM-1), 2 (ICAM-2) and 3 (ICAM-3), vascular cellular adhesion molecule (VCAM), endothelial leukocyte adhesion molecule-1 (ELAM-1), neutrophil adherence receptor, mad CAM-1, and the like. Other known and unknown factors (at this time) may also be targeted herein. Among the cytokines, lymphokines and chemokines preferred are interleukin-1 (IL-1), interleukin-1β (IL-1β), interleukin-3 (IL-3), interleukin-4 (IL-4), interleukin-5 (IL-5), interleukin-8 (IL-8), interleukin-9 (IL-9), interleukin-11 (IL-11),CCR-5 CC chemokine, and Rantes. Others, however, may also be targeted, as they are known to be involved in specific diseases or conditions to be treated, or for their generic activities, such as inflammation. Examples of defensins for the practice of this invention are defensin 1, defensin 2, and defensin 3, and of selectins are α4β1 selectin, α4β7 selectin, LFA-1 selectin, E-selectin, P-selectin, and L-selectin. Examples of oncogenes, although not an all inclusive list, are ras, src, myc, and bcBCL. Others, however, are also suitable for use with this invention.

The agents administered in accordance with this invention are preferably designed to be anti-sense to target genes and/or mRNAs related in origin to the species to which it is to be administered. When treating humans, the agents are preferably designed to be anti-sense to a human gene or RNA. The agents of the invention encompass oligonucleotides which are anti-sense to naturally occurring DNA and/or RNA sequences, fragments thereof of up to a length of one (1) base less than the targeted sequence, preferably at least about 7 nucleotides long, oligos having only over about 0.02%, more preferably over about 0.1%, still more preferably over about 1%, and even more preferably over about 4% adenosine nucleotides, and up to about 30%, more preferably up to about 15%, still more preferably up to about 10% and even more preferably up to about 5%, adenosine nucleotide, or lacking adenosine altogether, and oligos in which one or more of the adenosine nucleotides have been replaced with so-called universal bases, which may pair up with thymidine nucleotides but fail to substantially trigger adenosine receptor activity. Examples of human sequences and fragments, which are not limiting, of anti-sense oligonucleotide of the invention are the following fragments as well as shorter segments of the fragments and of the fall gene or mRNA coding sequences, exons and intron-exon junctions encompassing preferably 7, 10, 15, 18 to 21, 24, 27, 30, n-1 nucleotides for each sequence, where n is the sequence=s total number of nucleotides. These fragments may be selected from any portion of the longer oligo, for example, from the middle, 5'-end, 3'-end or starting at any other site of the original sequence. Of particular importance are fragments of low adenosine nucleotide content, that is, those fragments containing less than or about 30%, preferably less than or about 15%, more preferably less than or about 10%, and even more preferably less than or about 5%, and most preferably those devoid of adenosine nucleotide, either by choice or by replacement with a universal base in accordance with this invention. The agent of the invention includes as a most preferred group sequences and their fragments where one or more adenosines present in the sequence have been replaced by a universal base (B), as exemplified here. Similarly, also encompassed are all shorter fragments of the B-containing fragments designed by substitution of B(s) for adenosine(s) (A(s)) contained in the sequences, fragments thereof or segments thereof, as described above. A limited list of sequences and fragments is provided below.

Some of the examples of anti-sense oligonucleotide sequence fragments target the initiation codon of the respective gene, and in some cases adenosine is substituted with a universal or alternative base adenosine analogue denoted as "B", which lacks ability to bind to the adenosine $A_1$ and/or $A_3$ receptors. In fact, such replacement nucleotide acts as a "spacer". Many of the examples shown below provide one such sequence and many fragments overlapping the initiation codon, preferably wherein the number of nucleotides n is about 7, about 10, about 12, about 15, about 18, about 21 and up to about 28, about 35, about 40, about 50, about 60.

```
Human Receptor-related Antisense Polynucleotide

5'-GGCGGCCTGG AAAGCTGAGA TGGAGGGCGG CATGGCGGGC ACAGGCTGGG C TGCTTTTCT TTTCTGGGCC

TCTGTGGTCT GTTTTTTTCT GGCCCTGCTG GGGCGCTCTC CGCCGCCCGC CTGGCTCCCG GBGCCBTGB

TGGGCBTGCC GTGGTTCTTG CCCTCCTTTG GCTGCCGTGC CCGCTCCCCG GCCTCCTGGC GGGTGGCCGT

TGGGCCCGTG TTCCCCTGGG GCCTGGGGCT CCCTTCTCTC GCCCTTCTTG CTGGGCCTCT GCTGCTGCTG

GTGCTGTGGC CCCCGTACA CCGAGGAGCC CATGATGGGC ATGCCACAGA CGACAGGCGT BCBCCGBGGB

GCCCBTGBTG GGCBTGCCBC BGBCGBCBGG C GGC GCC GTG CCG CGT CTT GGT GGC GGC GG GTT CGC GCC

CGC GCG GGG CCC CTC CGG TCC GTT CGC GCC CGC GCG GGG CCC CTC CGG TCC CGG GTC GGG GCC CCC

CGC GGC C GCC TCG GGG CTG GGG CGC TGG TGG CCG GG CCG CGC CTC CGC CTG CCG CTT CTG GCT GGG

CCC CGG GCG CCC CCT CCC CTC TTG CTC GGG TCC CCG TG ACA GCG CGT CCT GTG TCT CCA GCA GCA TGG

CCG GGC CAG CTG GGC CCC BCB GCG CGT CCT GTG TCT CCB GCB GCB TGG CCG GGC CBG CTG GGC CCC ACA
```

-continued

```
GAG CAG TGC TGT TGT TGG GCA TCT TGC CTT CCC AGG G BCB GBG CB TGC TGT TGT TGG GCB TCT TGC CTT
CCC BGG GCC CTT TTC TGG TGG GGT GGT GCT GTT GTT GGG CTT TCT TCT GTT CCC BCB GBG CBG TGC TGT
TGT TGG GCB TCT TGC CTT CCC BGG GCC CTT TTC TGG TGG GGT GGT GCT GTT GTT GGG C TTT CTT CTG TTC
CC TTT CCC CTG GGT CTT CC CTC CTG CTC TTT TTT C ATT TGC TCT CCT ATT ACT TTC TGT GTC CAT TTT
TTC ATT AAC CGA GCT GT BTT TGC TCT CCT BTT BCT TTC TGT GTC CBT TTT TTC BTT BBC CGB GCT GT GCC
TGT GTC TGT CCT CCT GCT TCG TTC CTC TCG TTC CTG CTT GGT GCC CTT GCC G GTC CTG CTC CTC CGG GCT
GTG G GTC GTG GCC CTG GCT CCG GCT GGT GGG CTC CCC TGG CCT TCG CTG GCT GGC GGC GTG C GGG
TCT TGC TCT GGG CCT GGC TGT GGC CGT GGT TGG GGG TCT TC GCT GCC TCC GTT TGG GTG GC TCT CTG
AAT ATT GAC CTT CCT CCA TGG CGG TCC TGC TTG GAT TCT CCC GA TCT CTG BBT BTT GBC CTT CCT CCB
TGG CGG TCC TGC TTG GBT TCT CCC GB GCC TTT CCT GGT TCT CTT GTT GTT TTT GGG GTT TGG CTT ACA
GTA GAG TAG GGG ATT CCA TGG CAG GAG CCA TCT TCT TCA TGG ACT CC TTC AAG GAG ACC TTA GGT TTC
TGA GGG ACT GCT AAC ACG CCA TCT GGA GC BCB GTB GBG TBG GGG BTT CCB TGG CBG GBG CCB TCT TCT
TCB TGG BCT CC TTC BBG GBG BCC TTB GGT TTC TGB GGG BCT GCT BBC BCG CCB TCT GGB GC GTT GTT
TTT GGG GTT TGG CTT GCC TTT CCT GGT TCT CTT BCB GTB GBG TBG GGG BTT CCB TGG CBG GBG CCB TCT
TCT TCB TGG BCT CC TTC BBG GBG BCC TTB GGT TTC TGB GGG BCT GCT BBC BCG CCB TCT GGB GC GCC TGT
GTC TGT CCT CCT GCT TCG TTC CTC TCG TTC CTG CTT GGT GCC CTT GCC G GTC CTG CTC CTC CGG GCT GTG
G GTC CTC GCC CTG GCT CCG GCT GGT GGG CTC CCC TGG CCT TCG CTG GCT GGC GGC GTG C CCC BGB BCG
BGB CCC GGB CCG BCB GGC CGT GGT TGG GGG TCT TC GCT GCC TCC GTT TGG GTG GC GAT CTC TGA ATA
TTGA CCT TCC ATG GCG GTC CTG CTT GGA GBT CTC TGB BTB TTGB CCT TCC BTG GCG GTC CTG CTT GGB
TCT GGG GTG TCC TGG CCT TCG TGG TTC CTC TTC CTT CGT TTG CCG TCC GCG GGG GCC CCC GGG CCT GGC
TGC GCT CCT GCC CCG CCT CTT TCC CGG GCT CTT GCG CTG GGG GGT GCT CC CGT GTG TTT GCG CCC TC
CTC CTG GTC GCG CTT GTC GTT TTG GGG CCG GCT TTG CCC GCC TCC CGG CGC CTG GCC CGG CC TTC CTG
GGC TGC GTG CGC GTT CTG TTC TTC TTC CTG GCT CTG GGG TGT CCT GGC CTT CGT GGT TCC TCT TCC TTC
GTT TGC CGT CCG CGG GGG CCC CCG GGC CT GGC TGC GCT CCT GCC CCG CCT CTT TCC CGG GCT CTT GCG
CTG GGG GGT GCT CCC GTG TGT TTG CGC CCT CCT CCT GGT CGC GCT TGT CGT TTT GG GGC CGG CTT TGC
CCG CCT CCC GGC GCC TGG CCC GGC CTT CCT GGG CTG CGT GCG CGT TCT GTT CTT CTT CCT GGC GCA GGA
GAC AGG GCA GGG CGA TCA GGA GCA GCG TGA GCC AAA GGA GGA CCA TCG GGA ACG CAG CTC CGG AAC
GCA GGA CAG AGG TGC C GC BGG BGB CBG GGC BGG GCG BTC BGG BGC BGC GTG BGC CBB BGG BGG BCC
BTC GGG BBC GCB GCT CCG GBB CGC BGG BCB GBG GTG CC TCT GCC CTG TCC GCC GGC TCT TCG GTG GCT
CGG CCC CGC TCC TTG TCT TGC CGC GGG TTG GTT CCT GGG CCT GGT TCT TGC GGG CGT TTC GGT CTG CTG
GCT GGT CTG GGC CCG CGG TGC GGC GGG TGG CTT GCT GTT CTG CCT GGG CTC TCC CCT CTC CTC CTT TTC
TCC CTT CCT CTG TCT TGC CTC CTT CCT CTG GGT CCT CTT GGC CTG GGC GCT CTT CCC CTC GGG CGG CTG
CGG GCG CTC GTG CTG CCT GGT CCG CTC CCT GGG GGT GCT CCT TCC CTT TCC CCG CTC GTG GGG TTT GCG
GGG CTG GGC TGC CCT GGG GGG TCT GGG CCT TTT GGG GTC GGC TGG CTG CTG CTT CGG GCC GCC TGG GCT
TCC CTG TGC CCC TTT CCT CTG CTG GGT CCC CCT CCC GTT CCA AGC TGC ACC GCA CAG ACC GGC GCT ACA
GGA CAG AGC CAG GCA AGC ACC CAT GGG GAT CCA GGC CCA GCT GTT CCB BGC TGC BCC GCB CBG BCC
GGC GCT BCB GGB CBG BGC CBG GCB BGC BCC CBT GGG GBT CCB GGC CCB GCT G CTCAGTGGCC
CCCAAAAGGA TGAGTAATAC ATGCGCCACG ATGATCATAT CCTTTTTACT ATGAGGCCGT GTCTGTCGTG
TCTTTCCTTT GCTCTTGGTG TGTCTTTGCT GTGCCCTGCC TCTCTGCCCG TGTCTGTCGT GTCTTTCCTT
TGCTCTTGGT GTGTCTTTGC TGTGCCCTGC CTCTCTGCC CGTGTCTGTC GTGTCTTTCC TTTGCTCTTG
```

```
GTGTGTCTTT GCTGTGCCCT GCCTCTCTGC GGGGGTGGCT TCCTGCCGCG TCTCTGGGCC GTCCCGTCCC
TCGGCCCCGC GCCGCGCTCG GCTCCTCTCC CTCTGGCCCG GCTCGGGGCG GGGCGGGGCG GTGGGCGGGC
GGCGCTGCCC TGCGCGCGGC GCTGGCCCCT GCTGGCCGTC GGCTGCCCGC TGCTGGCTGC CCTGCTGGCC
GCGCCGGGGC CTGTCCGCCT CTGCGGGCGC TGTCTCCTGG CTTGTCTTCC GGCTCTTCTG CTGGGGTGGG
GCTGGGCGGC CGGCCCGGTG CTGGGCTCC TCGGGGGGG GGGCTCTTCC GGGCTGTCTC CCTCCGGGGC
GGGGGTTTCT GGCCGTGGGG GTCTTGCCTG GCCTCCGGGC TCCTGCTTGT CTTGCCTTCC TTCTCTGGTC
GGTTGTGGCT CGGGGCTCCG TGGGTCCCTG GCGCCCGTTT GTGTTTTGTC TTTTCCCCTG GCGTCCCTGT
GCCCCTCTCC TCTCCTTCCT CTGCTTCTCG CTCTCCTTTG TGGGGCCCTC CCTGCTGCTC TTGGTTTTGG
GCTTTTTTTC TCTTCCTCCT TTTTCGTGCG TGGGCCTCC GCACGCCTCT TGCCACCTCC TGCGCAGGGC
AGCGCCTTGG GGCCAGCGCC GCTCCCGGCG CGGCCAGCAG GGCAGCCAGC AGCGCGCAGC CGACGGCCAG
CATGCTTCCT CCTCGGCTAC CACTCCATGG TCCCGCAGAG GCGGACAGGC GCBCGCCTC TTGCCBCCTC
CTGCGCBGGG CBGCGCCTTG GGGCCBGCGC CGCTCCCGGC GCGGCCBGCB GGGCBGCCBG CBGCGCGCBG
CCGBCGGCCB GCBTGCTTCC TCCTCGGCTB CCBCTCCBTG GTCCCGCBGB GGCGGBCBGG C GCTGCCCGGC
GGGGTGTGCG CTTGGCGCTC CCGTGCTCGG TTCTCTGTCT CCCGGTCCCC CTTGCCTGGC GTCTCGGGCC
TTCGTCCTCT TCCTCTTCTT CCTTCCGCTC CGTGGGGGCT GCTTGGTGGG GGCCTGTGCCT CGGGGTCCCG
GGGCTTCTGG CCCTTGCCGT TCATGGTGGC TAGGTGGGGC GTTCBTGGTG GCTBGGTGGG GC GGG GTG GGT
BGG CCG TGT CTG GGGGTT GGC CBT GTT GGT TGC CTCT TGG TGG TGC GCC GGG CGCG TCT TGG CTT TCT
TCT CCT TCG GGC CCT CGG GCC GGT GCT TGT GGGCT CCT CCC GGG CGG CCT CCC CGG GCG GGG GCT TCT
TGGCG CTG GCG GGG GGG CCT CCTGCT CTG TGG CTG GGC GTT CCT TGG TGT TCT GGG TGGTGG CGG GCG
TGG TGG CCT CTG TGGGGG CCC GCG GCT GCB GGG GTTG CCT GTC TGC TTC GTCCTT TGC GCT CCC GGG CCG
CCGGG GTG GGT AGG CCG TGT CTG GGGGTT GGC CAT GTT GGT TGC CGGG CCC GCG GCT GCA GGG G
ACAGGGGCTG TAATCTTCATC TGCAGGTGGC ATGCCAGTGA AATTTAGATC ATCAAAATCC CACATCTGTG
GATCTGTAAT ATTTGACATG TCCTCTTCAG TTTCAGCAAT GGTTTGATCT AACTGAAGCA CCGGCCAGGB
CBGGGGCTGT BBTCTTCBTC TGCBGGTGGC BTGCCBGTGB BBTTTBGBTC BTCBBBBTCC CBCBTCTGTG
GBTCTGTBBT BTTTGBCBTG TCCTCTTCBG TTTCBGCBB TGGTTTGBTC TBBCTGBBGC BCCGGCCBGG
TGGCTCGGTG CTTCTGCCCC TGTTGTTGCG GCGCTCGGTT GGTGTGGCCC CTGTGGTGCT TCGTTTCCCC
CTCTTTCTCT TTGTTCGGGG GTTCTTGTGG CGGGCTGCTT GTCTCGTTCC GCCCTGTCGG GCGGGAAGCC
TCTCTCCTCT CCCCAGATC CGCGACAGGC CGCAGGCAAG AACCAGCGCA ACCAGGGCGC GTCCGCACAG
ACTTGGAGGC GGCTGCATGC TGCTACCTGC TCCAGAAGCG TCCGGTGGCC GCCGCGCC CTGTCGGGCG
GGBBGCCTCT CTCCTCTCCC CBGBTCCGCG BCBGGCCGCB GGCBBGBBCC BGCGCBBCCB GGGCGCGTCC
GCBCBGBCTT GGBGGCGGCT GCBTGCTGCT BCCTGCTCGGGCG GGBBGCCTCCG GTGGCCGCCG CGCGTCCGGT
GGCCGCCGCG CCTCTCTCCT CTCCCCGTGG CCCTGTCGGG CGGGTCCTGC CGTCCTGTCT CCTTTTCTTT
TGCTGTCTTG TCTTCCCGTC TCTGCTTT GTCGTCCTC CCCGTCTCCT CCCACTGCTT CTCCCGGGGG
CTTCCCCGGC TTCGGGTGGC CGGTGTCCCG GGCTCCGGCG CGGCGGCGGC TTCGGCTGCG GGTGGGTGGC
GCGGGCTGCC GGGTCCGCGC GGCGCCTGGG CCCTTGTGCT GCTTTTTGCT TGTTCCGTTC TGGCTGCTCC
GGTCTGTGTT GTGGTTGTTT TGTTTCTTCT TGGGTGTGGG CCTTGCGGTT TTGGCTGTGG GCCCTTTGGG
GCCTTGGCTT CTGGCTCGTC TGTCCTCCCC GTCTCCTCCC ACTGCTTCT CCCGGGGGCT TCCCCGGCTT
CGGGTGGCCG GTGTCCCGGG CTCCGGCGCG GCGGCGGCTT CGGCTGCGGG TGGGTGGCGC GGGCTGCCGG
GTCCGCGCGG CGCCTGGGCC CTTGTGCTGC TTTTTGCTTG TTCCGTTCTG GCTGCTCCGG TCTGTGTTGT
```

-continued

```
GGTTGTTTTG TTTCTTCTTG GGTGTGGGCC TTGCGGTTTT GGCTGTGGGC CCTTTGGGGC CTTGGCTTCT
GGCTCCAT CCACATGATT GCTTAGATTT GTGCTGTATC TCTCAGGATT ATCACTGATT ACACATCCAA
CCAGTGCCAG CCAAAAGGAT GCCCTGAGGC AAAGGGTTTC CATCTTGAGG CAAATTTGAG GACBTCCBC
BTGBTTGCTT BGBTTTGTGC TGTBTCTCTC BGGBTTBTCB CTGBTTBCBC BTCCBBCCBG TGCCBGCCBB
BBGGBTGCCC TGBGGCBBBG GGTTTCCBTC TTGBGGCBBB TTTGBGGBGGGCTBBGBT GBTCCBCBTC BCTBCCBCGT
TGCCCBCCBC BGBGGTCBCC BCBBTGBCCG TGTBGGCBGC TGCCCBBBGG BCBBTTGCC BGGCTGGTTG
CBCGBBCTGB TTGGGTTCCG BGGTGTTBGT GGBGBTGTTT GGGGBGBGGT CTGBGTCCBC CGGGBGGBCG
TTBTCCBTTT CGBBGCTBGG CGGTBBBGCC CTBCTBTCTG TBCBCBBCCC CCCTCTGCBG CBGBGTCCTG
TCGTGGCGCC TGGGGCTCBG GGTCCGGGC TAAGATGATC CACATCACTA CCACGTTGCC CACCACAGAG
GTCACCACAA TGACCGTGTA GGCAGCTGCC CAAAGGACAA TTTGCCAGGC TGGTTGCACG AACTGATTGG
GTTCCGAGGT GTTAGTGGAG ATGTTTGGGG AGAGGTCTGA GTCCACCGGG AGGACGTTAT CCATTTCGAA
GCTAGGCGGT AAAGCCCTAC TATCTGTACA CAACCCCCCT CTGCAGCAGA GTCCTGTCGT GGCGCCTGGG
GCTCAGGGTC CGTCCTGTCG TGGCGCCTGG GGCTCTTCTT TTGTGGGCTC TTTGGTGGCT GTGGCTGTGG
TCTCTGTGGT TGCTGCCCTG GGTCTGGGGG TGTGGCCTTG GGGCCGTCCT CTGGCTCCTC CTCGTGGGCC CCC
GGTGBCBTTG BGCBTGTCGG CGCGGTCCCG TTBBGBGTGG GCCCGCCAGC CCAGCCACTC CACTTGGGGG
CGGGTGGCCA GCACGAACAG CACCCAGAGG AAGGGGGGCG GCCCAGAAGG GCAGCCCGCA GGCCAGGATC
AGGTCTGCTG CGGCCGGAGA TAATGGCATT CACCACGCGG CGGCCCAGCG CACGCCGCGC ATCCGGCCCG
GGTTCTGACC TGCAGCCCCC GTCTCCTTGG CATTCCTGGG CCCCAGTCAC TCCTCTCCCT GCCCCCCTTG
CTGGGGCAGG GACGGGTG BCBTTGBGCB TGTCGGCGCG GTCCCGTTBB GBGTGGGCCC GCCAGCCCAG
CCACTCCACT TGGGGGCGGG TGGCCAGCAC GAACAGCACC CAGAGGAAGG GGGGCGGCCC AGAAGGCCAG
CCCGCAGGCC AGGATCAGGT CTGCTGCGGC CGGAGATAAT GGCATTCACC ACGCGGCGG CCAGCGCACG
CCGCGCATCC GGCCCGGGTT CTGACCTGCA GCCCCCGTCT CCTTGGCATT CCTGGGCCCC AGTCACTCCT
CTCCCTGCCC CCCTTGCTGG GGCAGGGACG GCCGTGTTGT CBGTGGTGCT GCCCGTTTGB GGTBTGGCGC
TCCBCCBBTT CCCTTTTCTC CTTGTTTTCG GTTTCTCTTG CCGTCTGTGG TT ATGCCGCCCT CCATCTCAGC
TTTCCAGGCC GCCTACATCG GCATCGAGGT GCTCATCGCC CTGGTCTCTG TGCCCGGGAA CGTGCTGGTG
ATCTGGGCGG TGAAGGTGAA CCAGGCGCTG CGGGATGCCA CCTTCTGCTT CATCGTCTCG CTGGCGGTGG
CTGATGTGGC CGTGGGTGCC CTGGTCATCC CCCTCGCCAT CCTCATCAAC ATTGGGCCAC AGACCTACTT
CCACACCTGC CTCATGGTTG CCTGTCCGGT CCTCATCCTC ACCCAGAGCT CCATCCTGGC CCTGCTGGCA
ATTGCTGTGG ACCGCTACCT CCGGGTCAAG ATCCCTCTCC GGTACAAGAT GGTGGTGACC CCCCGGAGGG
CGGCGGTGGC CATAGCCGGC TGCTGGATCC TCTCCTTCGT GGTGGGACTG CCCCTATGT TTGGCTGGAA
CAATCTGAGT GCGGTGGAGC GGGCCTGGGC AGCCAACGGC AGCATGGGGG AGCCCGTGAT CAAGTGCGAG
TTCGAGAAGG TCATCAGCAT GGAGTACATG GTCTACTTCA ACTTCTTTGT GTGGGTGCTG CCCCCGCTTC
TCCTCATGGT CCTCATCTAC CTGGAGGTCT TCTACCTAAT CCGCAAGCAG CTCAACAAGA AGGTGTCGGC
CTCCTCCGGC GACCCGCAGA AGTACTATGG GAAGGAGCTG AAGATCGCCA AGTCGCTGGC CCTCATCCTC
TTCCTCTTTG CCCTCAGCTG GCTGCCTTTG CACATCCTCA ACTGCATCAC CCTCTTCTGC CCGTCCTGCC
ACAAGCCCAG CATCCTTACC TACATTGCCA TCTTCCTCAC GCACGGCAAC TCGGCCATGA ACCCCATTGT
CTATGCCTTC CGCATCCAGA AGTTCCGCGT CACCTTCCTT AAGATTTGGA ATGACCATTT CCGCTGCCAG
CCTGCACCTC CCATTGACGA GGATCTCCCA GAAGAGAGGC CTGATGACTA G ATGAGTGTCA GAAGTGTGAA
GGGTGCCTGT TCTGAATCCC AGAGCCTCCT CTCCCTCTGT GAGGCTGGCA GGTGAGGAAG GGTTTAACCT
CACTGGAAGG AATCCCTGGA GCTAGCGGCT GCTGAAGGCG TCGAGGTGTG GGGGCACTTG GACAGAACAG
```

-continued

```
TCAGGCAGCC GGGAGCTCTG CCAGCTTTGG TGACCTTGGG CCGGGCTGGG AGCGCTGCGG CGGGAGCCGG

AGGACTATGA GCTGCCGCGC GTTGTCCAGA GCCCAGCCCA GCCCTACGCG CGCGGCCCGG AGCTCTGTTC

CCTGGAACTT TGGGCACTGC CTCTGGGACC CCTGCCGGCC AGCAGGCAGG ATGGTGCTTG CCTCGTGCCC

CTTGGTGCCC GTCTGCTGAT GTGCCCAGCC TGTGCCCGCC ATGCCGCCCT CCATCTCAGC TTTCCAGGCC

GCCTACATCG GCATCGAGGT GCTCATCGCC CTGGTCTCTG TGCCCGGGAA CGTGCTGGTG ATCTGGGCGG

TGAAGGTGAA CCAGGCGCTG CGGGATGCCA CCTTCTGCTT CATCGTGTCG CTGGCGGTGG CTGATGTGGC

CGTGGGTGCC CTGGTCATCC CCCTCGCCAT CCTCATCAAC ATTGGGCCAC AGACCTACTT CCACACCTGC

CTCATGGTTG CCTGTCCGGT CCTCATCCTC ACCCAGAGCT CCATCCTGGC CCTGCTGGCA ATTGCTGTGG

ACCGCTACCT CCGGGTCAAG ATCCCTCTCC GGTACAAGAT GGTGGTGACC CCCCGGAGGG CGGCGGTGGC

CATAGCCGGC TGCTGGATCC TCTCCTTCGT GGTGGGACTG ACCCCTATGT TTGGCTGGAA CAATCTGAGT

GCGGTGGAGC GGGCCTGGGC AGCCAACGGC AGCATGGGGG AGCCCGTGAT CAAGTGCGAG TTCGAGAAGG

TCATCAGCAT GGAGTACATG GTCTACTTCA ACTTCTTTGT GTGGGTGCTG CCCCCGCTTC TCCTCATGGT

CCTCATCTAC CTGGAGGTCT TCTACCTAAT CCGCAAGCAG CTCAACAAGA AGGTGTCGGC CTCCTCCGGC

GACCCGCAGA AGTACTATGG GAAGGAGCTG AAGATCGCCA GTCGCTGGC CCTCATCCTC TTCCTCTTTG

CCCTCAGCTG GCTGCCTTTG CACATCCTCA ACTGCATCAC CCTCTTCTGC CCGTCCTGCC ACAAGCCCAG

CATCCTTACC TACATTGCCA TCTTCCTCAC GCACGGCAAC TCGGCCATGA ACCCCATTGT CTATGCCTTC

CGCATCCAGA AGTTCCGCGT CACCTTCCTT AAGATTTGGA ATGACCATTT CCGCTGCCAG CCTGCACCTC

CCATTGACGA GGATCTCCCA GAAGAGAGGC CTGATGACTA GACCCCGCCT TCCGCTCCCA CCAGCCCACA

TCCAGTGGGG TCTCAGTCCA GTCCTCACAT GCCCGCTGTC CCAGGGGTCT CCCTGAGCCT GCCCCAGCTG

GGCTGTTGGC TGGGGCATG GGGGAGGCTC TGAAGAGATA CCCACAGAGT GTGGTCCCTC CACTAGGAGT

TAACTACCCT ACACCTCTGG GCCCTGCAGG AGGCCTGGGA GGGCAAGGGT CCTACGGAGG GACCAGGTGT

CTAGAGGCAA CAGTGTTCTG AGCCCCCACC TGCCTGACCA TCCCATGAGC AGTCCAGCGC TTCAGGGCTG

GGCAGGTCCT GGGGAGGCTG AGACTGCAGA GGAGCCACCT GGGCTGGGAG AAGGTGCTTG GCTTCTGCG

GTGAGGCAGG GGAGTCTGCT TGTCTTAGAT GTTGGTGGTG CAGCCCCAGG ACCAAGCTTA AGGAGAGGAG

AGCATCTGCT CTGAGACGGA TGGAAGGAGA GAGGTTGAGG ATGCACTGGC CTGTTCTGTA GGAGAGACTG

GCCAGAGGCA GCTAAGGGGC AGGAATCAAG GAGCCTCCGT TCCCACCTCT GAGGACTCTG ACCCCAGGC

CATACCAGGT GCTAGGGTGC CTGCTCTCCT TGCCCTGGGC CAGCCCAGGA TTGTACGTGG GAGAGGCAGA

AAGGGTAGGT TCAGTAATCA TTTCTGATGA TTTGCTGGAG TGCTGGCTCC ACGCCCTGGG GAGTGAGCTT

GGTGCGGTAG GTGCTGGCCT CAAACAGCCA CGAGGTGGTA GCTCTGAGCC CTCCTTCTTG CCCTGAGCTT

TCCGGGGAGG AGCCTGGAGT GTAATTACCT GTCATCTGGG CCACCAGCTC CACTGGCCCC CGTTGCCGGG

CCTGGACTGT CCTAGGTGAC CCCATCTCTG CTGCTTCTGG GCCTGATGGA GAGGAGAACA CTAGACATGC

CAACTCGGGA GCATTCTGCC TGCCTGGGAA CGGGTGGAC GAGGGAGTGT CTGTAAGGAC TCAGTGTTGA

CTGTAGGCGC CCCTGGGGTG GGTTTAGCAG GCTGCAGCAG GCAGAGGAGG AGTACCCCCC TGAGAGCATG

TGGGGGAAGG CCTTGCTGTC ATGTGAATCC CTCAATACCC CTAGTATCTG GCTGGGTTTT CAGGGGCTTT

GGAAGCTCTG TTGCAGGTGT CCGGGGGTCT AGGACTTTAG GGATCTGGGA TCTGGGGAAG GACCAACCCA

TGCCCTGCCA AGCCTGGAGC CCCTGTGTTG GGGGCAAGG TGGGGAGCC TGGAGCCCCT GTGTGGGAGG

GCGAGGCGGG GGAGCCTGGA GCCCCTGTGT GGGAGGGCGA GGCGGGGAT CCTGGAGCCC CTGTGTCGGG

GGGCGAGGGA GGGGAGGTGG CCGTCGGTTG ACCTTCTGAA CATGAGTGTC AACTCCAGGA CTTGCTTCCA

AGCCCTTCCC TCTGTTGGAA ATTGGGTGTG CCCTGGCTCC CAAGGGAGGC CCATGTGACT AATAAAAAAC
```

```
TGTGAACCCT CGCATTTGTG TTTTAATAAA AGAATCTGGA AGATAAATAG TCTTGAAGAG AGACAAAGGA
AGGAAAATTT AAATCCTTAG ATTCAAGCAG AAGAATTCCA TGTGGAAGGT TTGGGTTGTT GTTGTTGTTG
TTTGGTGTGT TTTTTGTTTT TTTGTTTTTT TGTTTTTTTT TGAGATGGAG TCTCGCTGTG TTACCGGGAG
CGACAGAGCC GCACGGCCGA GTCGAGTCCC AGCCAGCTAC CATCCCTCTG GAGCTTACCG GCCGGCCTTG
GCTTCCCCAG GAATCCCTGG AGCTAGCGGC TGCTGAAGGC GTCGAGGTGT GGGGCACTT GGACAGAACA
GTCAGGCAGC CGGGAGCTCT GCCAGCTTTG GTGACCTTGG GTGCTTGCCT CGTGCCCCTT GGTGCCCGTC
TGCTGATGTG CCCAGCCTGT GCCCGCCATG CCGCCCTCCA TCTCAGCTTT CCAGGCCGCC TACATCGGCA
TCGAGGTGCT CATCGCCCTG GTCTCTGTGC CCGGGAACGT GCTGGTGATC TGGGCGGTGA AGGTGAACCA
GGCGCTGCGG GATGCCACCT TCTGCTTCAT CGTGTCGCTG GCGGTGGCTG ATGTGGCCGT GGGTGCCCTG
GTCATCCCCC TCGCCATCCT CATCAACATT GGGCCACAGA CCTACTTCCA CACCTGCCTC ATGGTTGCCT
GTCCGGTCCT CATCCTCACC CAGAGCTCCA TCCTGGCCCT GCTGGCAATT GCTGTGGACC GCTACCTCCG
GGTCAAGATC CCTCTCCGGT ACAAGATGGT GGTGACCCCC CGGAGGGCGG CGGTGGCCAT AGCCGGCTGC
TGGATCCTCT CCTTCGTGGT GGGACTGACC CCTATGTTTG GCTGGAACAA TCTGAGTGCG GTGGAGCGGG
CCTGGGCAGC CAACGGCAGC ATGGGGGAGC CCGTGATCAA GTGCGAGTTC GAGAAGGTCA TCAGCATGGA
GTACATGGTC TACTTCAACT TCTTTGTGTG GGTGCTGCCC CCGCTTCTCC TCATGGTCCT CATCTACCTG
GAGGTCTTCT ACCTAATCCG CAAGCAGCTC AACAAGAAGG TGTCGGCCTC CTCCGGCGAC CCGCAGAAGT
ACTATGGGAA GGAGCTGAAG ATCGCCAAGT CGCTGGCCCT CATCCTCTTC CTCTTTGCCC TCAGCTGGCT
GCCTTTGCAC ATCCTCAACT GCATCACCCT CTTCTGCCCG TCCTGCCACA AGCCCAGCAT CCTTACCTAC
ATTGCCATCT TCCTCACGCA CGGCAACTCG GCCATGAACC CCATTGTCTA TGCCTTCCGC ATCCAGAAGT
TCCGCGTCAC CTTCCTTAAG ATTTGGAATG ACCATTTCCG CTGCCAGCCT GCACCTCCCA TTGACGAGGA
TCTCCCAGAA GAGAGGCCTG ATGACTAGAC CCCGCCTTCC GCTCCCACCG CCCACATCCA GTGGGGTCTC
AGTCCAGTCC TCACATGCCC GCTGTCCCAG GGGTCTCCCT GAGCCTGCCC CAGCTGGGCT GTTGGCTGGG
GGCATGGGGG AGGCTCTGAA GAGATACCCA CAGAGTGTGG TCCCTCCACT AGGAGTTAAC TACCCTACAC
CTCTGGGCCC TGCAGGAGGC CTGGGAGGGC AAGGGTCCTA CGGAGGGACC AGGTGTCTAG AGGCAACAGT
GTTCTGAGCC CCCACCTGCC TGACCATCCC ATGAGCAGTC CAGAGCTTCA GGGCTGGGCA GGTCCTGGGG
AGGCTGAGAC TGCAGAGGAG CCACCTGGGC TGGGAGAAGG TGCTTGGGCT CTGCGGTGA GGCAGGGGAG
TCTGCTTGTC TTAGATGTTG GTGGTGCAGC CCCAGGACCA AGCTTAAGGA GAGGAGAGCA TCTGCTCTGA
GACGGATGGA AGGAGAGAGG TTGAGGATGC ACTGGCCTGT TCTGTAGGAG AGACTGGCCA GA CCCAGCCCCG
AGGCTCAGAA GCGGCAGGCG GAGGCGCGGT CCGGGCGCTA TGGCCATGCC CGGCGGGTCT CACGCGGCTG
CCCCTCGCCC GGCGCGCCTT CGGTAGGGGG CGCCCGGGGC CCAGCTGGCC CGGCCATGCT GCTGGAGACA
CAGGACGCGC TGTACGTGGC GCTGGAGCTG GTCATCGCCG CGCTTTCGGT GGCGGGCAAC GTGCTGGTGT
GCGCCGCGGT GGGCACGGCG AACACTCTGC AGACGCCCAC CAACTACTTC CTGGTGTCCC TGGCTGCGGC
CGACGTGGCC GTGGGGCTCT TCGCCATCCC CTTTGCCATC ACCATCAGCC TGGGCTTCTG CACTGACTTC
TACGGCTGCC TCTTCCTCGC CTGCTTCGTG CTGGTGCTCA CGCAGAGCTC CATCTTCAGC CTTCTGGCCG
TGGCAGTCGA CAGATACCTG GCCATCTGTG TCCCGCTCAG GTATAAAAGT TTGGTCACGG GACCCGAGC
AAGAGGGGTC ATTGCTGTCC TCTGGGTCCT TGCCTTTGGC ATCGGATTGA CTCCATTCCT GGGGTGGAAC
AGTAAAGACA GTGCCACCAA CAACTGCACA GAACCCTGGG ATGGAACCAC GAATGAAAGC TGCTGCCTTG
TGAAGTGTCT CTTTGAGAAT GTGGTCCCCA TGAGCTACAT GGTATATTTC AATTTCTTTG GTGTGTTCT
GCCCCCACTG CTTATAATGC TGGTGATCTA CATTAAGATC TTCCTGGTGG CCTGCAGGCA GCTTCAGCGC
ACTGAGCTGA TGGACCACTC GAGGACCACC CTCCAGCGGG AGATCCATGC AGCCAAGTCA CTGGCCATGA
```

```
TTGTGGGGAT TTTTGCCCTG TGCTGGTTAC CTGTGCATGC TGTTAACTGT GTCACTCTTT TCCAGCCAGC

TCAGGGTAAA AATAAGCCCA AGTGGGCAAT GAATATGGCC ATTCTTCTGT CACATGCCAA TTCAGTTGTC

AATCCCATTG TCTATGCTTA CCGGAACCGA GACTTCCGCT ACACTTTTCA CAAAATTATC TCCAGGTATC

TTCTCTGCCA AGCAGATGTC AAGAGTGGGA ATGGTCAGGC TGGGGTACAG CCTGCTCTCG GTGTGGGCCT

ATGATCTAGG CTCTCGCCTC TTCCAGGAGA AGATACAAAT CCACAAGAAA CAAAGAGGAC ACGGCTGGTT

TTCATTGTGA AAGATAGCTA CACCTCACAA GGAAATGGAC TGCCTCTCTT GAGCACTTCC CTGGAGCTAC

CACGTATCTA GCTAATATGT ATGTGTCAGT AGTAGCACCA AGGATTGACA AATATATTTA TGATCTATTC

AGCTGCTTTT ACTGTGTGGA TTATGCCAAC AGCTTGAATG GATTCTAACA GACTCTTTTG TTTTTAAAAG

TCTGCCTTGT TTATGGTGGA AAATTACTGA AACTATTTTA CTGTGAAACA GTGTGAACTA TTATAATGCA

AATACTTTTT AACTTAGAGG CAATGGAAAA ATAAAAGTTG ACTGTACTAA AAATGTATAC TTGTTGCCAG

GAAGGTGACC TCAAAAATTA AAAGTATAAT TATTCGGCCG GGCATGGTGG CTCACACCTG TAATTCCAGC

ACTTTGGGAG GCCAAGGCAG GCGGATCACG AGGTCAGGAG TTCAAAACCA GCCTGTCCAA TATAGTG

GGGCAATTTG TTAGTTATCC GCCGCCACCA AGACGCGGCA CGGCGCCTGG ACCGGAGGGG CCCCGCGCGG

GCGCGAACTT TGGGCTCGGG CGAGTGGGTG GTGCTCCGCC CAGCCCGAGA CGGGCGGGCG CGCGGGCCAA

TGGGTGCCGC CTCTTGGCCG CGGGGGGCCC CGACCCGTGG GTCCCGGCCA CCAGCGCCCC AGCCCCGAGG

CTCAGAAGCG GCAGGCGGAG GCGCGGTCCG GGCGCTATGG CCATGCCCGG CGGGTCTCAC GCGGCTGCCC

CTCGCCCGGC GCGCCTTCGG TAGGGGCGC CCGGGGCCCA GCTGGCCCGG CCATGCTGCT GGAGACACAG

GACGCGCTGT ACGTGGCGCT GGAGCTGGTC ATCGCCGCGC TTTCGGTGGC GGGCAACGTG CTGGTGTGCG

CCGCGGTGGG CACGGCGAAC ACTCTGCAGA CGCCCACCAA CTACTTCCTG GTGTCCCTGG CTGCGGCCGA

CGTGGCCGTG GGGCTCTTCG CCATCCCCTT TGCCATCACC ATCAGCCTGG GCTTCTGCAC TGACTTCTAC

GGCTGCCTCT TCCTCGCCTG CTTCGTGCTG GTGCTCACGC AGAGCTCCAT CTTCAGCCTT CTGGCCGTGG

CAGTCGACAG ATACCTGGCC ATCTGTGTCC CGCTCAGGTA TAAAAGTTTG GTCACGGGGA CCCGAGCAAG

AGGGGTCATT GCTGTCCTCT GGGTCCTTGC CTTTGGCATC GGATTGACTC CATTCCTGGG GTGGAACAGT

AAAGACAGTG CCACCAACAA CTGCACAGAA CCCTGGGATG AACCACGAA TGAAAGCTGC TGCCTTGTGA

AGTGTCTCTT TGAGAATGTG GTCCCCATGA GCTACATGGT ATATTTCAAT TTCTTTGGGT GTGTTCTGCC

CCCACTGCTT ATAATGCTGG TGATCTACAT TAAGATCTTC CTGGTGGCCT GCAGGCAGCT TCAGCGCACT

GAGCTGATGG ACCACTCGAG GACCACCCTC CAGCGGGAGA TCCATGCAGC CAAGTCACTG GCCATGATTG

TGGGGATTTT TGCCCTGTGC TGGTTACCTG TGCATGCTGT TAACTGTGTC ACTCTTTTCC AGCCAGCTCA

GGGTAAAAAT AAGCCCAAGT GGGCAATGAA TATGGCCATT CTTCTGTCAC ATGCCAATTC AGTTGTCAAT

CCCATTGTCT ATGCTTACCG GAACCGAGAC TTCCGCTACA CTTTTCACAA AATTATCTCC AGGTATCTTC

TCTGCCAAGC AGATGTCAAG AGTGGGAATG GTCAGGCTGG GGTACAGCCT GCTCTCGGTG TGGGCCTATG

ATCTAGGCTC TCGCCTCTTC CAGGAGAAGA TACAAATCCA CAAGAAACAA AGAGGACACG CTGGTTTTC

ATTGTGAAAG ATAGCTACAC CTCACAAGGA AATGGACTGC CTCTCTTGAG CACTTCCCTG GAGCTACCAC

GTATCTAGCT AATATGTATG TGTCAGTAGT AGGCTCCAAG GATTGACAAA TATATTTATG ATCTATTCAG

CTGCTTTTAC TGTGTGGATT ATGCCAACAG CTTGAATGGA TTCTAACAGA CTCTTTTGTT TTTAAAAGTC

TGCCTTGTTT ATGGTGGAAA ATTACTGAAA CTATTTTACT GTGAAACAGT GTGAACTATT ATAATGCAAA

TACTTTTTAA CTTAGAGGCA ATGGAAAAAT AAAAGTTGAC TGTACTAAAA ATG GAATTCCCAG ATGGGCAGAG

GTGGCTGGGC TGGTGACCCT AAGTGTGTCT CCTGCCTTTA TTCTCTCTAG TGGGTTATTC TTTCATGTGG

TATCTTGCCT ACAGCATGCT GTGTTTGGAC ACAAACCCCT TTCCTTGGTT TCTCTGACCC AGCTGAGATG
```

-continued

```
GACTGATTCC AAAAGAACTC ACCTATGTAC TGGGGTAGGG GAGGGAGGGT TTTTTGCAGT ATTTAACTAA
GGTTCAAAGA GTGCTATATA GTGAGAAAGG CTTCTTTTTT TTTTTTTTTT TTTTTTGGCA GAGTGCTGCC
TCCTAGAAAT TTCTCTTGGT AACTTCCTTC TCTGAAGCAC AGATAAAGAA AACAATTACA GTAGAAACAT
TTATGAGGGA CACATTGGAG GCCGATGAAG CTTTTCAAGT TCCAGCAGTG CAGGGATGTG GGCAGAACTG
ACATTGGAAA ATACTAGAAT GATGGAAATT CAGTTGGAGA GGACTGCCCT TTTTAATGTC TGGGGAGTCT
GCTCAGGGAG AAATGACAAG TCTGGCGGGG ACAAGTATGG GATTTGGTAA GACTTGGATC AACTTGGGAT
ACAGGGTGGG GGTCGGGAGT GGAATCAATG AATGATGCCA GAGCAGATCA ACTAACAAGA GGACCCTGAT
GAGCCCCAGG CAGAGGCGTC TCCCTTATGC CCCACTCTGA AGTGTTTGTT AGTAAACACC AGAACGCCAT
TGTTGTTACT GCTGAATTTT ATTTTGGGCT GTACATATTT AGATGCTTAA GGTAAAAATG ATAAAGCCCT
CAAGCCACTG TGTGGGTTTG GGTCCAAGTG TTCCTTCTTG CTGCCTCTCT AACACGCCTG GTTAAAATAA
TCCCTTTGGA TGGTGCTGAG AAGCACCTGA ACCAAGTGGG TCCCCAAATA ACAATGGCGT GCAAGTGTCT
GGTTCCCAGA AGTTGGTGAC TAGGTAAGCA GCTTCAGGGA GAGGGGCTG ATTCCCGAC AGTCGCCTGT
TCCTGCGGGG ATGGGGCTGA GGCTTGGGGA ATGTGGGCAG GAGGATATGC CATTTGATTC TGTTGCACAC
GTTCTTTTCC CTTCTTTCTG TATGTCTGGT CATTCTGCTA TTCTGTCGTT CCTCACATAG GTTGGACATT
GGCCGGCTGC CAGCATAAGT GCCAGTGTGA TTTTGCTAGG TGTGAGCTGA GAAAGAGAGG TGGAGGCTAA
GCAGGTGTGA TGCTTCTCAG AGGTGCTGAG TTTTTGCCCT TCTGAGCAGG AATCTTTGC TTATCCCTTT
GACCAAGGAT CTTTGCTGCA AAGGCTGGGT ATCGGCTGTG CTCAGCAAAG CGTCAACTCG TGCAAGAACT
TAGCAGGAAT AGTTCTGGCT AAGGTTAGGA GGCTGCCACC AAAGTCTCTT TTTTGTTCCT CTGCTTCTCC
CGTTTGCCTC CTTATCATGA GATCTTTTTG CTAAGCTGGC AGAAAGATTG CATAGTCAGT GCTTCCAGCT
CTGCTCCCAC CTGATCCTGC ACTGTCCTCT GGTCCCTGAA TGAATGAACT CTGATACCCA ATCTTGTCTC
GAGCCTTCTC TATGCCACTC ATGGCTCCTC TTCTGCTCTT TCCATCTTTT TGCTGAGAGT TCTGAGCTCT
GTACTTCCTC TTGGCCCATC TCACTTCCTG AAACACCCCT GAAGAGGGTT GCTTATCTTG ATGGAACTCA
AAAAGCCAAA AAGCTGCAGG CAGAGGCGTT GAGGACATCT GTTTGGGGAA CTAAGAGCAG CAGCACTTTC
AGATTCAGTC CATATAGAGC TGTCCTACAG CATTCTGGAA ACTTGAGGAT GTGCGGTGCA TAAAGGGGCT
GGAAGTGACC CACCTGTGAT GAGCCCTTTC TAAGGAGAAG GGTTTCCAAG AGATCACCCC ACCAGAAAAG
GGTAGGAATG AGCAAGTTGG GAATTTTAGA CTGTCACTGC ACATGGACCT CTGGGAAGAC GTCTGGCGAG
AGCTAGGCCC ACTGGCCCTA CAGACGGATC TTGCTGGCTC ACCTGTCCCT GTGGAGGTTC CCCTGGGAAG
GCAAGATGCC CAACAACAGC ACTGCTCTGT CATTGGCCAA TGTTACCTAC ATCACCATGG AAATTTTCAT
TGGACTCTGC GCCATAGTGG GCAACGTGCT GGTCATCTGC GTGGTCAAGC TGAACCCCAG CCTGCAGACC
ACCACCTTCT ATTTCATTGT CTCTCTAGCC CTGGCTGACA TTGCTGTTGG GGTGCTGGTC ATGCCTTTGG
CCATTGTTGT CAGCCTGGGC ATCACAATCC ACTTCTACAG CTGCCTTTTT ATGACTTGCC TACTGCTTAT
CTTTACCCAC GCCTCCATCA TGTCCTTGCT GGCCATCGCT GTGGACCGAT ACTTGCGGGT CAAGCTTACC
GTCAGGTAGC CTGCGGCGTG GGGTGGGCAG CAATTGAGGC AGCTGGGAAA TGAGGCTACA AAGCCAGAGC
CTGCTGAATT TTATTTTGGA CTGTACATAT TTAGATGCTT AAGGTAAAAA TGATAAAGCC CTCAAGCCAC
TGTGTGGGTT GGGTCCAAGT GTTCCTTGCT GCTGCCTCTC TAACACGCCT GGTTAAAATA ATCCCTTTGG
ATGGTGCTGA GAAGCACCTG AACCAAGTGG GTCCCCAAAT AACTATGGCG TGCAAGTGTC TGGTTCCCAG
AAGTTGGTGA CTAGGTAAGC GACTCAGGGA GAGGGGCTGA TTCCCAGACA GTCGCCTGTT CCTGCTGGGA
TGGGGCTGAG GCTTGGGGAA TGTGGGCAGG AGGATATGCC ATTTGATTCT GTTGCACACG TTCTTTTCCC
TTCTTTCTGT ATGTCTGGTC ATTCTGCTAT TCTGTCGTTC CTCACATAGG TTGGACATTG GCCGGCTGCC
AGCATAAGTG CCAGTGTGAT TTTGCTAGGG TGTGAGCTGA GAAAGAGAGG TGGAGGCTAA GCAGGTGTGA
```

-continued

```
TGCTTCTCAG AGGTGCTGAG TTTTTGCCCT TCTGAGCAGG GAATCTTTGC TTATCCCTTT GACCAAGGAT
CTTTGCTCCA AAGGCTGGGT ATCGGCTGTG CTCAGCAAAG CGTCAACTCG TGCAAGAACT TAGCAGGAAT
AGTTCTGGCT AAGGTTAGGA GGCTGCCACC AAAGTCTCTT TTTTGTTCCT CTGCTTCTCC CGTTTGCCTC
CTTATCATGA GATCTTTTTG CTAAGCTGGC AGAAAGATTG CATAATCAGT GCTTCCAGCT CCGCTCCCAC
CTGATCCTGC ACTGTCCTCT GGTCCCTGAA TGAATGAACT CTGATACCCA ATCTTGTCTC GAGCCTTCTC
TATGCCACTC ATGGCTCCTC TTCTGCTCTT TCCATCTTTT TGCTGAGAGT TACTGAGCTC TGTACTTCCT
CTTGGCCCAT CTCACTTCCT GAAACACCCC TGAAGAGGGT TGCTTATCTT GATGGAACTC AAAAAGCCAA
AAAGCTGCAG GCAGAGGCGT TGAGGACATC TGTTTGGGGA ACTAAGAGCA GCAGCACTTT CAGATTCAGT
CCATATAGAG CTGTCCTACA GCATTCTGGA AACTTGAGGA TGTGCGGTGC ATAAAGGGGC TGGAAGTGAC
CCACCTGTGA TGAGCCCTTT CTAAGGAGAA GGGTTTCCAA GAGATCACCC CACCAGAAAA GGGTAGGAAT
GAGCAAGTTG GGAATTTTAG ACTGTCACTG CACATGGACC TCTGGGAAGA CGTCTGGCGA GAGCTAGGCC
CACTGGCCCT ACAGACGGAT CTTGCTGGCT CACCTGTCCC TGTGGAGGTT CCCCTGGGAA GGCAAGATGC
CCAACAACAG CACTGCTCTG CGAATTCGGG GGACATCTGT TTGGGGAACT AAGAGCAGCA GCACTTTCAG
ATTCAGTCCA TATAGAGCTG TCCTACAGCA TTCTGGAAAC TTGAGGATGT GCGGTGCATA AACGGGCTGG
AAGTGACCCA CCTGTGATGA GCCCTTTCTA AGGAGAAGGG TTTCCAAGAG ATCACCCCAC CAGAAAAGGG
TAGGAATGAG CAAGTTGGGA ATTTTAGACT GTCACTGCAC ATGGACCTCT GGGAAGACGT CTGGCGAGAG
CTAGGCCCAC TGGCCCTACA GACGGATCTT GCTGGCTCAC CTGTCCCTGT GGAGGTTCCC CTGGGAAGGC
AAGATGCCCA ACAACAGCAC TGCTCTGTCA TTGGCCAATG TTACCTACAT CACCATGGAA ATTTTCATTG
GACTCTGCGC CATAGTGGGC AACGTGCTGG TCATCTGCGT GGTCAAGCTG AACCCCAGCC TGCAGACCAC
CACCTTCTAT TTCATTGTCT CTCTAGCCCT GGCTGACATT GCTGTTGGGG TGCTGGTCAT GCCTTTGGCC
ATTGTTGTCA GCCTGGGCAT CACAATCCAC TTCTACAGCT GCCTTTTTAT GACTTGCCTA CTGCTTATCT
TTACCCACGC CTCCATCATG TCCTTGCTGG CCATCGCTGT GGACCGATAC TTGCGGGTCA AGCTTACCGT
CAGATACAAG AGGGTCACCA CTCACAGAAG AATATGGCTG GCCCTGGGCC TTTGCTGGCT GGTGTCATTC
CTGGTGGGAT TGACCCCCAT GTTTGGCTGG AACATGAAAC TGACCTCAGA GTACCACAGA AATGTCACCT
TCCTTTCATG CCAATTTGTT TCCGTCATGA GGATGGACTA CATGGTATAC TTCAGCTTCC TCACCTGGAT
TTTCATCCCC CTGGTTGTCA TGTGCGCCAT CTATCTTGAC ATCTTTTACA TCATTCGGAA CAAACTCAGT
CTGAACTTAT CTAACTCCAA AGAGACAGGT GCATTTATG GACGGGAGTT CAAGACGGCT AAGTCCTTGT
TTCTGGTTCT TTTCTTGTTT GCTCTGTCAT GGCTGCCTTT ATCTCTCATC AACTGCATCA TCTACTTTAA
TGGTGAGGTA CCACAGCTTG TGCTGTACAT GGGCATCCTG CTGTCCCATG CCAACTCCAT GATGAACCCT
ATCGTCTATG CCTATAAAAT AAAGAAGTTC AAGGAAACCT ACCTTTTGAT CCTCAAAGCC TGTGTGGTCT
GCCATCCCTC TGATTCTTTG GACACAAGCA TTGAGAAGAA TTCTGAGTAG TTATCCATCA GAGATGACTC
TGTCTCATTG ACCTTCAGAT TCCCCATCAA CAAACACTTG AGGGCCTGTA TGCCTGGGCC AAGGGATTTT
TACATCCTTG ATTACTTCCA CTGAGGTGGG AGCATCTCCA GTGCTCCCCA ATTATATCTC CCCCACTCCA
CTACTCTCTT CCTCCACTTC ATTTTTCCTT TGTCCTTTCT CTCTAATTCA GTGTTTTGGA GGCCTGACTT
GGGGACAACG TATTATTGAT ATTATTGTCT GTTTTCCTTC TTCCCAATAG AAGAATAAGT CATGGAGCCT
GAAGGGTGCC TAGTTGACTT ACTGACAAAA GGCTCTAGTT GGGCTGAACA TGTGTGTGGT GGTGACTCAT
TTCCATGCCA TTGTGGAATT GAGCAGAGAA CCTGCTCTCG GAGGATGCCT AGGAGATGTT GGAACAGAA
GAAATAAACT GAGTTTAAGG GGGACTTAAA CTGCTGAATT C CAGATTCACA AACTGCAGGA CTGGGCAGGG
AGCAGACAGT GAGCAAACGC CAGCAGGGCT GCTGTGAATT TGTGTAAGGA TTGAGGGACA GTTGCTTTTC
```

```
AGCATGGGCC CAGGAATGCC AAGGAGACAT CTATGCACGA CCTTGGGAAA TGAGTTGATG TCTCCGGTAA

AACACCGGAG ACTAATTCCT GCCCTGCCCA ATTTTGCAGG GAGCATGGCT GTGAGGATGG GGTGAACTCA

CGCACAGCCA AGGACTCCAA AATCACAACA GCATTACTGT TCTTATTTGC TGCCACACCT GAGCCAGCCT

GCTCCTTCCC AGGAGTGGAG GAGGCCTGGG GGGAGGGAGA GGAGTGACTG AGCTTCCCTC CCGTGTGTTC

TCCGTCCCTG CCCCAGCAAG ACAACTTAGA TCTCCAGGAG AACTGCCATC CAGCTTTGGT GCAATGGCTG

AGTGCACAAG TGAGTTGTTG CCCTGGGTTT CTTTAATCTA TTCAGCTAGA ACTTTGAAGG ACAATTTCTT

GCATTAATAA AGGTTAAGCC CTGAGGGGTC CCTGATAACA ACCTGGAGAC CAGGATTTTA TGGCTCCCCT

CACTGATGGA CAAGGAGGTC TGTGCCAAAG AAGAATCCAA TAAGCACATA TTGAGCACTT GCTGTATATG

CAGTATTGAG CACTGTAGGC AAGACCCAAG AAAGAGAAGG AGCCATCTCC ATCTTGAAGG AACTCAAAGA

CTCAAGTGGG AACGACTGGG CACTGCCACC ACCAGAAAGC TGTTCGACGA GACGGTCGAG CAGGGTGCTG

TGGGTGATAT GGACAGCAGA AGGGGGAGAC CAAGGTTCCA GCTCAACCAA TAACTATTGC ACAACCACCT

GTCCCTGCCT CAGTTCCCTT TTATGTAACA TGAAGTCGTT GTGAGGGTTA AAGGCAGTAA CAGGTATAAA

GTACTTAGAA AAGCAAAGGG TGCTACGTAC ATGTGAGGCA TCATTACGCA GACGTAACTG GGATATGTTT

ACTATAAGGA AAAGACACTG AGGTCTAGAA ATAGCTCCGT GGAGCAGAAT CAGTATTGGG AGCCGGTGGC

GGTGTGAAGC ACCAGTGTCT GGCACACAGT AGGTGCTCAT TGGCTCCCTT CCACCTGTCA TTCCCACCAC

CCTGAGGCCC CAACCGCCAC ACACACAGGA GCATTTGGAG AGAAGGCCAT GTCTTCAAAG TCTGATTTGT

GATGAGGCAG AGGAAGATAT TTCTAATCGG TCTTGCCCAG AGGATCACAG TGCTGAGACC CCCCACCACC

AGCCGGTACC TGGGAAGGGG GAGAGTGCAG GCCTGCTCAG GGACTGTTCC TGTCTCAGCA ACCAAGGGAT

TGTTCCTGTC AATCAATGGT TTATTGGAAG GTGGCCCAGT ATGAGCCCTA GAAGAGTGTG AAAAGGAATG

GCAATGGTGT TCACCATCGG CAGTGCCAGG GCAGCACTCA TTCACTTGAT AAATGAATAT TTATTAGCTG

GTTGGAGAGC TAGAACCTGG AGAGCTAGAA CCTGGAGAAC TAGAACCTGG AGGGCTAGAA CCTGGAGAGG

CTAGAACCAA GAAGGGCTAG AACCTGGAGG GGCTAGAACC TAGAGAAGCT AAAACCTGAG CTAGAAGCTG

GAGGACTAGA ACCTGGAGGG CTGGAATCTG AAGGGCTAGA ACCTGGAGGG CTGGAATCTG GAGAGCTAGA

ACCTGGAGGG CTAGAACCTG GAGGGCTAGA ACCTAGAAGG GCTAGAACCT GGAGGGCTGG AATCTGGAGA

GCTAGAACCT GGAGGGCTAG AACCTGGAGG GCTAGAACCT AGAAGGGCTA GAACCTGGAG GGCTAGAACC

TGGCAGGTTA GAACCTAGAA GGGCTAGAAC CTGGAGAGCC AGAACCTGGA GGGCTAGAAC CTGGAAGGGC

TAGAACCTGT AGAGCTAGAA CATGGAGAGC TAGAACCCGG CAGGCTAGAA CCTGGCAAGC TAGAACCTGG

AGGGAATGAA CCTGGAGGGC TAGAACCTGG AGAATGAGAA AAATTTACAT GGCAAAGAGC CCATAAATCC

TGACCAATCC AACTCTGAAT TTTAAAGCAA AAGCGTGAAA AAAAAGATTC CCTCCTTACC CCCAACCCAC

TCTTTTTTCC CACCACCCAC TCTCCTCTGC CTCAGTAAGT ATCTGGAGGA AGAAAACAGG TGAAAGAAGA

AGTAAAAACC ATTTAGTATT AGTATTAGAA TGAAGTCAAA CTGTGCCACA CATGGTGAAT GAAAAAAAAA

AAAAAGAGGC TGTGTTTTGT CACACAGGGC AGTCATTCAG CACCAGAGCA CGTGATGGTC TGAGACTCTC

TTAGGAGCAG AGCTCTGCCG CAATGGCCAT GTGGGGATCC ACACCTGGTC TGAGGGGCAA CTGAGTCTGC

GGGAGAAGAG CGGCCCTATG CATGGTGTAG ATGCCCTGAT AAAGAACATC TGTCCTGTGA AAGACTCAAT

GAGCTGTTAT GTTGTAAACA GGAAGCATTT CACATCCAAA CGAGAAAATC ATGTAAACAT GTGTCTTTTC

TGTAGAGCAT AATAAATGGA TGAGGTTTTT GCAAAAAAAA AAAAAAAA ATGCCGCCCT CCATCTCAGC

TTTCCAGGCC GCCTACATCG GCATCGAGGT GCTCATCGCC CTGGTCTCTG TGCCCGGGAA CGTGCTGGTG

ATCTGGGCGG TGAAGGTGAA CCAGGCGCTG CGGGATGCCA CCTTCTGCTT CATCGTCTCG CTGGCGGTGG

CTGATGTGGC CGTGGGTGCC CTGGTCATCC CCCTCGCCAT CCTCATCAAC ATTGGGCCAC AGACCTACTT

CCACACCTGC CTCATGGTTG CCTGTCCGGT CCTCATCCTC ACCCAGAGCT CCATCCTGGC CTGCTGGCA
```

```
ATTGCTGTGG ACCGCTACCT CCGGGTCAAG ATCCCTCTCC GGTACAAGAT GGTGGTGACC CCCCGGAGGG

CGGCGGTGGC CATAGCCGGC TGCTGGATCC TCTCCTTCGT GGTGGGACTG ACCCCTATGT TTGGCTGGAA

CAATCTGAGT GCGGTGGAGC GGGCCTGGGC AGCCAACGGC AGCATGGGGG AGCCCGTGAT CAAGTGCGAG

TTCGAGAAGG TCATCAGCAT GGAGTACATG GTCTACTTCA ACTTCTTTGT GTGGGTGCTG CCCCCGCTTC

TCCTCATGGT CCTCATCTAC CTGGAGGTCT TCTACCTAAT CCGCAAGCAG CTCAACAAGA AGGTGTCGGC

CTCCTCCGGC GACCCGCAGA AGTACTATGG GAAGGAGCTG AAGATCGCCA AGTCGCTGGC CCTCATCCTC

TTCCTCTTTG CCCTCAGCTG GCTGCCTTTG CACATCCTCA ACTGCATCAC CCTCTTCTGC CCGTCCTGCC

ACAAGCCCAG CATCCTTACC TACATTGCCA TCTTCCTCAC GCACGGCAAC TCGGCCATGA ACCCCATTGT

CTATGCCTTC CGCATCCAGA AGTTCCGCGT CACCTTCCTT AAGATTTGGA ATGACCATTT CCGCTGCCAG

CCTGCACCTC CCATTGACGA GGATCTCCCA GAAGAGAGGC TGATGACTA G ATGAGTGTCA GAAGTGTGAA

GGGTGCCTGT TCTGAATCCC AGAGCCTCCT CTCCCTCTGT GAGGCTGGCA GGTGAGGAAG GGTTTAACCT

CACTGGAAGG AATCCCTGGA GCTAGCGGCT GCTGAAGGCG TCGAGGTGTG GGGGCACTTG ACAGAACAG

TCAGGCAGCC GGGAGCTCTG CCAGCTTTGG TGACCTTGGG CCGGGCTGGG AGCGCTGCGG CGGGAGCCGG

AGGACTATGA GCTGCCGCGC GTTGTCCAGA GCCCAGCCCA GCCCTACGCG CGCGGCCCGG AGCTCTGTTC

CCTGGAACTT TGGGCACTGC CTCTGGGACC CCTGCCGGCC AGCAGGCAGG ATGGTGCTTG CCTCGTGCCC

CTTGGTGCCC GTCTGCTGAT GTGCCCAGCC TGTGCCCGCC ATGCCGCCCT CCATCTCAGC TTTCCAGGCC

GCCTACATCG GCATCGAGGT GCTCATCGCC CTGGTCTCTG TGCCCGGGAA CGTGCTGGTG ATCTGGGCGG

TGAAGGTGAA CCAGGCGCTG CGGGATGCCA CCTTCTGCTT CATCGTGTCG CTGGCGGTGG CTGATGTGGC

CGTGGGTGCC CTGGTCATCC CCCTCGCCAT CCTCATCAAC ATTGGGCCAC AGACCTACTT CCACACCTGC

CTCATGGTTG CCTGTCCGGT CCTCATCCTC ACCCAGAGCT CCATCCTGGC CCTGCTGGCA ATTGCTGTGG

ACCGCTACCT CCGGGTCAAG ATCCCTCTCC GGTACAAGAT GGTGGTGACC CCCCGGAGGG CGGCGGTGGC

CATAGCCGGC TGCTGGATCC TCTCCTTCGT GGTGGGACTG ACCCCTATGT TTGGCTGGAA CAATCTGAGT

GCGGTGGAGC GGGCCTGGGC AGCCAACGGC AGCATGGGGG AGCCCGTGAT CAAGTGCGAG TTCGAGAAGG

TCATCAGCAT GGAGTACATG GTCTACTTCA ACTTCTTTGT GTGGGTGCTG CCCCCGCTTC TCCTCATGGT

CCTCATCTAC CTGGAGGTCT TCTACCTAAT CCGCAAGCAG CTCAACAAGA AGGTGTCGGC CTCCTCCGGC

GACCCGCAGA AGTACTATGG GAAGGAGCTG AAGATCGCCA AGTCGCTGGC CCTCATCCTC TTCCTCTTTG

CCCTCAGCTG GCTGCCTTTG CACATCCTCA ACTGCATCAC CCTCTTCTGC CCGTCCTGCC ACAAGCCCAG

CATCCTTACC TACATTGCCA TCTTCCTCAC GCACGGCAAC TCGGCCATGA ACCCCATTGT CTATGCCTTC

CGCATCCAGA AGTTCCGCGT CACCTTCCTT AAGATTTGGA ATGACCATTT CCGCTGCCAG CCTGCACCTC

CCATTGACGA GGATCTCCCA GAAGAGAGGC TGATGACTA GACCCCGCCT TCCGCTCCCA CCAGCCCACA

TCCAGTGGGG TCTCAGTCCA GTCCTCACAT GCCCGCTGTC CCAGGGGTCT CCCTGAGCCT GCCCCAGCTG

GGCTGTTGGC TGGGGGCATG GGGGAGGCTC TGAAGAGATA CCCACAGAGT GTGGTCCCTC CACTAGGAGT

TAACTACCCT ACACCTCTGG GCCCTGCAGG AGGCCTGGGA GGGCAAGGGT CCTACGGAGG GACCAGGTGT

CTAGAGGCAA CAGTGTTCTG AGCCCCCACC TGCCTGACCA TCCCATGAGC AGTCCAGCGC TTCAGGGCTG

GGCAGGTCCT GGGGAGGCTG AGACTGCAGA GGAGCCACCT GGGCTGGGAG AAGGTGCTTG GGCTTCTGCG

GTGAGGCAGG GGAGTCTGCT TGTCTTAGAT GTTGGTGGTG CAGCCCCAGG ACCAAGCTTA AGGAGAGGAG

AGCATCTGCT CTGAGACGGA TGGAAGGAGA GAGGTTGAGG ATGCACTGGC CTGTTCTGTA GGAGAGACTG

GCCAGAGGCA GCTAAGGGGC AGGAATCAAG GAGCCTCCGT TCCCACCTCT GAGGACTCTG GACCCCAGGC

CATACCAGGT GCTAGGGTGC CTGCTCTCCT TGCCCTGGGC CAGCCCAGGA TTGTACGTGG GAGAGGCAGA
```

-continued

```
AAGGGTAGGT TCAGTAATCA TTTCTGATGA TTTGCTGGAG TGCTGGCTCC ACGCCCTGGG GAGTGAGCTT

GGTGCGGTAG GTGCTGGCCT CAAACAGCCA CGAGGTGGTA GCTCTGAGCC CTCCTTCTTG CCCTGAGCTT

TCCGGGGAGG AGCCTGGAGT GTAATTACCT GTCATCTGGG CCACCAGCTC CACTGGCCCC CGTTGCCGGG

CCTGGACTGT CCTAGGTGAC CCCATCTCTG CTGCTTCTGG GCCTGATGGA GAGGAGAACA CTAGACATGC

CAACTCGGGA GCATTCTGCC TGCCTGGGAA CGGGGTGGAC GAGGGAGTGT CTGTAAGGAC TCAGTGTTGA

CTGTAGGCGC CCCTGGGGTG GGTTTAGCAG GCTGCAGCAG GCAGAGGAGG AGTACCCCCC TGAGAGCATG

TGGGGGAAGG CCTTGCTGTC ATGTGAATCC CTCAATACCC CTAGTATCTG GCTGGGTTTT CAGGGGCTTT

GGAAGCTCTG TTGCAGGTGT CCGGGGGTCT AGGACTTTAG GGATCTGGGA TCTGGGGAAG GACCAACCCA

TGCCCTGCCA AGCCTGGAGC CCCTGTGTTG GGGGCAAGG TGGGGGAGCC TGGAGCCCCT GTGTGGGAGG

GCGAGGCGGG GGAGCCTGGA GCCCCTGTGT GGGAGGGCGA GGCGGGGAT CCTGGAGCCC CTGTGTCGGG

GGGCGAGGGA GGGGAGGTGG CCGTCGGTTG ACCTTCTGAA CATGAGTGTC AACTCCAGGA CTTGCTTCCA

AGCCCTTCCC TCTGTTGGAA ATTGGGTGTG CCCTGGCTCC CAAGGGAGGC CCATGTGACT AATAAAAAAC

TGTGAACCCT CGCATTTGTG TTTTAATAAA AGAATCTGGA AGATAAATAG TCTTGAAGAG AGACAAAGGA

AGGAAAATTT AAATCCTTAG ATTCAAGCAG AAGAATTCCA TGTGGAAGGT TTGGGTTGTT GTTGTTGTTG

TTTGGTGTGT TTTTTGTTTT TTTGTTTTTT TGTTTTTTTT TGAGATGGAG TCTCGCTGTG TTACCGGGAG

CGACAGAGCC GCACGGCCGA GTCGAGTCCC AGCCAGCTAC CATCCCTCTG GAGCTTACCG GCCGGCCTTG

GCTTCCCCAG GAATCCCTGG AGCTAGCGGC TGCTGAAGGC GTCGAGGTGT GGGGCACTT GGACAGAACA

GTCAGGCAGC CGGGAGCTCT GCCAGCTTTG GTGACCTTGG GTGCTTGCCT CGTGCCCCTT GGTGCCCGTC

TGCTGATGTG CCCAGCCTGT GCCCGCCATG CCGCCCTCCA TCTCAGCTTT CCAGGCCGCC TACATCGGCA

TCGAGGTGCT CATCGCCCTG GTCTCTGTGC CCGGGAACGT GCTGGTGATC TGGGCGGTGA AGGTGAACCA

GGCGCTGCGG GATGCCACCT TCTGCTTCAT CGTGTCGCTG GCGGTGGCTG ATGTGGCCGT GGGTGCCCTG

GTCATCCCCC TCGCCATCCT CATCAACATT GGGCCACAGA CCTACTTCCA CACCTGCCTC ATGGTTGCCT

GTCCGGTCCT CATCCTCACC CAGAGCTCCA TCCTGGCCCT GCTGGCAATT GCTGTGGACC GCTACCTCCG

GGTCAAGATC CCTCTCCGGT ACAAGATGGT GGTGACCCCC CGGAGGGCGG CGGTGGCCAT AGCCGGCTGC

TGGATCCTCT CCTTCGTGGT GGGACTGACC CCTATGTTTG GCTGGAACAA TCTGAGTGCG GTGGAGCGGG

CCTGGGCAGC CAACGGCAGC ATGGGGGAGC CCGTGATCAA GTGCGAGTTC GAGAAGGTCA TCAGCATGGA

GTACATGGTC TACTTCAACT TCTTTGTGTG GGTGCTGCCC CCGCTTCTCC TCATGGTCCT CATCTACCTG

GAGGTCTTCT ACCTAATCCG CAAGCAGCTC AACAAGAAGG TGTCGGCCTC CTCCGGCGAC CCGCAGAAGT

ACTATGGGAA GGAGCTGAAG ATCGCCAAGT CGCTGGCCCT CATCCTCTTC CTCTTTGCCC TCAGCTGGCT

GCCTTTGCAC ATCCTCAACT GCATCACCCT CTTCTGCCCG TCCTGCCACA AGCCCAGCAT CCTTACCTAC

ATTGCCATCT TCCTCACGCA CGGCAACTCG GCCATGAACC CCATTGTCTA TGCCTTCCGC ATCCAGAAGT

TCCGCGTCAC CTTCCTTAAG ATTTGGAATG ACCATTTCCG CTGCCAGCCT GCACCTCCCA TTGACGAGGA

TCTCCCAGAA GAGAGGCCTG ATGACTAGAC CCCGCCTTCC GCTCCCACCG CCCACATCCA GTGGGGTCTC

AGTCCAGTCC TCACATGCCC GCTGTCCCAG GGGTCTCCCT GAGCCTGCCC CAGCTGGGCT GTTGGCTGGG

GGCATGGGGG AGGCTCTGAA GAGATACCCA CAGAGTGTGG TCCCTCCACT AGGAGTTAAC TACCCTACAC

CTCTGGGCCC TGCAGGAGGC CTGGGAGGGC AAGGGTCCTA CGGAGGGACC AGGTGTCTAG AGGCAACAGT

GTTCTGAGCC CCCACCTGCC TGACCATCCC ATGAGCAGTC CAGAGCTTCA GGGCTGGGCA GGTCCTGGGG

AGGCTGAGAC TGCAGAGGAG CCACCTGGGC TGGGAGAAGG TGCTTGGGCT TCTGCGGTGA GGCAGGGGAG

TCTGCTTGTC TTAGATGTTG GTGGTGCAGC CCCAGGACCA AGCTTAAGGA GAGGAGAGCA TCTGCTCTGA

GACGGATGGA AGGAGAGAGG TTGAGGATGC ACTGGCCTGT TCTGTAGGAG AGACTGGCCA GA CCCAGCCCCG
```

```
AGGCTCAGAA GCGGCAGGCG GAGGCGCGGT CCGGGCGCTA TGGCCATGCC CGGCGGGTCT CACGCGGCTG
CCCCTCGCCC GGCGCGCCTT CGGTAGGGGG CGCCCGGGGC CCAGCTGGCC CGGCCATGCT GCTGGAGACA
CAGGACGCGC TGTACGTGGC GCTGGAGCTG GTCATCGCCG CGCTTTCGGT GGCGGGCAAC GTGCTGGTGT
GCGCCGCGGT GGGCACGGCG AACACTCTGC AGACGCCCAC CAACTACTTC CTGGTGTCCC TGGCTGCGGC
CGACGTGGCC GTGGGGCTCT TCGCCATCCC CTTTGCCATC ACCATCAGCC TGGGCTTCTG CACTGACTTC
TACGGCTGCC TCTTCCTCGC CTGCTTCGTG CTGGTGCTCA CGCAGAGCTC CATCTTCAGC CTTCTGGCCG
TGGCAGTCGA CAGATACCTG GCCATCTGTG TCCCGCTCAG GTATAAAAGT TTGGTCACGG GACCCGAGC
AAGAGGGGTC ATTGCTGTCC TCTGGGTCCT TGCCTTTGGC ATCGGATTGA CTCCATTCCT GGGGTGGAAC
AGTAAAGACA GTGCCACCAA CAACTGCACA GAACCCTGGG ATGAACCAC GAATGAAAGC TGCTGCCTTG
TGAAGTGTCT CTTTGAGAAT GTGGTCCCCA TGAGCTACAT GGTATATTTC AATTTCTTTG GGTGTGTTCT
GCCCCCACTG CTTATAATGC TGGTGATCTA CATTAAGATC TTCCTGGTGG CCTGCAGGCA GCTTCAGCGC
ACTGAGCTGA TGGACCACTC GAGGACCACC CTCCAGCGGG AGATCCATGC AGCCAAGTCA CTGGCCATGA
TTGTGGGGAT TTTTGCCCTG TGCTGGTTAC CTGTGCATGC TGTTAACTGT GTCACTCTTT TCCAGCCAGC
TCAGGGTAAA AATAAGCCCA AGTGGGCAAT GAATATGGCC ATTCTTCTGT CACATGCCAA TTCAGTTGTC
AATCCCATTG TCTATGCTTA CCGGAACCGA GACTTCCGCT ACACTTTTCA CAAAATTATC TCCAGGTATC
TTCTCTGCCA AGCAGATGTC AAGAGTGGGA ATGGTCAGGC TGGGGTACAG CCTGCTCTCG GTGTGGGCCT
ATGATCTAGG CTCTCGCCTC TTCCAGGAGA AGATACAAAT CCACAAGAAA CAAAGAGGAC ACGGCTGGTT
TTCATTGTGA AAGATAGCTA CACCTCACAA GGAAATGGAC TGCCTCTCTT GAGCACTTCC CTGGAGCTAC
CACGTATCTA GCTAATATGT ATGTGTCAGT AGTAGCACCA AGGATTGACA AATATATTTA TGATCTATTC
AGCTGCTTTT ACTGTGTGGA TTATGCCAAC AGCTTGAATG GATTCTAACA GACTCTTTTG TTTTTAAAAG
TCTGCCTTGT TTATGGTGGA AAATTACTGA AACTATTTTA CTGTGAAACA GTGTGAACTA TTATAATGCA
AATACTTTTT AACTTAGAGG CAATGAAAAA ATAAAAGTTG ACTGTACTAA AAATGTATAC TTGTTGCCAG
GAAGGTGACC TCAAAAATTA AAAGTATAAT TATTCGGCCG GCATGGTGG CTCACACCTG TAATTCCAGC
ACTTTGGGAG GCCAAGGCAG GCGGATCACG AGGTCAGGAG TTCAAAACCA GCCTGTCCAA TATAGTG
GGGCAATTTG TTAGTTATCC GCCGCCACCA AGACGCGGCA CGGCGCCTGG ACCGGAGGGG CCCCGCGCGG
GCGCGAACTT TGGGCTCGGG CGAGTGGGTG GTGCTCCGCC CAGCCCGAGA CGGGCGGGCG CGCGGGCCAA
TGGGTGCCGC CTCTTGGCCG CGGGGGGCCC CGACCCGTGG GTCCCGGCCA CCAGCGCCCC AGCCCCGAGG
CTCAGAAGCG GCAGGCGGAG GCGCGGTCCG GCGCTATGG CCATGCCCGG CGGGTCTCAC GCGGCTGCCC
CTCGCCCGGC GCGCCTTCGG TAGGGGCGC CCGGGCCCA GCTGCCCGG CCATGCTGCT GGAGACACAG
GACGCGCTGT ACGTGGCGCT GGAGCTGGTC ATCGCCGCGC TTTCGGTGGC GGGCAACGTG CTGGTGTGCG
CCGCGGTGGG CACGGCGAAC ACTCTGCAGA CGCCCACCAA CTACTTCCTG GTGTCCCTGG CTGCGGCCGA
CGTGGCCGTG GGCTCTTCG CCATCCCCTT TGCCATCACC ATCAGCCTGG GCTTCTGCAC TGACTTCTAC
GGCTGCCTCT TCCTCGCCTG CTTCGTGCTG GTGCTCACGC AGAGCTCCAT CTTCAGCCTT CTGGCCGTGG
CAGTCGACAG ATACCTGGCC ATCTGTGTCC CGCTCAGGTA TAAAGTTTA GTCACGGGA CCCGAGCAAG
AGGGTCATT GCTGTCCTCT GGGTCCTTGC CTTTGGCATC GGATTGACTC CATTCCTGGG GTGGAACAGT
AAAGACAGTG CCACCAACAA CTGCACAGAA CCCTGGGATG AACCACGAA TGAAAGCTGC TGCCTTGTGA
AGTGTCTCTT TGAGAATGTG GTCCCCATGA GCTACATGGT ATATTTCAAT TCTTTGGGT GTGTTCTGCC
CCCACTGCTT ATAATGCTGG TGATCTACAT TAAGATCTTC CTGGTGGCCT GCAGGCAGCT TCAGCGCACT
GAGCTGATGG ACCACTCGAG GACCACCCTC AGCGGGAGA TCCATGCAGC CAAGTCACTG GCCATGATTG
```

```
TGGGGATTTT TGCCCTGTGC TGGTTACCTG TGCATGCTGT TAACTGTGTC ACTCTTTTCC AGCCAGCTCA

GGGTAAAAAT AAGCCCAAGT GGGCAATGAA TATGGCCATT CTTCTGTCAC ATGCCAATTC AGTTGTCAAT

CCCATTGTCT ATGCTTACCG GAACCGAGAC TTCCGCTACA CTTTTCACAA AATTATCTCC AGGTATCTTC

TCTGCCAAGC AGATGTCAAG AGTGGGAATG GTCAGGCTGG GGTACAGCCT GCTCTCGGTG TGGGCCTATG

ATCTAGGCTC TCGCCTCTTC CAGGAGAAGA TACAAATCCA CAAGAAACAA AGAGGACACG GCTGGTTTTC

ATTGTGAAAG ATAGCTACAC CTCACAAGGA AATGGACTGC CTCTCTTGAG CACTTCCCTG GAGCTACCAC

GTATCTAGCT AATATGTATG TGTCAGTAGT AGGCTCCAAG GATTGACAAA TATATTTATG ATCTATTCAG

CTGCTTTTAC TGTGTGGATT ATGCCAACAG CTTGAATGGA TTCTAACAGA CTCTTTTGTT TTTAAAAGTC

TGCCTTGTTT ATGGTGGAAA ATTACTGAAA CTATTTTACT GTGAAACAGT GTGAACTATT ATAATGCAAA

TACTTTTTAA CTTAGAGGCA ATGGAAAAAT AAAAGTTGAC TGTACTAAAA ATG GAATTCCCAG ATGGGCAGAG

GTGGCTGGGC TGGTGACCCT AAGTGTGTCT CCTGCCTTTA TTCTCTCTAG TGGGTTATTC TTTCATGTGG

TATCTTGCCT ACAGCATGCT GTGTTTGGAC ACAAACCCCT TTCCTTGGTT TCTCTGACCC AGCTGAGATG

GACTGATTCC AAAAGAACTC ACCTATGTAC TGGGGTAGGG GAGGGAGGGT TTTTTGCAGT ATTTAACTAA

GGTTCAAAGA GTGCTATATA GTGAGAAAGG CTTCTTTTTT TTTTTTTTTT TTTTTGGCA GAGTGCTGCC

TCCTAGAAAT TTCTCTTGGT AACTTCCTTC TCTGAAGCAC AGATAAAGAA AACAATTACA GTAGAAACAT

TTATGAGGGA CACATTGGAG GCCGATGAAG CTTTTCAAGT TCCAGCAGTG CAGGGATGTG GGCAGAACTG

ACATTGGAAA ATACTAGAAT GATGGAAATT CAGTTGGAGA GGACTGCCCT TTTTAATGTC TGGGGAGTCT

GCTCAGGGAG AAATGACAAG TCTGGCGGGG ACAAGTATGG GATTTGGTAA GACTTGGATC AACTTGGGAT

ACAGGGTGGG GGTCGGGAGT GGAATCAATG AATGATGCCA GAGCAGATCA ACTAACAAGA GGACCCTGAT

GAGCCCCAGG CAGAGGCGTC TCCCTTATGC CCCACTCTGA AGTGTTTGTT AGTAAACACC AGAACGCCAT

TGTTGTTACT GCTGAATTTT ATTTTGGGCT GTACATATTT AGATGCTTAA GGTAAAAATG ATAAAGCCCT

CAAGCCACTG TGTGGGTTTG GGTCCAAGTG TTCCTTCTTG CTGCCTCTCT AACACGCCTG GTTAAAATAA

TCCCTTTGGA TGGTGCTGAG AAGCACCTGA ACCAAGTGGG TCCCCAAATA ACAATGGCGT GCAAGTGTCT

GGTTCCCAGA AGTTGGTGAC TAGGTAAGCA GCTTCAGGGA GAGGGGCTG ATTCCCAGAC AGTCGCCTGT

TCCTGCGGGG ATGGGCTGA GGCTTGGGA ATGTGGGCAG GAGGATATGC CATTTGATTC TGTTGCACAC

GTTCTTTTCC CTTCTTTCTG TATGTCTGGT CATTCTGCTA TTCTGTCGTT CCTCACATAG GTTGGACATT

GGCCGGCTGC CAGCATAAGT GCCAGTGTGA TTTTGCTAGG TGTGAGCTGA GAAAGAGAGG TGGAGGCTAA

GCAGGTGTGA TGCTTCTCAG AGGTGCTGAG TTTTTGCCCT TCTGAGCAGG AATCTTTGC TTATCCCTTT

GACCAAGGAT CTTTGCTGCA AAGGCTGGGT ATCGGCTGTG CTCAGCAAAG CGTCAACTCG TGCAAGAACT

TAGCAGGAAT AGTTCTGGCT AAGGTTAGGA GGCTGCCACC AAAGTCTCTT TTTTGTTCCT CTGCTTCTCC

CGTTTGCCTC CTTATCATGA GATCTTTTTG CTAAGCTGGC AGAAAGATTG CATAGTCAGT GCTTCCAGCT

CTGCTCCCAC CTGATCCTGC ACTGTCCTCT GGTCCCTGAA TGAATGAACT CTGATACCCA ATCTTGTCTC

GAGCCTTCTC TATGCCACTC ATGGCTCCTC TTCTGCTCTT TCCATCTTTT TGCTGAGAGT TCTGAGCTCT

GTACTTCCTC TTGGCCCATC TCACTTCCTG AAACACCCCT GAAGAGGGTT GCTTATCTTG ATGGAACTCA

AAAAGCCAAA AAGCTGCAGG CAGAGGCGTT GAGGACATCT GTTTGGGAA CTAAGAGCAG CAGCACTTTC

AGATTCAGTC CATATAGAGC TGTCCTACAG CATTCTGGAA ACTTGAGGAT GTGCGGTGCA TAAAGGGGCT

GGAAGTGACC CACCTGTGAT GAGCCCTTTC TAAGGAGAAG GGTTTCCAAG AGATCACCCC ACCAGAAAAG

GGTAGGAATG AGCAAGTTGG GAATTTTAGA CTGTCACTGC ACATGGACCT CTGGGAAGAC GTCTGGCGAG

AGCTAGGCCC ACTGGCCCTA CAGACGGATC TTGCTGGCTC ACCTGTCCCT GTGGAGGTTC CCCTGGGAAG

GCAAGATGCC CAACAACAGC ACTGCTCTGT CATTGGCCAA TGTTACCTAC ATCACCATGG AAATTTTCAT
```

```
TGGACTCTGC GCCATAGTGG GCAACGTGCT GGTCATCTGC GTGGTCAAGC TGAACCCCAG CCTGCAGACC
ACCACCTTCT ATTTCATTGT CTCTCTAGCC CTGGCTGACA TTGCTGTTGG GGTGCTGGTC ATGCCTTTGG
CCATTGTTGT CAGCCTGGGC ATCACAATCC ACTTCTACAG CTGCCTTTTT ATGACTTGCC TACTGCTTAT
CTTTACCCAC GCCTCCATCA TGTCCTTGCT GGCCATCGCT GTGGACCGAT ACTTGCGGGT CAAGCTTACC
GTCAGGTAGC CTGCGGCGTG GGTGGGCAG CAATTGAGGC AGCTGGGAAA TGAGGCTACA AAGCCAGAGCS
CTGCTGAATT TTATTTTGGA CTGTACATAT TTAGATGCTT AAGGTAAAAA TGATAAAGCC CTCAAGCCAC
TGTGTGGGTT GGGTCCAAGT GTTCCTTGCT GCTGCCTCTC TAACACGCCT GGTTAAAATA ATCCCTTTGG
ATGGTGCTGA GAAGCACCTG AACCAAGTGG GTCCCCAAAT AACTATGGCG TGCAAGTGTC TGGTTCCCAG
AAGTTGGTGA CTAGGTAAGC GACTCAGGGA GAGGGCTGA TTCCCAGACA GTCGCCTGTT CCTGCTGGGA
TGGGCTGAG GCTTGGGAA TGTGGGCAGG AGGATATGCC ATTTGATTCT GTTGCACACG TTCTTTTCCC
TTCTTTCTGT ATGTCTGGTC ATTCTGCTAT TCTGTCGTTC CTCACATAGG TTGGACATTG GCCGGCTGCC
AGCATAAGTG CCAGTGTGAT TTTGCTAGGG TGTGAGCTGA GAAAGAGAGG TGGAGGCTAA GCAGGTGTGA
TGCTTCTCAG AGGTGCTGAG TTTTTGCCCT TCTGAGCAGG GAATCTTTGC TTATCCCTTT GACCAAGGAT
CTTTGCTCCA AAGGCTGGGT ATCGGCTGTG CTCAGCAAAG CGTCAACTCG TGCAAGAACT TAGCAGGAAT
AGTTCTGGCT AAGGTTAGGA GGCTGCCACC AAAGTCTCTT TTTTGTTCCT CTGCTTCTCC CGTTTGCCTC
CTTATCATGA GATCTTTTTG CTAAGCTGGC AGAAAGATTG CATAATCAGT GCTTCCAGCT CCGCTCCCAC
CTGATCCTGC ACTGTCCTCT GGTCCCTGAA TGAATGAACT CTGATACCCA ATCTTGTCTC GAGCCTTCTC
TATGCCACTC ATGGCTCCTC TTCTGCTCTT TCCATCTTTT TGCTGAGAGT TACTGAGCTC TGTACTTCCT
CTTGGCCCAT CTCACTTCCT GAAACACCCC TGAAGAGGGT TGCTTATCTT GATGGAACTC AAAAAGCCAA
AAAGCTGCAG GCAGAGGCGT TGAGGACATC TGTTTGGGGA ACTAAGAGCA GCAGCACTTT CAGATTCAGT
CCATATAGAG CTGTCCTACA GCATTCTGGA AACTTGAGGA TGTGCGGTGC ATAAAGGGGC TGGAAGTGAC
CCACCTGTGA TGAGCCCTTT CTAAGGAGAA GGGTTTCCAA GAGATCACCC CACCAGAAAA GGGTAGGAAT
GAGCAAGTTG GGAATTTTAG ACTGTCACTG CACATGGACC TCTGGGAAGA CGTCTGGCGA GAGCTAGGCC
CACTGGCCCT ACAGACGGAT CTTGCTGGCT CACCTGTCCC TGTGGAGGTT CCCTGGGAA GGCAAGATGC
CCAACAACAG CACTGCTCTG CGAATTCGGG GGACATCTGT TTGGGGAACT AAGAGCAGCA GCACTTTCAG
ATTCAGTCCA TATAGAGCTG TCCTACAGCA TTCTGGAAAC TTGAGGATGT GCGGTGCATA AACGGGCTGG
AAGTGACCCA CCTGTGATGA GCCCTTTCTA AGGAGAAGGG TTTCAAGAG ATCACCCCAC CAGAAAAGGG
TAGGAATGAG CAAGTTGGGA ATTTTAGACT GTCACTGCAC ATGGACCTCT GGGAAGACGT CTGGCGAGAG
CTAGGCCCAC TGGCCCTACA GACGGATCTT GCTGGCTCAC CTGTCCCTGT GGAGGTTCCC TGGGAAGGC
AAGATGCCCA ACAACAGCAC TGCTCTGTCA TTGGCCAATG TTACCTACAT CACCATGGAA ATTTTCATTG
GACTCTGCGC CATAGTGGGC AACGTGCTGG TCATCTGCGT GGTCAAGCTG AACCCCAGCC TGCAGACCAC
CACCTTCTAT TTCATTGTCT CTCTAGCCCT GGCTGACATT GCTGTTGGGG TGCTGGTCAT GCCTTTGGCC
ATTGTTGTCA GCCTGGGCAT CACAATCCAC TTCTACAGCT GCCTTTTTAT GACTTGCCTA CTGCTTATCT
TTACCCACGC CTCCATCATG TCCTTGCTGG CCATCGCTGT GGACCGATAC TTGCGGGTCA AGCTTACCGT
CAGATACAAG AGGGTCACCA CTCACAGAAG AATATGGCTG GCCCTGGGCC TTTGCTGGCT GGTGTCATTC
CTGGTGGGAT TGACCCCCAT GTTTGGCTGG AACATGAAAC TGACCTCAGA GTACCACAGA AATGTCACCT
TCCTTTCATG CCAATTTGTT TCCGTCATGA GGATGGACTA CATGGTATAC TTCAGCTTCC TCACCTGGAT
TTTCATCCCC CTGGTTGTCA TGTGCGCCAT CTATCTTGAC ATCTTTTACA TCATTCGGAA CAAACTCAGT
CTGAACTTAT CTAACTCCAA AGAGACAGGT GCATTTTATG GACGGGAGTT CAAGACGGCT AAGTCCTTGT
```

```
TTCTGGTTCT TTTCTTGTTT GCTCTGTCAT GGCTGCCTTT ATCTCTCATC AACTGCATCA TCTACTTTAA
TGGTGAGGTA CCACAGCTTG TGCTGTACAT GGGCATCCTG CTGTCCCATG CCAACTCCAT GATGAACCCT
ATCGTCTATG CCTATAAAAT AAAGAAGTTC AAGGAAACCT ACCTTTTGAT CCTCAAAGCC TGTGTGGTCT
GCCATCCCTC TGATTCTTTG GACACAAGCA TTGAGAAGAA TTCTGAGTAG TTATCCATCA GAGATGACTC
TGTCTCATTG ACCTTCAGAT TCCCCATCAA CAAACACTTG AGGGCCTGTA TGCCTGGGCC AAGGGATTTT
TACATCCTTG ATTACTTCCA CTGAGGTGGG AGCATCTCCA GTGCTCCCCA ATTATATCTC CCCCACTCCA
CTACTCTCTT CCTCCACTTC ATTTTTCCTT TGTCCTTTCT CTCTAATTCA GTGTTTTGGA GGCCTGACTT
GGGGACAACG TATTATTGAT ATTATTGTCT GTTTTCCTTC TTCCCAATAG AAGAATAAGT CATGGAGCCT
GAAGGGTGCC TAGTTGACTT ACTGACAAAA GGCTCTAGTT GGGCTGAACA TGTGTGTGGT GGTGACTCAT
TTCCATGCCA TTGTGGAATT GAGCAGAGAA CCTGCTCTCG GAGGATGCCT AGGAGATGTT GGGAACAGAA
GAAATAAACT GAGTTTAAGG GGGACTTAAA CTGCTGAATT C AAATGATAGA CCGTCAATAA TTTGTTAAAT
GCTTTTTAAA ATGAATGCTT TAAGCCGGGT GCAGTGCCTC ACATCTGTAA TCCCAGCACT TTGGAGCCGA
GCGGGTGGAT TGTGTGAGGT CAGGAGTTCG AGACCAACCT GGCCAACATG GCAAAACCTC ACTCTCTACC
AAAAATACAA AAATTAGCCA GGCATGGTGG CAGGCACCTG TGATCCCAGC TACTCAGGAG GCTGAGACAG
GAGAATCGCT TGAACCCGGG AGGCAAGGTT GCAGTGAGCC AAGATTACGC CATTGTACTC CAGCCTGGGT
GACAGAGAGA GACTCCGTCT CAAAAAAAAA AAAAAAAAA AAAAAATTAC GCTTCAAACA CATGATCTCT
CACCACTGTT GAATTTTCTT TCTATGAGCC CAGGAGGGCC TCTCAGAGAG GAAAGCTCCT AGGTCTTCCT
TTCCCTCTGC AAACTCCCTG CCTTGAAGGT TCAGAAGGAC TGTGCGTGCT CGTTGCATCC TTTGCAAGTG
TCCAAACCCT GATCCCAGCT GTGCTTAGGG GTTCCTGCAA ACCTTTTCCA GGTGTTAATT ACCTCCCACT
TCATTTCCTG TTTACCAACT CAGCTTTTTG TTTTAGTGTG TTTGAATTCC CTGAACTGAC CGTTGTCTGA
TCTCCACCTC CCAACTGAAT TAGGGGAGCT GGGCTTCTGG AAACCCAGGT GCCGGGTGTT GCAGAGTGGC
TGAAAGCTGG GATGTGGCAG ATCCGTGGCT ACATTCATGC ACACACACAC ACCCACATAC CCACACATGC
ACACACACAC ACACACCCGC ACTCACACAC TTGGACATGC ATAGACCACA GCTTTCCACA CCCTTCCTAG
ACAGGGTCA CTTGGTATCC TGGAGAGAGT GTGAAGTCCT GGAATGGAAA GAGGGGGAT TAAGCCCCAC
CTCTAGCCAT GGGACTGAGA CAAGTCACCA CCAACCCATC TGCGCCTTGT TTACCTCCTC TGTGAGGCAA
GCACAGAGCC CATGCCTGCC CCCCTGGATG GGAGTGATGT GAAACTTGAA GGGCGGTCAG AGCAAGGGTC
GGGAATGGAA GGCCCTTGGG AAAAAAGGCC CTTTCAACTA GGGGCACAGA GGAGGCCCTG GGCTGAGAAC
TTGACAGCAC CTTGTAATTG GTAAGCCAAG CCCGAAGGGA CTGGAAATAC TCAGATGTGT CTGTCTCCCT
TATTAGGTTC AAAGTCCCTC AAGACCCTGT CTCCATCACA GTGCTCCAGT CCAGACCCCT CCTCTGAGCT
CCAGACCCTG CTGGACCCAA CCAGCCCTAT GGGGTCGCAT CCCCACCTGC CTGGAATTCT CCAAAGAACC
TCCCCTTTAA CAGTTCCAGC CTTTAACAGT TCCAGTCTAA ACACATGACC TTTCTCCTCT AAATCAGCCC
CCCATCTCTG CCTTTGCAGG AGATGGAAGC CATGACACCT GCCTCGCCCC TGTCCTCACC CCATCCATGT
CCAATCAAGC ACTAGGCATG TCAGGTTTAC CCTCTAAACT CCTCTGGAAT CCAGTCTCTC AGTCTCCATC
ATCCCAGGTC GAAGCTAATG GGCTAACTGG TCCTTGCTTC CACTCTACCC CCACTGCAGT CCTGACTTCC
TGAGCAGCAG CCAGGGCCTA ATCGATATTC ACACCAAGCG CCAACCTGAC TGAGATATCC TCCTGCACCA
TCATCCCTCC ACCCTGTTTA GTTCTGCTCA CCCTCAGTGT TCTCATCAAT AATCCACTCC CCTCACAGGC
GCGTTTGGGA CCCCATGTTC TATGCTCTCA CAGGACCTTT TGCTTGATTT TTCACTGTAC TTAGGTCAGT
TTGCAGTTAT TAAGTGACTG AGCAATGTCT GGCTTCTCCA GTAGACTGTC AGCTCCTAGC CATTGTATAC
CTAGCACCGC TGTGTGGGAG CACGTGACAA ACGTCCAGTG AGTCAGGGAC TCAGCAGTCT CCATTTCTCC
GCCCTGCTGG AGAATGCGTG TATTTGGCAA TCCCCAGCCC CTGTGCCATC TAACCATCTT TTCTTCTCTG
```

-continued

```
TTCAGCCCAG GTGTGGCCTC ACTCACATCC CACTCTGAGT CCAAATGTTC TCTCCCTGGA AGATATCAAT
GTTTCTGTCT GTTCGTGAGG ACTCCGTGCC CACCACGGCC TCTTTCAGGT GAGTCAAAGG GATTCCTCAG
TTCACTAGTT AGGGGAGGTG GGCAGACACC CTGGAGAACT CCCTGGAAAG CTCAACTCTC ATGCCCCGGA
CAACAGTTGA AGGAACCATG GTGATGTTAA GCCCAAAGAC AAAACCTCTC AGGTGTCCAA GTCCCTGTTG
GAATCTTGGG AGCAGAGGGA ATGTTCTGTG GTCTAGAGGA AGAGGGCTC AGGGAGGAGA AGGGCACATT
CCTGGTTGTT ATATGTTTCT ATCTATCCCA GATGAACTTG GAAGTGAAGG GAAGAGAGTT AAACATTAAA
GTAAATACCC AGTGGATCAG ACAGCAATGT GCCAGATTGC CTTGGAAACA AAATATCTCC AACACATGGC
TGACATTTGG TGGGAGATCA GAACACCCTA AGAGAGAAT TTAAGGGGAG GGGGAGGAGG ACCTGAGCCA
GAGTAGAAGC AGAGGATAGG GAGATCTGTT CTTGGGGACA GCATTTGCAA GAAACAAGGC TGAGGGGTCC
ACTCCAACCT CTCCACCCTG CTGCAGGTGC TGCCTATGAT GAAGATGAGC AGATGGCCAT CTCAGCTGGG
GCCACAGTGC ACTGGACCTA TAGTTTCCAA TTCCGCACTC AGCAGGCATC TTTCTGATGA TCCGATGGCT
TCTCAGAGCC AGGGATGGGC CAGGATCCAT CCCCTTGGCT ACTGTCTTGC TGAGAAATTT ATAAGCAGCA
TCTGGTGCTA TACTTTGGTC TCTAGTGAGT TAGCTCATGA AAGATGATAG ACTCTCCAAG CCAGGGGTAT
GCAGGAAATG GGTTTTCTGT AGCTACAGAA ATGGGGTTGA GGGTTGGACC AAGGGACTAC CCAGGGGAAG
TCTTACCTTC AGAGGACTCT GGAAAGGAGG CTGCAAGTTT TCATGGGTCA AGAATTCAGA GCCCAGTAGA
GACAGCTTAT CTCTGTTCCA AGATGTCTGG GGCCTTGGTT GGAAGATTCA AAGGCTAGGA AACCAGGAGC
CACCAAAAGC GTAACTGGGG CCAGAGGATC CACTTTCAAG GTGGCAAGTT GGTTCCCCCC ATGTGGCTGC
TTGAGTATCC TCACATGGCG GCTCACATCC TTCCAAGTAA GCAATGCAAA AGGCCAAGAA AGATGCTGCA
AAGATGTTAT GACCTAGCCT CAGAAATCAC ACACCATCCC TGCCACCATT AGTAAGAAGT CCAGCCCACG
TCCAGGAGAA GAGGAAGCAG ATTCCTCCTT TTGAAATGAA GAATATCAAG TAATTCGGGG GGCATATGAA
AGCCACCACA CACCACAGGG ATCTTTTTAG AGCATACTTC TTATACCATC ACTGTAGTTC CTTAAGACTC
AGGGGCAAAG CCTCACTTCC TTAGCACCCA GTGAAGACCA CGCTTACTCC CTCACTCAAC CTCTTGCTAC
TTCCCACCTC TCCTGTCCAA CATCTAGTGT CACTTTCCAG AACATACCAA CAGCTTCCCC AGTTCTGTGC
CTCTGCTCAG GCTGTTCCCC CTGCCTGGTC CACTTGTCCT CCTTCTTGTC CGGTCAAAAT GCTTCTTATC
CTTCAAGACC CAGCTCTAGA GTCACCTCCA ACCCCTTACC CACCAGCCCC CTCTCCAAGT CTGTGTCCCA
CAACCCCCCT GCTCCCTCCA GGGCACCCTC CACCCTCTGG GCCACAGTTG TCAGGAGTCA GGCAGGGCAG
GGGCCGGGTG GTGTCTTCTT TGTGTTCTTG CACTCAGGGC AGAGCTCAGC ACAGAGCAGA CGCTCAAAAA
ACATTTAAAG GATAGAAGCA TTGATTTGTG GGTCCCCCAG TCTGGCTCCA GGATGCCAGC CAGCTGCTCC
TAGAAGCAAA CGGACTTTTC CTGGGAAATC CCAGAGGTGA TGATCAGTAA TCTCTCCCGT GACTCGTAGT
TCAGCTCTTC CTCCATGAGC CTGACTATCA GTGGACCTTC CAGAAAGAGC CCCTTTTCCT TCTCTCACCC
ACAGCACAGG GCACTGGGAA AATGCCCAAT GAGTCCTGCC TCTGGTTGT GCTTTGGACT TTTCAGTGTG
TCTCGCATCC ACTCTTCAAC TTGAATGTTG CAACAGCCAT GAAAAAGAA ATGCAAAGCG ATTCAGGATG
AGAGCAATAC CCTACTCCAA AGAAGGCAAC ATAGAAGCTC AGAGAGATCA AGCAATTTGC CCAAGACCAC
ACAGCTAGGA GTGAACTCA TGGCTGTCCA AGCCCCATGC CTCTGCTGAA GGTAGAGATG AATTACAGCA
ACAAGTCTAG AAAGGTGCCT GCCCTATGGT CTGTGAGTCT TGCCTAAGAA TGAAAGAGGA GCCAGTGGGT
TAAAGATGAG GTCACCAACA ACGGTGGTGT TGGAGTTTAC CACTGATAAT AAGGGTGCAA AATGTAAATT
ACTAATGTTT ATTGAGCCTA GTGCAGTGCG TGGGGCATTT TGCACATTGT CTCTGATCCC TATGACAACC
CTGAGAGGTA GTGGTTTTAA CTGCCATGTT ACAGGTGAGG TCATTGTGGT TCAAGGACGT TAAGTAACTT
CCCCAGCGTG ACACGGCTTA TAAGTAAGGC AGCCAGGATG TGAACCCAGT AGGACTATCT GGCTGCAAAG
```

-continued

```
TCCCCACCCC CCTCGCCATC TGTATCCTCC AATCACTTCA GTGCTTTGCT GCATAGAAGG TAACGGAAAT

CACGATGCCA CAGACTGTCC AGGAAGACAG AAACTAGGCA GATGGGCTGG CCATGGTCTC CAAGCCAGAC

TGGAATCTCC AGGTCTGGAA TGATATCATT TTTCTCTTTT AATAAATTAA CTCACCCACC ACACGGCTTT

GAGAGGCTCA AAGTTGACCA ACTCCCTTGG GAGGGCCCCG GTTGATAAGG AAGGAACGTG AATCCTCCCA

TCACGGAAGC TTCAAGGAGG TCAAGGGTCC AACACTTGAG ATTGTTAGTG CTGTTGGTGG ATACTGGCCA

AGGAAATATC CCAGTGGAGC CTCGAGATGA AGAACATGAG GCCCCCGTTT AGAACCAAGG ATCAGAGGGG

GCTCTGTAAG ACCCAGGGGA GTCAGGTGCA CTGGAGCGCG GGCATGCAGA AAACAGCCTG AGCTCCACCT

CGGCTTCTCC TTGTCCTGGC TGGTTGTCCT TAACCCCTGT CTCCTTCTGG ACCAGTTTTT GTCCTTCCCT

TGTGACCGCT GAGGGGTAAC AGCCTCTTTC CACTTTCTTT CAGCGCCGAC ATGCTCAATG TCACCTTGCA

AGGGCCCACT CTTAACGGGA CCTTTGCCCA GAGCAAATGC CCCCAAGTGG AGTGGCTGGG CTGGCTCAAC

ACCATCCAGC CCCCCTTCCT CTGGGTGCTG TTCGTGCTGG CCACCCTAGA AACATCTTT GTCCTCAGCG

TCTTCTGCCT GCACAAGAGC AGCTGCACGG TGGCAGAGAT CTACCTGGGG AACCTGGCCG CAGCAGACCT

GATCCTGGCC TGCGGGCTGC CCTTCTGGGC CATCACCATC TCCAACAACT TCGACTGGCT CTTTGGGGAG

ACGCTCTGCC GCGTGGTGAA TGCCATTATC TCCATGAACC TGTACAGCAG CATCTGTTTC CTGATGCTGG

TGAGCATCGA CCGCTACCTG GCCCTGGTGA AAACCATGTC CATGGGCCGG ATGCGCGGCG TGCGCTGGGC

CAAGCTCTAC AGCTTGGTGA TCTGGGGGTG TACGCTGCTC CTGAGCTCAC CCATGCTGGT GTTCCGGACC

ATGAAGGAGT ACAGCGATGA GGGCCACAAC GTCACCGCTT GTGTCATCAG CTACCCATCC CTCATCTGGG

AAGTGTTCAC CAACATGCTC CTGAATGTCG TGGGCTTCCT GCTGCCCCTG AGTGTCATCA CCTTCTGCAC

GATGCAGATC ATGCAGGTGC TGCGGAACAA CGAGATGCAG AAGTTCAAGG AGATCCAGAC GGAGAGGAGG

GCCACGGTGC TAGTCCTGGT TGTGCTGCTG CTATTCATCA TCTGCTGGCT GCCCTTCCAG ATCAGCACCT

TCCTGGATAC GCTGCATCGC TCGGCATCC TCTCCAGCTG CCAGGACGAG CGCATCATCG ATGTAATCAC

ACAGATCGCC TCCTTCATGG CCTACAGCAA CAGCTGCCTC AACCCACTGG TGTACGTGAT CGTGGGCAAG

CGCTTCCGAA AGAAGTCTTG GGAGGTGTAC CAGGGAGTGT GCCAGAAAGG GGGCTGCAGG TCAGAACCCA

TTCAGATGGA GAACTCCATG GGCACACTGC GGACCTCCAT CTCCGTGGAA CGCCAGATTC ACAAACTGCA

GGACTGGGCA GGGAGCAGAC AGTGAGCAAA CGCCAGCAGG GCTGCTGTGA ATTTGTGTAA GGATTGAGGG

ACAGTTGCTT TTCAGCATGG GCCCAGGAAT GCCAAGGAGA CATCTATGCA CGACCTTGGG AAATGAGTTG

ATGTCTCCGG TAAAACACCG GAGACTAATT CCTGCCCTGC CCAATTTTGC AGGGAGCATG GCTGTGAGGA

TGGGGTGAAC TCACGCACAG CCAAGGACTC CAAAATCACA ACAGCATTAC TGTTCTTATT TGCTGCCACA

CCTGAGCCAG CCTGCTCCTT CCCAGGAGTG GAGGAGGCCT GGGGGCAGGG AGAGGAGTGA CTGAGCTTCC

CTCCCGTGTG TTCTCCGTCC CTGCCCCAGC AAGACAACTT AGATCTCCAG GAGAACTGCC ATCCAGCTTT

GGTGCAATGG CTGAGTGCAC AAGTGAGTTG TTGCCCTGGG TTTCTTTAAT CTATTCAGCT AGAACTTTGA

AGGACAATTT CTTGCATTAA TAAAGGTTAA GCCCTGAGGG GTCCCTGATA ACAACCTGGA GACCAGGATT

TTATGGCTCC CCTCACTGAT GGACAAGGAG GTCTGTGCCA AGAAGAATC CAATAAGCAC ATATTGAGCA

CTTGCTGTAT ATGCAGTATT GAGCACTGTA GGCAAGAGGG AAGAAAGAGA AGGAGCCATC TCCATCTTGA

AGGAACTCAA AGACTCAAGT GGGAACGACT GGGCACTGCC ACCACCAGAA AGCTGTTCGA TGAGACGGTC

GAGCAGGGTG CTGTGGGTGA TATGGACAGC AGAAGGGGA GCCAGGTTCC AGCTCACCAA TACTATTGCA

CACCACCTGT CCTGCCCTC GCCCTTCAAA GATGAGCTGT TCCCGCCGCC ACTCCAGCTC TGGCTTCTGG

GCTCCGAGGA GGGGTGGGGA CGGTGGTGAC GGTGGGGACA TCAGGCTGCC CCGCAGTACC AGGGAGCGAC

TGAAGTGCCC ATGCCGCTTG CTCCGGAGAA GGTGGGTGCC GGGCAGGGGC TGCTCCAGCC GCCTCACCTC

TGCTGGGAGG ACAAACTGTC CCAGCACAGA GGGAGGGAGG GAGGGCAGGC AGCGGGGAGA AGTTTCCCTG
```

```
TGGTCGTGGG GAGTT GAGCTCTTCA ATATTTTAGT GAAAGCTATA GATGAGGCTC CATAGGGGAT AAAGCACAGA

CACACCTTTT CAGAGGGCTT GTGGACTCTG GGCAGCCTGT CCATAGACCT CTGTCCCCAA CTGGCAAGTC

AGGAAACTCC AGATTAAGGA GCCCCAATGT GGTTGAACAG CCAGGTGCAC AGATGAGTCA ACCACACAGC

CAGGCCAGGG AGGGCCTTCA CTCAAGAGCC TACAGCCAGT TCACAGCCAA GCCAGGGCTA GCGCCAGGCC

ACCCATAAAC TGATCTGAGA CTCTGTTTCC CTGTCTCCAT GATGATGGGA TCAGGCTTGA TTGCTGGTTT

GTAGGCTTGT TATGAATCAA GTCACAGGGA AGAGGAGCTG ATGGGCTGGG GGACGTCCT CTGGCCCTCC

TGTCTCTTCC CCAGATCCAC TGGGCCCACT CTTATCTGTT CTCTTCTGAA GGAAGGGTTT TAAGGCTTCA

AAAAAAAATG TTTTGAAAGT CCCTGCCCTT TCCAGCTCCT ACCGTCTCAG CCCTGGGAGT GTAAAGTGCT

GCAGATAGTT AGTAAGTCTT TGAGCAAAAC TGAGAAAGCC AGCCTGAGCC TTGACATGGG AGAAACCTCC

GCCATACATC TCCGAAGAAA CGGCCGCGTG TCTCAGGGGA GCGCAAACAC CCGTACCCAG GAAACAGGAC

AGCTTCTGCC ACTGTCGCCC TTGGGAGCCG TACGTGGCAT GACAAAGAAA TCCCAGGACT CCGCCTGCCC

ACCTGGCCAC CCTCTGTTTA CACCTTCCGC GTAAACGCCC ACTGTTTACA TCCAAAACTC AGACACAAAA

TAACCACCTC AAGAAGATAA ATAATGATAA GAAATAAATG TTACGCGAGG CAAATTTATT CACATGGGGC

TTCCCAGGCC ACTTTGTGGT CAGCCGGGAG GGACGTTTTT GCCGTCCCAC GACTCCAACG GGCAGCCGGG

CCTACGCAAA CATGGAAATC TTCCAAGAGC CTCCCTGGCC CCCAGGGCTC AGAGGGTGGC AGAGCGGAGA

GCGAAGGTGG CCGCAGCCTT CCCGGCCCCA CAGCCAGCCT GGCTCCAGCT GGGCAGGAGT GCAGAGCTCA

GCTGGAGGCG AGGGGGAAGT GCCCAGGAGG CTGATGACAT CACTACCCAG CCCTTCAAAG ATGAGCTGTT

CCCGCCGCCA CTCCAGCTCT GGCTTCTGGG CTCCGAGGAG GGGTGGGGAC GGTGGTGACG GTGGGGACAT

CAGGCTGCCC CGCAGTACCA GGGAGCGACT GAAGTGCCCA TGCCGCTTGC TCCGGAGAAG GTGGGTGCCG

GGCAGGGGCT GCTCCAGCCG CCTCACCTCT GCTGGGAGGA CAAACTGTCC CAGCACAGAG GGAGGGAGGG

AGGGCAGGCA GCGGGGAGAA GTTTCCCTGT GGTCGTGGGG AGTTGGGAAA AGTTCCCTTC CTTCCGGAGG GAGG

CAGATTCACA AACTGCAGGA CTGGGCAGGG AGCAGACAGT GAGCAAACGC CAGCAGGGCT GCTGTGAATT

TGTGTAAGGA TTGAGGGACA GTTGCTTTTC AGCATGGGCC CAGGAATGCC AAGGAGACAT CTATGCACGA

CCTTGGGAAA TGAGTTGATG TCTCCGGTAA ACACCGGAG ACTAATTCCT GCCCTGCCCA ATTTTGCAGG

GAGCATGGCT GTGAGGATGG GGTGAACTCA CGCACAGCCA AGGACTCCAA AATCACAACA GCATTACTGT

TCTTATTTGC TGCCACACCT GAGCCAGCCT GCTCCTTCCC AGGAGTGGAG GAGGCCTGGG GGGAGGGAGA

GGAGTGACTG AGCTTCCCTC CCGTGTGTTC TCCGTCCCTG CCCCAGCAAG ACAACTTAGA TCTCCAGGAG

AACTGCCATC CAGCTTTGGT GCAATGGCTG AGTGCACAAG TGAGTTGTTG CCCTGGGTTT CTTTAATCTA

TTCAGCTAGA ACTTTGAAGG ACAATTTCTT GCATTAATAA AGGTTAAGCC CTGAGGGTC CCTGATAACA

ACCTGGAGAC CAGGATTTTA TGGCTCCCCT CACTGATGGA CAAGGAGGTC TGTGCCAAAG AAGAATCCAA

TAAGCACATA TTGAGCACTT GCTGTATATG CAGTATTGAG CACTGTAGGC AAGACCCAAG AAAGAGAAGG

AGCCATCTCC ATCTTGAAGG AACTCAAAGA CTCAAGTGGG AACGACTGGG CACTGCCACC ACCAGAAAGC

TGTTCGACGA CGGTCGAG CAGGGTGCTG TGGGTGATAT GGACAGCAGA AGGGGAGAC CAAGGTTCCA

GCTCAACCAA TAACTATTGC ACAACCACCT GTCCCTGCCT CAGTTCCCTT TTATGTAACA TGAAGTCGTT

GTGAGGGTTA AAGGCAGTAA CAGGTATAAA GTACTTAGAA AAGCAAAGGG TGCTACGTAC ATGTGAGGCA

TCATTACGCA GACGTAACTG GGATATGTTT ACTATAAGGA AAAGCACTG AGGTCTAGAA ATAGCTCCGT

GGAGCAGAAT CAGTATTGGG AGCCGGTGGC GGTGTGAAGC ACCAGTGTCT GGCACACAGT AGGTGCTCAT

TGGCTCCCTT CCACCTGTCA TTCCCACCAC CCTGAGGCCC CAACCGCCAC ACACACAGGA GCATTTGGAG

AGAAGGCCAT GTCTTCAAAG TCTGATTTGT GATGAGGCAG AGGAAGATAT TTCTAATCGG TCTTGCCCAG
```

```
AGGATCACAG TGCTGAGACC CCCCACCACC AGCCGGTACC TGGGAAGGGG GAGAGTGCAG GCCTGCTCAG
GGACTGTTCC TGTCTCAGCA ACCAAGGGAT TGTTCCTGTC AATCAATGGT TTATTGGAAG GTGGCCCAGT
ATGAGCCCTA GAAGAGTGTG AAAAGGAATG GCAATGGTGT TCACCATCGG CAGTGCCAGG GCAGCACTCA
TTCACTTGAT AAATGAATAT TTATTAGCTG GTTGGAGAGC TAGAACCTGG AGAGCTAGAA CCTGGAGAAC
TAGAACCTGG AGGGCTAGAA CCTGGAGAGG CTAGAACCAA GAAGGGCTAG AACCTGGAGG GGCTAGAACC
TAGAGAAGCT AAAACCTGAG CTAGAAGCTG GAGGACTAGA ACCTGGAGGG CTGGAATCTG AAGGGCTAGA
ACCTGGAGGG CTGGAATCTG GAGAGCTAGA ACCTGGAGGG CTAGAACCTG GAGGGCTAGA ACCTAGAAGG
GCTAGAACCT GGAGGGCTGG AATCTGGAGA GCTAGAACCT GGAGGGCTAG AACCTGGAGG GCTAGAACCT
AGAAGGGCTA GAACCTGGAG GGCTAGAACC TGGCAGGTTA GAACCTAGAA GGGCTAGAAC CTGGAGAGCC
AGAACCTGGA GGGCTAGAAC CTGGAAGGGC TAGAACCTGT AGAGCTAGAA CATGGAGAGC TAGAACCCGG
CAGGCTAGAA CCTGGCAAGC TAGAACCTGG AGGGAATGAA CCTGGAGGGC TAGAACCTGG AGAATGAGAA
AAATTTACAT GGCAAAGAGC CCATAAATCC TGACCAATCC AACTCTGAAT TTTAAAGCAA AGCGTGAAA
AAAAAGATTC CCTCCTTACC CCCAACCCAC TCTTTTTTCC CACCACCCAC TCTCCTCTGC CTCAGTAAGT
ATCTGGAGGA AGAAAACAGG TGAAAGAAGA AGTAAAAACC ATTTAGTATT AGTATTAGAA TGAAGTCAAA
CTGTGCCACA CATGGTGAAT GAAAAAAAAA AAAAAGAGGC TGTGTTTTGT CACACAGGGC AGTCATTCAG
CACCAGAGCA CGTGATGGTC TGAGACTCTC TTAGGAGCAG AGCTCTGCCG CAATGGCCAT GTGGGGATCC
ACACCTGGTC TGAGGGCAA CTGAGTCTGC GGGAGAAGAG CGGCCCTATG CATGGTGTAG ATGCCCTGAT
AAAGAACATC TGTCCTGTGA AAGACTCAAT GAGCTGTTAT GTTGTAAACA GGAAGCATTT CACATCCAAA
CGAGAAAATC ATGTAAACAT GTGTCTTTTC TGTAGAGCAT AATAAATGGA TGAGGTTTTT GCAAAAAAAA
AAAAAAAAAA AAATGATAGA CCGTCAATAA TTTGTTAAAT GCTTTTTAAA ATGAATGCTT TAAGCCGGGT
GCAGTGCCTC ACATCTGTAA TCCCAGCACT TTGGAGCCGA GCGGTGGAT TGTGTGAGGT CAGGAGTTCG
AGACCAACCT GGCCAACATG GCAAAACCTC ACTCTCTACC AAAAATACAA AAATTAGCCA GGCATGGTGG
CAGGCACCTG TGATCCCAGC TACTCAGGAG GCTGAGACAG GAGAATCGCT TGAACCCGGG AGGCAAGGTT
GCAGTGAGCC AAGATTACGC CATTGTACTC CAGCCTGGGT GACAGAGAGA GACTCCGTCT CAAAAAAAAA
AAAAAAAAAA AAAAATTAC GCTTCAAACA CATGATCTCT CACCACTGTT GAATTTCTT TCTATGAGCC
CAGGAGGGCC TCTCAGAGAG GAAAGCTCCT AGGTCTTCCT TTCCCTCTGC AAACTCCCTG CCTTGAAGGT
TCAGAAGGAC TGTGCGTGCT CGTTGCATCC TTTGCAAGTG TCCAAACCCT GATCCCAGCT GTGCTTAGGG
GTTCCTGCAA ACCTTTTCCA GGTGTTAATT ACCTCCCACT TCATTTCCTG TTTACCAACT CAGCTTTTTG
TTTTAGTGTG TTTGAATTCC CTGAACTGAC CGTTGTCTGA TCTCCACCTC CCAACTGAAT TAGGGGAGCT
GGGCTTCTGG AAACCCAGGT GCCGGGTGTT GCAGAGTGGC TGAAAGCTGG GATGTGGCAC ATCCGTGGCT
ACATTCATGC ACACACACAC ACCCACATAC CCACACATGC ACACACACAC ACACACCCGC ACTCACACAC
TTGGACATGC ATAGACCACA GCTTTCCACA CCCTTCCTAG ACAGGGGTCA CTTGGTATCC TGGAGAGAGT
GTGAAGTCCT GGAATGGAAA GAGGGGGGAT TAAGCCCCAC CTCTAGCCAT GGGACTGAGA CAAGTCACCA
CCAACCCATC TGCGCCTTGT TTACCTCCTC TGTGAGGCAA GCACAGAGCC CATGCCTGCC CCCCTGGATG
GGAGTGATGT GAAACTTGAA GGGCGGTCAG AGCAAGGGTC GGGAATGGAA GGCCCTTGGG AAAAAAGGCC
CTTTCAACTA GGGGCACAGA GGAGGCCCTG GGCTGAGAAC TTGACAGCAC CTTGTAATTG GTAAGCCAAG
CCCGAAGGGA CTGGAAATAC TCAGATGTGT CTGTCTCCCT TATTAGGTTC AAAGTCCCTC AAGACCCTGT
CTCCATCACA GTGCTCCAGT CCAGACCCCT CCTCTGAGCT CCAGACCCTG CTGGACCCAA CCAGCCCTAT
GGGGTCGCAT CCCCACCTGC CTGGAATTCT CCAAAGAACC TCCCCTTTAA CAGTTCCAGC CTTTAACAGT
TCCAGTCTAA ACACATGACC TTTCTCCTCT AAATCAGCCC CCCATCTCTG CCTTTGCAGG AGATGGAAGC
```

```
CATGACACCT GCCTCGCCCC TGTCCTCACC CCATCCATGT CCAATCAAGC ACTAGGCATG TCAGGTTTAC

CCTCTAAACT CCTCTGGAAT CCAGTCTCTC AGTCTCCATC ATCCCAGGTC GAAGCTAATG GGCTAACTGG

TCCTTGCTTC CACTCTACCC CCACTGCAGT CCTGACTTCC TGAGCAGCAG CCAGGGCCTA ATCGATATTC

ACACCAAGCG CCAACCTGAC TGAGATATCC TCCTGCACCA TCATCCCTCC ACCCTGTTTA GTTCTGCTCA

CCCTCAGTGT TCTCATCAAT AATCCACTCC CCTCACAGGC GCGTTTGGGA CCCCATGTTC TATGCTCTCA

CAGGACCTTT TGCTTGATTT TTCACTGTAC TTAGGTCAGT TTGCAGTTAT TAAGTGACTG AGCAATGTCT

GGCTTCTCCA GTAGACTGTC AGCTCCTAGC CATTGTATAC CTAGCACCGC TGTGTGGGAG CACGTGACAA

ACGTCCAGTG AGTCAGGGAC TCAGCAGTCT CCATTTCTCC GCCCTGCTGG AGAATGCGTG TATTTGGCAA

TCCCCAGCCC CTGTGCCATC TAACCATCTT TTCTTCTCTG TTCAGCCCAG GTGTGGCCTC ACTCACATCC

CACTCTGAGT CCAAATGTTC TCTCCCTGGA AGATATCAAT GTTTCTGTCT GTTCGTGAGG ACTCCGTGCC

CACCACGGCC TCTTTCAGGT GAGTCAAAGG GATTCCTCAG TTCACTAGTT AGGGGAGGTG GGCAGACACC

CTGGAGAACT CCCTGGAAAG CTCAACTCTC ATGCCCCGGA CAACAGTTGA AGGAACCATG GTGATGTTAA

GCCCAAAGAC AAAACCTCTC AGGTGTCCAA GTCCCTGTTG GAATCTTGGG AGCAGAGGGA ATGTTCTGTG

GTCTAGAGGA AGAGGGGCTC AGGGAGGAGA AGGGCACATT CCTGGTTGTT ATATGTTTCT ATCTATCCCA

GATGAACTTG GAAGTGAAGG GAAGAGAGTT AAACATTAAA GTAAATACCC AGTGGATCAG ACAGCAATGT

GCCAGATTGC CTTGAAAACA AAATATCTCC AACACATGGC TGACATTTGG TGGGAGATCA GAACACCCTA

AAGAGAGAAT TTAAGGGGAG GGGGAGGAGG ACCTGAGCCA GAGTAGAAGC AGAGGATAGG GAGATCTGTT

CTTGGGGACA GCATTTGCAA GAAACAAGGC TGAGGGGTCC ACTCCAACCT CTCCACCCTG CTGCAGGTGC

TGCCTATGAT GAAGATGAGC AGATGGCCAT CTCAGCTGGG GCCACAGTGC ACTGGACCTA TAGTTTCCAA

TTCCGCACTC AGCAGGCATC TTTCTGATGA TCCGATGGCT TCTCAGAGCC AGGGATGGGC CAGGATCCAT

CCCCTTGGCT ACTGTCTTGC TGAGAAATTT ATAAGCAGCA TCTGGTGCTA TACTTTGGTC TCTAGTGAGT

TAGCTCATGA AAGATGATAG ACTCTCCAAG CCAGGGGTAT GCAGGAAATG GGTTTTCTGT AGCTACAGAA

ATGGGGTTGA GGGTTGGACC AAGGGACTAC CCAGGGGAAG TCTTACCTTC AGAGGACTCT GGAAAGGAGG

CTGCAAGTTT TCATGGGTCA AGAATTCAGA GCCCAGTAGA GACAGCTTAT CTCTGTTCCA AGATGTCTGG

GGCCTTGGTT GGAAGATTCA AAGGCTAGGA AACCAGGAGC CACCAAAAGC GTAACTGGGG CCAGAGGATC

CACTTTCAAG GTGGCAAGTT GGTTCCCCCC ATGTGGCTGC TTGAGTATCC TCACATGGCG GCTCACATCC

TTCCAAGTAA GCAATGCAAA AGGCCAAGAA AGATGCTGCA AAGATGTTAT GACCTAGCCT CAGAAATCAC

ACACCATCCC TGCCACCATT AGTAAGAAGT CCAGCCCACG TCCAGGAGAA GAGGAAGCAG ATTCCTCCTT

TTGAAATGAA GAATATCAAG TAATTCGGGG GGCATATGAA AGCCACCACA CACCACAGGG ATCTTTTTAG

AGCATACTTC TTATACCATC ACTGTAGTTC CTTAAGACTC AGGGGCAAAG CCTCACTTCC TTAGCACCCA

GTGAAGACCA CGCTTACTCC CTCACTCAAC CTCTTGCTAC TTCCCACCTC TCCTGTCCAA CATCTAGTGT

CACTTTCCAG AACATACCAA CAGCTTCCCC AGTTCTGTGC CTCTGCTCAG GCTGTTCCCC CTGCCTGGTC

CACTTGTCCT CCTTCTTGTC CGGTCAAAAT GCTTCTTATC CTTCAAGACC CAGCTCTAGA GTCACCTCCA

ACCCCTTACC CACCAGCCCC CTCTCCAAGT CTGTGTCCCA CAACCCCCCT GCTCCCTCCA GGGCACCCTC

CACCCTCTGG GCCACAGTTG TCAGGAGTCA GGCAGGGCAG GGGCCGGGTG GTGTCTTCTT TGTGTTCTTG

CACTCAGGGC AGAGCTCAGC ACAGAGCAGA CGCTCAAAAA ACATTTAAAG GATAGAAGCA TTGATTTGTG

GGTCCCCCAG TCTGGCTCCA GGATGCCAGC CAGCTGCTCC TAGAAGCAAA CGGACTTTTC CTGGGAAATC

CCAGAGGTGA TGATCAGTAA TCTCTCCCGT GACTCGTAGT TCAGCTCTTC CTCCATGAGC CTGACTATCA

GTGGACCTTC CAGAAAGAGC CCCTTTTCCT TCTCTCACCC ACAGCACAGG GCACTGGGAA AATGCCCAAT
```

```
GAGTCCTGCC TCTGGGTTGT GCTTTGGACT TTTCAGTGTG TCTCGCATCC ACTCTTCAAC TTGAATGTTG

CAACAGCCAT GAAAAAAGAA ATGCAAAGCG ATTCAGGATG AGAGCAATAC CCTACTCCAA AGAAGGCAAC

ATAGAAGCTC AGAGAGATCA AGCAATTTGC CCAAGACCAC ACAGCTAGGA GTGGAACTCA TGGCTGTCCA

AGCCCCATGC CTCTGCTGAA GGTAGAGATG AATTACAGCA ACAAGTCTAG AAAGGTGCCT GCCCTATGGT

CTGTGAGTCT TGCCTAAGAA TGAAAGAGGA GCCAGTGGGT TAAAGATGAG GTCACCAACA ACGGTGGTGT

TGGAGTTTAC CACTGATAAT AAGGGTGCAA AATGTAAATT ACTAATGTTT ATTGAGCCTA GTGCAGTGCG

TGGGGCATTT TGCACATTGT CTCTGATCCC TATGACAACC CTGAGAGGTA GTGGTTTTAA CTGCCATGTT

ACAGGTGAGG TCATTGTGGT TCAAGGACGT TAAGTAACTT CCCCAGCGTG ACACGGCTTA TAAGTAAGGC

AGCCAGGATG TGAACCCAGT AGGACTATCT GGCTGCAAAG TCCCCACCCC CCTCGCCATC TGTATCCTCC

AATCACTTCA GTGCTTTGCT GCATAGAAGG TAACGGAAAT CACGATGCCA CAGACTGTCC AGGAAGACAG

AAACTAGGCA GATGGGCTGG CCATGGTCTC CAAGCCAGAC TGGAATCTCC AGGTCTGGAA TGATATCATT

TTTCTCTTTT AATAAATTAA CTCACCCACC ACACGGCTTT GAGAGGCTCA AGTTGACCA ACTCCCTTGG

GAGGGCCCCG GTTGATAAGG AAGGAACGTG AATCCTCCCA TCACGGAAGC TTCAAGGAGG TCAAGGGTCC

AACACTTGAG ATTGTTAGTG CTGTTGGTGG ATACTGGCCA AGGAAATATC CCAGTGGAGC CTCGAGATGA

AGAACATGAG GCCCCCGTTT AGAACCAAGG ATCAGAGGGG GCTCTGTAAG ACCCAGGGGA GTCAGGTGCA

CTGGAGCGCG GGCATGCAGA AAACAGCCTG AGCTCCACCT CGGCTTCTCC TTGTCCTGGC TGGTTGTCCT

TAACCCCTGT CTCCTTCTGG ACCAGTTTTT GTCCTTCCCT TGTGACCGCT GAGGGGTAAC AGCCTCTTTC

CACTTTCTTT CAGCGCCGAC ATGCTCAATG TCACCTTGCA AGGGCCCACT CTTAACGGGA CCTTTGCCCA

GAGCAAATGC CCCCAAGTGG AGTGGCTGGG CTGGCTCAAC ACCATCCAGC CCCCCTTCCT CTGGGTGCTG

TTCGTGCTGG CCACCCTAGA GAACATCTTT GTCCTCAGCG TCTTCTGCCT GCACAAGAGC AGCTGCACGG

TGGCAGAGAT CTACCTGGGG AACCTGGCCG CAGCAGACCT GATCCTGGCC TGCGGGCTGC CCTTCTGGGC

CATCACCATC TCCAACAACT TCGACTGGCT CTTTGGGGAG ACGCTCTGCC GCGTGGTGAA TGCCATTATC

TCCATGAACC TGTACAGCAG CATCTGTTTC CTGATGCTGG TGAGCATCGA CCGCTACCTG GCCCTGGTGA

AAACCATGTC CATGGGCCGG ATGCGCGGCG TGCGCTGGGC CAAGCTCTAC AGCTTGGTGA TCTGGGGGTG

TACGCTGCTC CTGAGCTCAC CCATGCTGGT GTTCCGGACC ATGAAGGAGT ACAGCGATGA GGGCCACAAC

GTCACCGCTT GTGTCATCAG CTACCCATCC CTCATCTGGG AAGTGTTCAC CAACATGCTC CTGAATGTCG

TGGGCTTCCT GCTGCCCCTG AGTGTCATCA CCTTCTGCAC GATGCAGATC ATGCAGGTGC TGCGGAACAA

CGAGATGCAG AAGTTCAAGG AGATCCAGAC GGAGAGGAGG GCCACGGTGC TAGTCCTGGT TGTGCTGCTG

CTATTCATCA TCTGCTGGCT GCCCTTCCAG ATCAGCACCT TCCTGGATAC GCTGCATCGC TCGGCATCC

TCTCCAGCTG CCAGGACGAG CGCATCATCG ATGTAATCAC ACAGATCGCC TCCTTCATGG CCTACAGCAA

CAGCTGCCTC AACCCACTGG TGTACGTGAT CGTGGGCAAG CGCTTCCGAA AGAAGTCTTG GGAGGTGTAC

CAGGGAGTGT GCCAGAAAGG GGGCTGCAGG TCAGAACCCA TTCAGATGGA GAACTCCATG GGCACACTGC

GGACCTCCAT CTCCGTGGAA CGCCAGATTC ACAAACTGCA GGACTGGGCA GGGAGCAGAC AGTGAGCAAA

CGCCAGCAGG GCTGCTGTGA ATTTGTGTAA GGATTGAGGG ACAGTTGCTT TTCAGCATGG GCCCAGGAAT

GCCAAGGAGA CATCTATGCA CGACCTTGGG AAATGAGTTG ATGTCTCCGG TAAAACACCG GAGACTAATT

CCTGCCCTGC CCAATTTTGC AGGGAGCATG GCTGTGAGGA TGGGGTGAAC TCACGCACAG CCAAGGACTC

CAAAATCACA ACAGCATTAC TGTTCTTATT TGCTGCCACA CCTGAGCCAG CCTGCTCCTT CCCAGGAGTG

GAGGAGGCCT GGGGGCAGGG AGAGGAGTGA CTGAGCTTCC CTCCCGTGTG TTCTCCGTCC CTGCCCCAGC

AAGACAACTT AGATCTCCAG GAGAACTGCC ATCCAGCTTT GGTGCAATGG CTGAGTGCAC AAGTGAGTTG

TTGCCCTGGG TTTCTTTAAT CTATTCAGCT AGAACTTTGA AGGACAATTT CTTGCATTAA TAAAGGTTAA
```

```
GCCCTGAGGG GTCCCTGATA ACAACCTGGA GACCAGGATT TTATGGCTCC CCTCACTGAT GGACAAGGAG
GTCTGTGCCA AAGAAGAATC CAATAAGCAC ATATTGAGCA CTTGCTGTAT ATGCAGTATT GAGCACTGTA
GGCAAGAGGG AAGAAAGAGA AGGAGCCATC TCCATCTTGA AGGAACTCAA AGACTCAAGT GGGAACGACT
GGGCACTGCC ACCACCAGAA AGCTGTTCGA TGAGACGGTC GAGCAGGGTG CTGTGGGTGA TATGGACAGC
AGAAGGGGGA GCCAGGTTCC AGCTCACCAA TACTATTGCA CACCACCTGT CCTGCCTC CTGCAGAAAA
CAGCCTGAGC TCCACCTCGG CTTCTCCTTG CCCTGGCTGG TTGTCCTTAA CCCCTGTCTC CTTCTGGACC
AGTTTTTGTC CTTCCCTTGT GACCCTGAGG GGTAACAGCC TCTTTTCCAC TTTCTTTCAG CGCCGACATG
CTCAATGTCA CCTTGCAAGG GCCCACTCTT AACGGGACCT TGCCCAGAG CAAATGCCCC CAAGTGGAGT
GGCTGGGCTG GCTCAACACC ATCCAGCCCC CCTTCCTCTG GGTGCTGTTC GTGCTGGCCA CCCTAGAGAA
CATCTTTGTC CTCAGCGTCT TCTGCCTGCA CAAGAGCAGC TGCACGGTGG CAGAGATCTA CCTGGGGAAC
CTGGCCGCAG CAGACCTGAT CCTGGCCTGC GGGCTGCCCT TCTGGGCCAT CACCATCTCC AACAACTTCG
ACTGGCTCTT TGGGGAGACG CTCTGCCGCG TGGTGAATGC CATTATCTCC ATGAACCTGT ACAGCAGCAT
CTGTTTCCTG ATGCTGGTGA GCATCGACCG CTACCTGGCC CTGGTGAAAA CCATGTCCAT GGGCCGGATG
CGCGGCGTGC GCTGGGCCAA GCTCTACAGC TTGGTGATCT GGGGGTGTAC GCTGCTCCTG AGCTCACCCA
TGCTGGTGTT CCGGACCATG AAGGAGTACA GCGATGAGGG CCACAACGTC ACCGCTTGTG TCATCAGCTA
CCCATCCCTC ATCTGGAAG TGTTCACCAA CATGCTCCTG AATGTCGTGG GCTTCCTGCT GCCCCTGAGT
GTCATCACCT TCTGCACGAT GCAGATCATG CAGGTGCTGC GGAACAACGA GATGCAGAAG TTCAAGGAGA
TCCAGACGGA GAGGAGGGCC ACGGTGCTAG TCCTGGTTGT GCTGCTGCTA TTCATCATCT GCTGGCTGCC
CTTCCAGATC AGCACCTTCC TGGATACGCT GCATCGCCTC GGCATCCTCT CCAGCTGCCA GGACGAGCGC
ATCATCGATG TAATCACACA GATCGCCTCC TTCATGGCCT ACAGCAACAG CTGCCTCAAC CCACTGGTGT
ACGTGATCGT GGGCAAGCGC TTCCGAAAGA AGTCTTGGGA GGTGTACCAG GGAGTGTGCC AGAAAGGGGG
CTGCAGGTCA GAACCCATTC AGATGGAGAA CTCCATGGGC ACACTGCGGA CCTCCATCTC CGTGGAACGC
CAGATTCACA AACTGCAGGA CTGGGCAGGG AGCAGACAGT GAGCAAACGC CAGCAGGGCT GCTGTGAATT
TGTGTAAGGA TTGAGGGACA GTTGCTTTTC AGCATGGGCC CAGGAATGCC AAGGAGACAT CTATGCACGA
CCTTGGGAAA TGAGTTGATG TCTCCGGTAA AACACCGGAG ACTAATTCCT GNCCTGCCCA ATTTTGCAGG
GAGCATGGCT GTGAGGATGG GGTGAACTCA CGCACAGCCA AGGACTCCAA AATCACAACA GCATTACTGT
TCTTATTTGC TGCCACACCT GAGCCAGCCT GCTCCTTCCC AGGAGTGGAG GAGGCCTGGG GGCAGGGAGA
GGAGTGACTG AGCTTCCCTC CCGTGTGTTC TCCGTCCCTG CCCCAGCAAG ACAACTTAGA TCTCCAGGAG
AACTGCCATC CAGCTTTGGT GCAATGGCTG AGTGCACAAG TGAGTTGTTG CCCTGGGTTT CTTTAATCTA
TTCAGCTAGA ACTTTGAAGG ACAATTTCTT GCATTAATAA AGGTTAAGCC CTGAGGGGTC CCTGATAACA
ACCTGGAGAC CAGGATTTTA TGGCTCCCCT CACTGATGGA CAAGGGAGGT CTGTGCCAAA GAAGAATCCA
ATAAGCACAT ATTGAGCACT TGCTGTATAT GCAGTATTGA GCACTGTAGG CAAGAGGGAA AAAGAGAAG
GAGCCATCTC CATCTTGAAG GAACTCAAAG ACTCAAGTGG GAACGACTGG CACTGCCACC ACCAGAAAGC
TGTTCGACGA GACGGTCGAG CAGGGTGCTG TGGGTGATAT GGACAGCAGA AGGGGAGAC CAAGGTTCCA
GCTCAACCAA TAACTATTGC ACAACCACCT GTCCCTGCCT CAGTTCCCTC TTCTGTAACA TGAAGTCGTT
GTGAGGGTTA AAGGCAGTAA CAGGTATAAA GTACTTAGAA AAGCAAAGGG TGCTACGTAC ATGTGAGGCA
TCATTACGCA GACGTAACTG GGATATGTTT ACTATAAGGA AAAGACACTG AGGTCTAGA TGATCCTATC
ACAACCTGAG AGTAGTTTTT ACTCCATTTA CAGGTGAGGT CATTGTGGTT CAAGGACGTT AAGTAACTTC
CCCAGCTCAC ACGGCTTATA AGTAAGGCAG CCAGGATGTG AACCCAGTAG GACTATCTGG CTGCAAAGTC
```

```
CCCACCCTCC CTCGCCATCT GTATCCTCCA ATCATCTTCA GTGCTTTGCT GATAGAAGGT ACGGAAATAC
GATGCCACAG ACTGTCCAGG AAGACAGAAA CTAGGCAGAT GGGCTGGCCA TGGTCTCCAA GCCAGACTGG
AATCTCCAGG TCTGGAATGA TATCATTTTT CTCTTTTAAT AAATTAACTC ACCCACCACA CGGCTTTGAG
AGGCTCAAAG GTGACCAACT CCCTTGGGAG GGCCCCGGTT GATAAGGAAG GAATGTGAAT CCTCCCATCA
CGGAAGCTTC AAGGAGGTCA AGGGTCCAAC ACTTGAGATT GTTAGTGCTG TTGGTGGATA CTGCAGAATA
TCCAGTGGAG CCTCAGATGA AGAACATGAG GCCCCGTTTA GATCCAAGGA TCAGAGGGGG CTCTGTAAGA
CCCAGGGGAG TCAGGTGCAC TGGAGCGCGG GCTGCAGAAA ACAGCCTGAG CTCCACCTCG GCTTCTCCTT
GCCCTGGCTG GTTGTCCTTA ACCCCTGTCT CCTTCTGGAC CAGTTTTTGT CCTTCCCTTG TGACCTGAGG
GGTAACAGCC TCTTTTCCAC TTTCTTTCAG CGCCGACATG CTCAATGTCA CCTTGCAAGG GCCCACTCTT
AACGGGACCT TTGCCCAGAG CAAATGCCCC CAAGTGGAGT GGCTGGGCTG GCTCAACACC ATCCAGCCCC
CCTTCCTCTG GGTGCTGTTC GTGCTGGCCA CCCTAGAGAA CATCTTTGTC CTCAGCGTCT TCTGCCTGCA
CAAGAGCAGC TGCACGGTGG CAGAGATCTA CCTGGGGAAC CTGGCCGCAG CAGACCTGAT CCTGGCCTGC
GGGCTGCCCT TCTGGGCCAT CACCATCTCC AACAACTTCG ACTGGCTCTT TGGGGAGACG CTCTGCCGCG
TGGTGAATGC CATTATCTCC ATGAACCTGT ACAGCAGCAT CTGTTTCCTG ATGCTGGTGA GCATCGACCG
CTACCTGGCC CTGGTGAAAA CCATGTCCAT GGGCCGGATG CGCGGCGTGC GCTGGGCCAA GCTCTACAGC
TTGGTGATCT GGGGGTGTAC GCTGCTCCTG AGCTCACCCA TGCTGGTGTT CCGGACCATG AAGGAGTACA
GCGATGAGGG CCACAACGTC ACCGCTTGTG TCATCAGCTA CCCATCCCTC ATCTGGGAAG TGTTCACCAA
CATGCTCCTG AATGTCGTGG GCTTCCTGCT GCCCCTGAGT GTCATCACCT TCTGCACGAT GCAGATCATG
CAGGTGCTGC GGAACAACGA GATGCAGAAG TTCAAGGAGA TCCAGACGGA GAGGAGGGCC ACGGTGCTAG
TCCTGGTTGT GCTGCTGCTA TTCATCATCT GCTGGCTGCC CTTCCAGATC AGCACCTTCC TGGATACGCT
GCATCGCCTC GGCATCCTCT CCAGCTGCCA GGACGAGCGC ATCATCGATG TAATCACACA GATCGCCTCC
TTCATGGCCT ACAGCAACAG CTGCCTCAAC CCACTGGTGT ACGTGATCGT GGGCAAGCGC TTCCGAAAGA
AGTCTTGGGA GGTGTACCAG GGAGTGTGCC AGAAAGGGGG CTGCAGGTCA GAACCCATTC AGATGGAGAA
CTCCATGGGC ACACTGCGGA CCTCCATCTC CGTGGAACGC CAGATTCACA AACTGCAGGA CTGGGCAGGG
AGCAGACAGT GAGCAAACGC CAGCAGGGCT GCTGTGAATT TGTGTAAGGA TTGAGGGACA GTTGCTTTTC
AGCATGGGCC CAGGAATGCC AAGGAGACAT CTATGCACGA CCTTGGGAAA TGAGTGTTGA TGTCTCCGGT
AAAACACCGG AGACTAATTC CTGCCCTGCC CAATTTTCGA GGGAGCATGG CTGTGAGGAT GGGGTGAACT
CACGCACAGC CAAGGACTCC AAAATCACAA CAGCATTACT GTTCTTATTT GCTGCCACAC CTGAGCCAGC
CTGCTCCTTC CCAGGAGTGG AGGAGGCCTG GGGGAGGGAG AGGAGTGACT GAGCTTCCCT CCCGTGTGTT
CTCCGTCCCT GCCCCAGCAA GACAACTTAG ATCTCCAGGA GAACTGCCAT CCACGTTTGG TGCAATGGCT
GAGTGCACAA GTGAGTTGTT GCCCTGGGTT TCTTTAATCT ATCAGCTAGA ACTTTGAAGG ACAATTTCTT
GCATTAATAA AGGTTAAGCC CTGAGGGGTC CCTTGATAAC AACCTGGAGA CCAGGATTTT ATGGCTCCCC
TCACTGATGG ACAAGGAGGT CTGTGCCAAA GAAGAATCAA TAAGCACATA TGAGCACTTC TGTATATCAG
TATTGAGCAC TGTAGGCA ATGTTCTCTC CCTGGAAGAT ATCAATGTTT CTGTCTGTTT GTGAGGACTC
CGTGCCCACC ACGGCCTCTT TCAGCGCCGA CATGCTCAAT GTCACCTTGC AAGGGCCCAC TCTTAACGGG
ACCTTTGCCC AGAGCAAATG CCCCCAAGTG GAGTGGCTGG GCTGGCTCAA CACCATCCAG CCCCCCTTCC
TCTGGGTGCT GTTCGTGCTG GCCACCCTAG AGAACATCTT TGTCCTCAGC GTCTTCTGCC TGCACAAGAG
CAGCTGCACG GTGGCAGAGA TCTACCTGGG GAACCTGGCC GCAGCAGACC TGATCCTGGC CTGCGGGCTG
CCCTTCTGGG CCATCACCAT CTCCAACAAC TTCGACTGGC TCTTTGGGGA CGCTCTGCGC GCGTGGTGA
ATGCCATTAT CTCCATGAAC CTGTACAGCA GCATCTGTTT CCTGATGCTG GTGAGCATCG ACCGCTACCT
```

```
GGCCCTGGTG AAAACCATGT CCATGGGCCG GATGCGCGGC GTGCGCTGGG CCAAGCTCTA CAGCTTGGTG
ATCTGGGGGT GTACGCTGCT CCTGAGCTCA CCCATGCTGG TGTTCCGGAC CATGAAGGAG TACAGCGATG
AGGGCCACAA CGTCACCGCT TGTGTCATCA GCTACCCATC CCTCATCTGG GAAGTGTTCA CCAACATGCT
CCTGAATGTC GTGGGCTTCC TGCTGCCCCT GAGTGTCATC ACCTTCTGCA CGATGCAGAT CATGCAGGTG
CTGCGGAACA ACGAGATGCA GAAGTTCAAG GAGATCCAGA CGGAGAGGAG GGCCACGGTG CTAGTCCTGG
TTGTGCTGCT GCTATTCATC ATCTGCTGGC TGCCCTTCCA GATCAGCACC TTCCTGGATA CGCTGCATCG
CCTCGGCATC CTCTCCAGCT GCCAGGACGA GCGCATCATC GATGTAATCA CACAGATCGC CTCCTTCATG
GCCTACAGCA ACAGCTGCCT CAACCCACTG GTGTACGTGA TCGTGGGCAA GCGCTTCCGA AAGAAGTCTT
GGGAGGTGTA CCAGGGAGTG TGCCAGAAAG GGGGCTGCAG GTCAGAACCC ATTCAGATGG AGAACTCCAT
GGGCACACTG CGGACCTCCA TCTCCGTGGA ACGCCAGATT CACAAACTGC AGGACTGGGC AGGGAGCAGA
CAGTGAGCAA ACGCCAGCAG GGCTGCTGTG AATTTGTGTA AGGATTGAGG GACAGTTGCT T ATGTTCTCTC
CCTGGAAGAT ATCAATGTTT CTGTCTGTTC GTGAGGACTC CGTGCCCACC ACGGCCTCTT TCAGCGCCGA
CATGCTCAAT GTCACCTTGC AAGGGCCCAC TCTTAACGGG ACCTTTGCCC AGAGCAAATG CCCCCAAGTG
GAGTGGCTGG GCTGGCTCAA CACCATCCAG CCCCCCTTCC TCTGGGTGCT GTTCGTGCTG GCCACCCTAG
AGAACATCTT TGTCCTCAGC GTCTTCTGCC TGCACAAGAG CAGCTGCACG GTGGCAGAGA TCTACCTGGG
GAACCTGGCC GCAGCAGACC TGATCCTGGC CTGCGGGCTG CCCTTCTGGG CCATCACCAT CTCCAACAAC
TTCGACTGGC TCTTTGGGGA GACGCTCTGC CGCGTGGTGA ATGCCATTAT CTCCATGAAC CTGTACAGCA
GCATCTGTTT CCTGATGCTG GTGAGCATCG ACCGCTACCT GGCCCTGGTG AAAACCATGT CCATGGGCCG
GATGCGCGGC GTGCGCTGGG CCAAGCTCTA CAGCTTGGTG ATCTGGGGGT GTACGCTGCT CCTGAGCTCA
CCCATGCTGG TGTTCCGGAC CATGAAGGAG TACAGCGATG AGGGCCACAA CGTCACCGCT TGTGTCATCA
GCTACCCATC CCTCATCTGG GAAGTGTTCA CCAACATGCT CCTGAATGTC GTGGGCTTCC TGCTGCCCCT
GAGTGTCATC ACCTTCTGCA CGATGCAGAT CATGCAGGTG CTGCGGAACA ACGAGATGCA GAAGTTCAAG
GAGATCCAGA CGGAGAGGAG GGCCACGGTG CTAGTCCTGG TTGTGCTGCT GCTATTCATC ATCTGCTGGC
TGCCCTTCCA GATCAGCACC TTCCTGGATA CGCTGCATCG CCTCGGCATC CTCTCCAGCT GCCAGGACGA
GCGCATCATC GATGTAATCA CACAGATCGC CTCCTTCATG GCCTACAGCA ACAGCTGCCT CAACCCACTG
GTGTACGTGA TCGTGGGCAA GCGCTTCCGA AAGAAGTCTT GGGAGGTGTA CCAGGGAGTG TGCCAGAAAG
GGGGCTGCAG GTCAGAACCC ATTCAGATGG AGAACTCCAT GGGCACACTG CGGACCTCCA TCTCCGTGGA
ACGCCAGATT CACAAACTGC AGGACTGGGC AGGGAGCAGA CAGTGAGCAA ACGCCAGCAG GGCTGCTGTG
AATTTGTGTA AGGATTGAGG GACAGTTGCT T GCCCTTCAAA GATGAGCTGT TCCCGCCGCC ACTCCAGCTC
TGGCTTCTGG GCTCCGAGGA GGGGTGGGGA CGGTGGGGAC ATCAGGCTGC CCGCAGTAC CAGGGAGCGA
CTGAAGTGCC CATGCCGCTT GCTCCGGAGA AGGTGGGTGC CGGGCAGGGG CTGCTCCAGC CGCCTCACCT
CTGCTGGGAG ACAAACTGT CCCAGCACAG AGGGAGGGAG GAGGGCAGGC AGCGGGGAG AAGTTTCCCT
GTGGTCGTGG GGAGTT GCCCTTCAAA GATGAGCTGT TCCCGCCGCC ACTCCAGCTC TGGCTTCTGG
GCTCCGAGGA GGGGTGGGGA CGGTGGTGAC GGTGGGGACA TCAGGCTGCC CCGCAGTACC AGGGAGCGAC
TGAAGTGCCC ATGCCGCTTG CTCCGGAGAA GGTGGGTGCC GGGCAGGGGC TGCTCCAGCC GCCTCACCTC
TGCTGGGAGG ACAAACTGTC CCAGCACAGA GGGAGGGAGG GAGGGCAGGC AGCGGGGAGA AGTTTCCCTG
TGGTCGTGGG GAGTT GAGCTCTTCA ATATTTTAGT GAAAGCTATA GATGAGGCTC CATAGGGGAT AAAGCACAGA
CACACCTTTT CAGAGGGCTT GTGGACTCTG GGCAGCCTGT CCATAGACCT CTGTCCCCAA CTGGCAAGTC
AGGAAACTCC AGATTAAGGA GCCCCAATGT GGTTGAACAG CCAGGTGCAC AGATGAGTCA ACCACACAGC
```

```
CAGGCCAGGG AGGGCCTTCA CTCAAGAGCC TACAGCCAGT TCACAGCCAA GCCAGGGCTA GCGCCAGGCC
ACCCATAAAC TGATCTGAGA CTCTGTTTCC CTGTCTCCAT GATGATGGGA TCAGGCTTGA TTGCTGGTTT
GTAGGCTTGT TATGAATCAA GTCACAGGGA AGAGGAGCTG ATGGGCTGGG GGACGTCCT CTGGCCCTCC
TGTCTCTTCC CCAGATCCAC TGGGCCCACT CTTATCTGTT CTCTTCTGAA GGAAGGGTTT TAAGGCTTCA
AAAAAAAATG TTTTGAAAGT CCCTGCCCTT TCCAGCTCCT ACCGTCTCAG CCCTGGGAGT GTAAAGTGCT
GCAGATAGTT AGTAAGTCTT TGAGCAAAAC TGAGAAAGCC AGCCTGAGCC TTGACATGGG AGAAACCTCC
GCCATACATC TCCGAAGAAA CGGCCGCGTG TCTCAGGGGA GCGCAAACAC CCGTACCCAG GAAACAGGAC
AGCTTCTGCC ACTGTCGCCC TTGGGAGCCG TACGTGGCAT GACAAAGAAA TCCCAGGACT CCGCCTGCCC
ACCTGGCCAC CCTCTGTTTA CACCTTCCGC GTAAACGCCC ACTGTTTACA TCCAAAACTC AGACACAAAA
TAACCACCTC AAGAAGATAA ATAATGATAA GAAATAAATG TTACGCGAGG CAAATTTATT CACATGGGGC
TTCCCAGGCC ACTTTGTGGT CAGCCGGGAG GGACGTTTTT GCCGTCCCAC GACTCCAACG GGCAGCCGGG
CCTACGCAAA CATGGAAATC TTCCAAGAGC CTCCCTGGCC CCCAGGGCTC AGAGGGTGGC AGAGCGGAGA
GCGAAGGTGG CCGCAGCCTT CCCGGCCCCA CAGCCAGCCT GGCTCCAGCT GGGCAGGAGT GCAGAGCTCA
GCTGGAGGCG AGGGGGAAGT GCCCAGGAGG CTGATGACAT CACTACCCAG CCCTTCAAAG ATGAGCTGTT
CCCGCCGCCA CTCCAGCTCT GGCTTCTGGG CTCCGAGGAG GGGTGGGGAC GGTGGTGACG GTGGGGACAT
CAGGCTGCCC CGCAGTACCA GGGAGCGACT GAAGTGCCCA TGCCGCTTGC TCCGAGAAG GTGGGTGCCG
GGCAGGGGCT GCTCCAGCCG CCTCACCTCT GCTGGGAGGA CAAACTGTCC CAGCACAGAG GGAGGGAGGG
AGGGCAGGCA GCGGGGAGAA GTTTCCCTGT GGTCGTGGGG AGTTGGGAAA AGTTCCCTTC CTTCCGGAGG GAGG
CAGATTCACA AACTGCAGGA CTGGGCAGGG AGCAGACAGT GAGCAAACGC CAGCAGGGCT GCTGTGAATT
TGTGTAAGGA TTGAGGGACA GTTGCTTTTC AGCATGGGCC CAGGAATGCC AAGGAGACAT CTATGCACGA
CCTTGGGAAA TGAGTTGATG TCTCCGGTAA ACACCGGAG ACTAATTCCT GCCCTGCCCA ATTTTGCAGG
GAGCATGGCT GTGAGGATGG GGTGAACTCA CGCACAGCCA AGGACTCCAA AATCACAACA GCATTACTGT
TCTTATTTGC TGCCACACCT GAGCCAGCCT GCTCCTTCCC AGGAGTGGAG GAGGCCTGGG GGGAGGGAGA
GGAGTGACTG AGCTTCCCTC CCGTGTGTTC TCCGTCCCTG CCCCAGCAAG ACAACTTAGA TCTCCAGGAG
AACTGCCATC CAGCTTTGGT GCAATGGCTG AGTGCACAAG TGAGTTGTTG CCCTGGGTTT CTTTAATCTA
TTCAGCTAGA ACTTTGAAGG ACAATTTCTT GCATTAATAA AGGTTAAGCC CTGAGGGGTC CCTGATAACA
ACCTGGAGAC CAGGATTTTA TGGCTCCCCT CACTGATGGA CAAGGAGGTC TGTGCCAAAG AAGAATCCAA
TAAGCACATA TTGAGCACTT GCTGTATATG CAGTATTGAG CACTGTAGGC AAGACCCAAG AAAGAGAAGG
AGCCATCTCC ATCTTGAAGG AACTCAAAGA CTCAAGTGGG AACGACTGGG CACTGCCACC ACCAGAAAGC
TGTTCGACGA GACGGTCGAG CAGGGTGCTG TGGGTGATAT GGACAGCAGA AGGGGGAGAC CAAGGTTCCA
GCTCAACCAA TAACTATTGC ACAACCACCT GTCCCTGCCT CAGTTCCCTT TTATGTAACA TGAAGTCGTT
GTGAGGGTTA AAGGCAGTAA CAGGTATAAA GTACTTAGAA AAGCAAAGGG TGCTACGTAC ATGTGAGGCA
TCATTACGCA GACGTAACTG GGATATGTTT ACTATAAGGA AAAGACACTG AGGTCTAGAA ATAGCTCCGT
GGAGCAGAAT CAGTATTGGG AGCCGGTGGC GGTGTGAAGC ACCAGTGTCT GGCACACAGT AGGTGCTCAT
TGGCTCCCTT CCACCTGTCA TTCCCACCAC CCTGAGGCCC CAACCGCCAC ACACACAGGA GCATTTGGAG
AGAAGGCCAT GTCTTCAAAG TCTGATTTGT GATGAGGCAG AGGAAGATAT TTCTAATCGG TCTTGCCCAG
AGGATCACAG TGCTGAGACC CCCCACCACC AGCCGGTACC TGGGAAGGGG GAGAGTGCAG GCCTGCTCAG
GGACTGTTCC TGTCTCAGCA ACCAAGGGAT TGTTCCTGTC AATCAATGGT TTATTGGAAG GTGGCCCAGT
ATGAGCCCTA GAAGAGTGTG AAAAGGAATG GCAATGGTGT TCACCATCGG CAGTGCCAGG GCAGCACTCA
TTCACTTGAT AAATGAATAT TTATTAGCTG GTTGGAGAGC TAGAACCTGG AGAGCTAGAA CCTGGAGAAC
```

-continued

```
TAGAACCTGG AGGGCTAGAA CCTGGAGAGG CTAGAACCAA GAAGGGCTAG AACCTGGAGG GGCTAGAACC
TAGAGAAGCT AAAACCTGAG CTAGAAGCTG GAGGACTAGA ACCTGGAGGG CTGGAATCTG AAGGGCTAGA
ACCTGGAGGG CTGGAATCTG GAGAGCTAGA ACCTGGAGGG CTAGAACCTG GAGGGCTAGA ACCTAGAAGG
GCTAGAACCT GGAGGGCTGG AATCTGGAGA GCTAGAACCT GGAGGGCTAG AACCTGGAGG GCTAGAACCT
AGAAGGGCTA GAACCTGGAG GGCTAGAACC TGGCAGGTTA GAACCTAGAA GGGCTAGAAC CTGGAGAGCC
AGAACCTGGA GGGCTAGAAC CTGGAAGGGC TAGAACCTGT AGAGCTAGAA CATGGAGAGC TAGAACCCGG
CAGGCTAGAA CCTGGCAAGC TAGAACCTGG AGGGAATGAA CCTGGAGGGC TAGAACCTGG AGAATGAGAA
AAATTTACAT GGCAAAGAGC CCATAAATCC TGACCAATCC AACTCTGAAT TTTAAAGCAA AAGCGTGAAA
AAAAAGATTC CCTCCTTACC CCCAACCCAC TCTTTTTTCC CACCACCCAC TCTCCTCTGC CTCAGTAAGT
ATCTGGAGGA AGAAAACAGG TGAAAGAAGA AGTAAAAACC ATTTAGTATT AGTATTAGAA TGAAGTCAAA
CTGTGCCACA CATGGTGAAT GAAAAAAAAA AAAAAGAGGC TGTGTTTTGT CACACAGGGC AGTCATTCAG
CACCAGAGCA CGTGATGGTC TGAGACTCTC TTAGGAGCAG AGCTCTGCCG CAATGGCCAT GTGGGGATCC
ACACCTGGTC TGAGGGGCAA CTGAGTCTGC GGGAGAAGAG CGGCCCTATG CATGGTGTAG ATGCCCTGAT
AAAGAACATC TGTCCTGTGA AAGACTCAAT GAGCTGTTAT GTTGTAAACA GGAAGCATTT CACATCCAAA
CGAGAAAATC ATGTAAACAT GTGTCTTTTC TGTAGAGCAT AATAAATGGA TGAGGTTTTT GCAAAAAAAA
AAAAAAAAA AAATGATAGA CCGTCAATAA TTTGTTAAAT GCTTTTTAAA ATGAATGCTT TAAGCCGGGT
GCAGTGCCTC ACATCTGTAA TCCCAGCACT TTGGAGCCGA GCGGGTGGAT TGTGTGAGGT CAGGAGTTCG
AGACCAACCT GGCCAACATG GCAAAACCTC ACTCTCTACC AAAAATACAA AAATTAGCCA GGCATGGTGG
CAGGCACCTG TGATCCCAGC TACTCAGGAG GCTGAGACAG GAGAATCGCT TGAACCCGGG AGGCAAGGTT
GCAGTGAGCC AAGATTACGC CATTGTACTC CAGCCTGGGT GACAGAGAGA GACTCCGTCT CAAAAAAAAA
AAAAAAAAAA AAAAATTAC GCTTCAAACA CATGATCTCT CACCACTGTT GAATTTTCTT TCTATGAGCC
CAGGAGGGCC TCTCAGAGAG GAAAGCTCCT AGGTCTTCCT TTCCCTCTGC AAACTCCCTG CCTTGAAGGT
TCAGAAGGAC TGTGCGTGCT CGTTGCATCC TTTGCAAGTG TCCAAACCCT GATCCCAGCT GTGCTTAGGG
GTTCCTGCAA ACCTTTTCCA GGTGTTAATT ACCTCCCACT TCATTTCCTG TTTACCAACT CAGCTTTTTG
TTTTAGTGTG TTTGAATTCC CTGAACTGAC CGTTGTCTGA TCTCCACCTC CCAACTGAAT TAGGGGAGCT
GGGCTTCTGG AAACCCAGGT GCCGGGTGTT GCAGAGTGGC TGAAAGCTGG GATGTGGCAG ATCCGTGGCT
ACATTCATGC ACACACACAC ACCCACATAC CCACACATGC ACACACACAC ACACACCCGC ACTCACACAC
TTGGACATGC ATAGACCACA GCTTTCCACA CCCTTCCTAG ACAGGGGTCA CTTGGTATCC TGGAGAGAGT
GTGAAGTCCT GGAATGGAAA GAGGGGGGAT TAAGCCCCAC CTCTAGCCAT GGGACTGAGA CAAGTCACCA
CCAACCCATC TGCGCCTTGT TTACCTCCTC TGTGAGGCAA GCACAGAGCC CATGCCTGCC CCCCTGGATG
GGAGTGATGT GAAACTTGAA GGGCGGTCAG AGCAAGGGTC GGGAATGGAA GGCCCTTGGG AAAAAGGCC
CTTTCAACTA GGGGCACAGA GGAGGCCCTG GGCTGAGAAC TTGACAGCAC CTTGTAATTG GTAAGCCAAG
CCCGAAGGGA CTGGAAATAC TCAGATGTGT CTGTCTCCCT TATTAGGTTC AAAGTCCCTC AAGACCCTGT
CTCCATCACA GTGCTCCAGT CCAGACCCCT CCTCTGAGCT CCAGACCCTG CTGGACCCAA CCAGCCCTAT
GGGGTCGCAT CCCCACCTGC CTGGAATTCT CCAAAGAACC TCCCCTTTAA CAGTTCCAGC CTTTAACAGT
TCCAGTCTAA ACACATGACC TTTCTCCTCT AAATCAGCCC CCCATCTCTG CCTTTGCAGG AGATGGAAGC
CATGACACCT GCCTCGCCCC TGTCCTCACC CCATCCATGT CCAATCAAGC ACTAGGCATG TCAGGTTTAC
CCTCTAAACT CCTCTGGAAT CCAGTCTCTC AGTCTCCATC ATCCCAGGTC GAAGCTAATG GGCTAACTGG
TCCTTGCTTC CACTCTACCC CCACTGCAGT CCTGACTTCC TGAGCAGCAG CCAGGGCCTA ATCGATATTC
```

```
ACACCAAGCG CCAACCTGAC TGAGATATCC TCCTGCACCA TCATCCCTCC ACCCTGTTTA GTTCTGCTCA
CCCTCAGTGT TCTCATCAAT AATCCACTCC CCTCACAGGC GCGTTTGGGA CCCCATGTTC TATGCTCTCA
CAGGACCTTT TGCTTGATTT TTCACTGTAC TTAGGTCAGT TTGCAGTTAT TAAGTGACTG AGCAATGTCT
GGCTTCTCCA GTAGACTGTC AGCTCCTAGC CATTGTATAC CTAGCACCGC TGTGTGGGAG CACGTGACAA
ACGTCCAGTG AGTCAGGGAC TCAGCAGTCT CCATTTCTCC GCCCTGCTGG AGAATGCGTG TATTTGGCAA
TCCCCAGCCC CTGTGCCATC TAACCATCTT TTCTTCTCTG TTCAGCCCAG GTGTGGCCTC ACTCACATCC
CACTCTGAGT CCAAATGTTC TCTCCCTGGA AGATATCAAT GTTTCTGTCT GTTCGTGAGG ACTCCGTGCC
CACCACGGCC TCTTTCAGGT GAGTCAAAGG GATTCCTCAG TTCACTAGTT AGGGGAGGTG GGCAGACACC
CTGGAGAACT CCCTGGAAAG CTCAACTCTC ATGCCCCGGA CAACAGTTGA AGGAACCATG GTGATGTTAA
GCCCAAAGAC AAAACCTCTC AGGTGTCCAA GTCCCTGTTG GAATCTTGGG AGCAGAGGGA ATGTTCTGTG
GTCTAGAGGA AGAGGGGCTC AGGGAGGAGA AGGGCACATT CCTGGTTGTT ATATGTTTCT ATCTATCCCA
GATGAACTTG GAAGTGAAGG GAAGAGAGTT AAACATTAAA GTAAATACCC AGTGGATCAG ACAGCAATGT
GCCAGATTGC CTTGGAAACA AAATATCTCC AACACATGGC TGACATTTGG TGGGAGATCA GAACACCCTA
AAGAGAGAAT TTAAGGGGAG GGGGAGGAGG ACCTGAGCCA GAGTAGAAGC AGAGGATAGG GAGATCTGTT
CTTGGGGACA GCATTTGCAA GAAACAAGGC TGAGGGGTCC ACTCCAACCT CTCCACCCTG CTGCAGGTGC
TGCCTATGAT GAAGATGAGC AGATGGCCAT CTCAGCTGGG GCCACAGTGC ACTGGACCTA TAGTTTCCAA
TTCCGCACTC AGCAGGCATC TTTCTGATGA TCCGATGGCT TCTCAGAGCC AGGGATGGGC CAGGATCCAT
CCCCTTGGCT ACTGTCTTGC TGAGAAATTT ATAAGCAGCA TCTGGTGCTA TACTTTGGTC TCTAGTGAGT
TAGCTCATGA AAGATGATAG ACTCTCCAAG CCAGGGGTAT GCAGGAAATG GGTTTTCTGT AGCTACAGAA
ATGGGGTTGA GGGTTGGACC AAGGGACTAC CCAGGGGAAG TCTTACCTTC AGAGGACTCT GGAAAGGAGG
CTGCAAGTTT TCATGGGTCA AGAATTCAGA GCCCAGTAGA GACAGCTTAT CTCTGTTCCA AGATGTCTGG
GGCCTTGGTT GGAAGATTCA AAGGCTAGGA AACCAGGAGC CACCAAAAGC GTAACTGGGG CCAGAGGATC
CACTTTCAAG GTGGCAAGTT GGTTCCCCCC ATGTGGCTGC TTGAGTATCC TCACATGGCG GCTCACATCC
TTCCAAGTAA GCAATGCAAA AGGCCAAGAA AGATGCTGCA AAGATGTTAT GACCTAGCCT CAGAAATCAC
ACACCATCCC TGCCACCATT AGTAAGAAGT CCAGCCCACG TCCAGGAGAA GAGGAAGCAG ATTCCTCCTT
TTGAAATGAA GAATATCAAG TAATTCGGGG GGCATATGAA AGCCACCACA CACCACAGGG ATCTTTTTAG
AGCATACTTC TTATACCATC ACTGTAGTTC CTTAAGACTC AGGGCAAAG CCTCACTTCC TTAGCACCCA
GTGAAGACCA CGCTTACTCC CTCACTCAAC CTCTTGCTAC TTCCCACCTC TCCTGTCCAA CATCTAGTGT
CACTTTCCAG AACATACCAA CAGCTTCCCC AGTTCTGTGC CTCTGCTCAG GCTGTTCCCC CTGCCTGGTC
CACTTGTCCT CCTTCTTGTC CGGTCAAAAT GCTTCTTATC CTTCAAGACC CAGCTCTAGA GTCACCTCCA
ACCCCTTACC CACCAGCCCC CTCTCCAAGT CTGTGTCCCA CAACCCCCCT GCTCCCTCCA GGGCACCCTC
CACCCTCTGG GCCACAGTTG TCAGGAGTCA GGCAGGGCAG GGGCCGGGTG GTGTCTTCTT TGTGTTCTTG
CACTCAGGGC AGAGCTCAGC ACAGAGCAGA CGCTCAAAAA ACATTTAAAG GATAGAAGCA TTGATTTGTG
GGTCCCCCAG TCTGGCTCCA GGATGCCAGC CAGCTGCTCC TAGAAGCAAA CGGACTTTTC CTGGGAAATC
CCAGAGGTGA TGATCAGTAA TCTCTCCCGT GACTCGTAGT TCAGCTCTTC CTCCATGAGC CTGACTATCA
GTGGACCTTC CAGAAAGAGC CCCTTTTCCT TCTCTCACCC ACAGCACAGG GCACTGGGAA AATGCCCAAT
GAGTCCTGCC TCTGGGTTGT GCTTTGGACT TTTCAGTGTG TCTCGCATCC ACTCTTCAAC TTGAATGTTG
CAACAGCCAT GAAAAAGAA ATGCAAAGCG ATTCAGGATG AGAGCAATAC CCTACTCCAA AGAAGGCAAC
ATAGAAGCTC AGAGAGATCA AGCAATTTGC CCAAGACCAC ACAGCTAGGA GTGGAACTCA TGGCTGTCCA
AGCCCCATGC CTCTGCTGAA GGTAGAGATG AATTACAGCA ACAAGTCTAG AAAGGTGCCT GCCCTATGGT
```

```
CTGTGAGTCT TGCCTAAGAA TGAAAGAGGA GCCAGTGGGT TAAAGATGAG GTCACCAACA ACGGTGGTGT
TGGAGTTTAC CACTGATAAT AAGGGTGCAA AATGTAAATT ACTAATGTTT ATTGAGCCTA GTGCAGTGCG
TGGGGCATTT TGCACATTGT CTCTGATCCC TATGACAACC CTGAGAGGTA GTGGTTTTAA CTGCCATGTT
ACAGGTGAGG TCATTGTGGT TCAAGGACGT TAAGTAACTT CCCCAGCGTG ACACGGCTTA TAAGTAAGGC
AGCCAGGATG TGAACCCAGT AGGACTATCT GGCTGCAAAG TCCCCACCCC CCTCGCCATC TGTATCCTCC
AATCACTTCA GTGCTTTGCT GCATAGAAGG TAACGAAAT CACGATGCCA CAGACTGTCC AGGAAGACAG
AAACTAGGCA GATGGGCTGG CCATGGTCTC CAAGCCAGAC TGGAATCTCC AGGTCTGGAA TGATATCATT
TTTCTCTTTT AATAAATTAA CTCACCCACC ACACGGCTTT GAGAGGCTCA AGTTGACCA ACTCCCTTGG
GAGGGCCCCG GTTGATAAGG AAGGAACGTG AATCCTCCCA TCACGGAAGC TTCAAGGAGG TCAAGGGTCC
AACACTTGAG ATTGTTAGTG CTGTTGGTGG ATACTGGCCA AGGAAATATC CCAGTGGAGC CTCGAGATGA
AGAACATGAG GCCCCCGTTT AGAACCAAGG ATCAGAGGGG GCTCTGTAAG ACCCAGGGGA GTCAGGTGCA
CTGGAGCGCG GGCATGCAGA AAACAGCCTG AGCTCCACCT CGGCTTCTCC TTGTCCTGGC TGGTTGTCCT
TAACCCCTGT CTCCTTCTGG ACCAGTTTTT GTCCTTCCCT TGTGACCGCT GAGGGGTAAC AGCCTCTTTC
CACTTTCTTT CAGCGCCGAC ATGCTCAATG TCACCTTGCA AGGGCCCACT CTTAACGGGA CCTTTGCCCA
GAGCAAATGC CCCCAAGTGG AGTGGCTGGG CTGGCTCAAC ACCATCCAGC CCCCTTCCT CTGGGTGCTG
TTCGTGCTGG CCACCCTAGA GAACATCTTT GTCCTCAGCG TCTTCTGCCT GCACAAGAGC AGCTGCACGG
TGGCAGAGAT CTACCTGGGG AACCTGGCCG CAGCAGACCT GATCCTGGCC TGCGGGCTGC CCTTCTGGGC
CATCACCATC TCCAACAACT TCGACTGGCT CTTTGGGGAG ACGCTCTGCC GCGTGGTGAA TGCCATTATC
TCCATGAACC TGTACAGCAG CATCTGTTTC CTGATGCTGG TGAGCATCGA CCGCTACCTG GCCCTGGTGA
AAACCATGTC CATGGGCCGG ATGCGCGGCG TGCGCTGGGC CAAGCTCTAC AGCTTGGTGA TCTGGGGGTG
TACGCTGCTC CTGAGCTCAC CCATGCTGGT GTTCCGGACC ATGAAGGAGT ACAGCGATGA GGGCCACAAC
GTCACCGCTT GTGTCATCAG CTACCCATCC CTCATCTGGG AAGTGTTCAC CAACATGCTC CTGAATGTCG
TGGGCTTCCT GCTGCCCCTG AGTGTCATCA CCTTCTGCAC GATGCAGATC ATGCAGGTGC TGCGGAACAA
CGAGATGCAG AAGTTCAAGG AGATCCAGAC GGAGAGGAGG GCCACGGTGC TAGTCCTGGT TGTGCTGCTG
CTATTCATCA TCTGCTGGCT GCCCTTCCAG ATCAGCACCT TCCTGGATAC GCTGCATCGC CTCGGCATCC
TCTCCAGCTG CCAGGACGAG CGCATCATCG ATGTAATCAC ACAGATCGCC TCCTTCATGG CCTACAGCAA
CAGCTGCCTC AACCCACTGG TGTACGTGAT CGTGGGCAAG CGCTTCCGAA AGAAGTCTTG GGAGGTGTAC
CAGGGAGTGT GCCAGAAAGG GGGCTGCAGG TCAGAACCCA TTCAGATGGA GAACTCCATG GGCACACTGC
GGACCTCCAT CTCCGTGGAA CGCCAGATTC ACAAACTGCA GGACTGGGCA GGGAGCAGAC AGTGAGCAAA
CGCCAGCAGG GCTGCTGTGA ATTTGTGTAA GGATTGAGGG ACAGTTGCTT TTCAGCATGG CCCAGGAAT
GCCAAGGAGA CATCTATGCA CGACCTTGGG AAATGAGTTG ATGTCTCCGG TAAAACACCG GAGACTAATT
CCTGCCCTGC CCAATTTTGC AGGGAGCATG GCTGTGAGGA TGGGGTGAAC TCACGCACAG CCAAGGACTC
CAAAATCACA ACAGCATTAC TGTTCTTATT TGCTGCCACA CCTGAGCCAG CCTGCTCCTT CCCAGGAGTG
GAGGAGGCCT GGGGGCAGGG AGAGGAGTGA CTGAGCTTCC CTCCCGTGTG TTCTCCGTCC CTGCCCCAGC
AAGACAACTT AGATCTCCAG GAGAACTGCC ATCCAGCTTT GGTGCAATGG CTGAGTGCAC AAGTGAGTTG
TTGCCCTGGG TTTCTTTAAT CTATTCAGCT AGAACTTTGA AGGACAATTT CTTGCATTAA TAAAGGTTAA
GCCCTGAGGG GTCCCTGATA ACAACCTGGA GACCAGGATT TTATGGCTCC CCTCACTGAT GGACAAGGAG
GTCTGTGCCA AAGAAGAATC CAATAAGCAC ATATTGAGCA CTTGCTGTAT ATGCAGTATT GAGCACTGTA
GGCAAGAGGG AAGAAAGAGA AGGAGCCATC TCCATCTTGA AGGAACTCAA AGACTCAAGT GGGAACGACT
```

```
GGGCACTGCC ACCACCAGAA AGCTGTTCGA TGAGACGGTC GAGCAGGGTG CTGTGGGTGA TATGGACAGC
AGAAGGGGGA GCCAGGTTCC AGCTCACCAA TACTATTGCA CACCACCTGT CCTGCCTC CTGCAGAAAA
CAGCCTGAGC TCCACCTCGG CTTCTCCTTG CCCTGGCTGG TTGTCCTTAA CCCCTGTCTC CTTCTGGACC
AGTTTTTGTC CTTCCCTTGT GACCCTGAGG GGTAACAGCC TCTTTTCCAC TTTCTTTCAG CGCCGACATG
CTCAATGTCA CCTTGCAAGG GCCCACTCTT AACGGGACCT TTGCCCAGAG CAAATGCCCC CAAGTGGAGT
GGCTGGGCTG GCTCAACACC ATCCAGCCCC CCTTCCTCTG GGTGCTGTTC GTGCTGGCCA CCCTAGAGAA
CATCTTTGTC CTCAGCGTCT TCTGCCTGCA CAAGAGCAGC TGCACGGTGG CAGAGATCTA CCTGGGGAAC
CTGGCCGCAG CAGACCTGAT CCTGGCCTGC GGGCTGCCCT TCTGGGCCAT CACCATCTCC AACAACTTCG
ACTGGCTCTT TGGGGAGACG CTCTGCCGCG TGGTGAATGC CATTATCTCC ATGAACCTGT ACAGCAGCAT
CTGTTTCCTG ATGCTGGTGA GCATCGACCG CTACCTGGCC CTGGTGAAAA CCATGTCCAT GGGCCGGATG
CGCGGCGTGC GCTGGGCCAA GCTCTACAGC TTGGTGATCT GGGGGTGTAC GCTGCTCCTG AGCTCACCCA
TGCTGGTGTT CCGGACCATG AAGGAGTACA GCGATGAGGG CCACAACGTC ACCGCTTGTG TCATCAGCTA
CCCATCCCTC ATCTGGGAAG TGTTCACCAA CATGCTCCTG AATGTCGTGG GCTTCCTGCT GCCCCTGAGT
GTCATCACCT TCTGCACGAT GCAGATCATG CAGGTGCTGC GGAACAACGA GATGCAGAAG TTCAAGGAGA
TCCAGACGGA GAGGAGGGCC ACGGTGCTAG TCCTGGTTGT GCTGCTGCTA TTCATCATCT GCTGGCTGCC
CTTCCAGATC AGCACCTTCC TGGATACGCT GCATCGCCTC GGCATCCTCT CCAGCTGCCA GGACGAGCGC
ATCATCGATG TAATCACACA GATCGCCTCC TTCATGGCCT ACAGCAACAG CTGCCTCAAC CCACTGGTGT
ACGTGATCGT GGGCAAGCGC TTCCGAAAGA AGTCTTGGGA GGTGTACCAG GGAGTGTGCC AGAAAGGGGG
CTGCAGGTCA GAACCCATTC AGATGGAGAA CTCCATGGGC ACACTGCGGA CCTCCATCTC CGTGGAACGC
CAGATTCACA AACTGCAGGA CTGGGCAGGG AGCAGACAGT GAGCAAACGC CAGCAGGGCT GCTGTGAATT
TGTGTAAGGA TTGAGGGACA GTTGCTTTTC AGCATGGGCC CAGGAATGCC AAGGAGACAT CTATGCACGA
CCTTGGGAAA TGAGTTGATG TCTCCGGTAA ACACCGGAG ACTAATTCCT GNCCTGCCCA ATTTTGCAGG
GAGCATGGCT GTGAGGATGG GGTGAACTCA CGCACAGCCA AGGACTCCAA AATCACAACA GCATTACTGT
TCTTATTTGC TGCCACACCT GAGCCAGCCT GCTCCTTCCC AGGAGTGGAG GAGGCCTGGG GGCAGGGAGA
GGAGTGACTG AGCTTCCCTC CCGTGTGTTC TCCGTCCCTG CCCCAGCAAG ACAACTTAGA TCTCCAGGAG
AACTGCCATC CAGCTTTGGT GCAATGGCTG AGTGCACAAG TGAGTTGTTG CCCTGGGTTT CTTTAATCTA
TTCAGCTAGA ACTTTGAAGG ACAATTTCTT GCATTAATAA AGGTTAAGCC CTGAGGGGTC CCTGATAACA
ACCTGGAGAC CAGGATTTTA TGGCTCCCCT CACTGATGGA CAAGGGAGGT CTGTGCCAAA GAAGAATCCA
ATAAGCACAT ATTGAGCACT TGCTGTATAT GCAGTATTGA GCACTGTAGG CAAGAGGGAA GAAAGAGAAG
GAGCCATCTC CATCTTGAAG GAACTCAAAG ACTCAAGTGG GAACGACTGG CACTGCCACC ACCAGAAAGC
TGTTCGACGA GACGGTCGAG CAGGGTGCTG TGGGTGATAT GGACAGCAGA AGGGGAGAC CAAGGTTCCA
GCTCAACCAA TAACTATTGC ACAACCACCT GTCCCTGCCT CAGTTCCCTC TTCTGTAACA TGAAGTCGTT
GTGAGGGTTA AAGGCAGTAA CAGGTATAAA GTACTTAGAA AAGCAAAGGG TGCTACGTAC ATGTGAGGCA
TCATTACGCA GACGTAACTG GGATATGTTT ACTATAAGGA AAAGACACTG AGGTCTAGA TGATCCTATC
ACAACCTGAG AGTAGTTTTT ACTCCATTTA CAGGTGAGGT CATTGTGGTT CAAGGACGTT AAGTAACTTC
CCCAGCTCAC ACGGCTTATA AGTAAGGCAG CCAGGATGTG AACCCAGTAG GACTATCTGG CTGCAAAGTC
CCCACCCTCC CTCGCCATCT GTATCCTCCA ATCATCTTCA GTGCTTTGCT GATAGAAGGT ACGGAAATAC
GATGCCACAG ACTGTCCAGG AAGACAGAAA CTAGGCAGAT GGGCTGGCCA TGGTCTCCAA GCCAGACTGG
AATCTCCAGG TCTGGAATGA TATCATTTTT CTCTTTTAAT AAATTAACTC ACCCACCACA CGGCTTTGAG
AGGCTCAAAG GTGACCAACT CCCTTGGGAG GGCCCCGGTT GATAAGGAAG GAATGTGAAT CCTCCCATCA
```

-continued

```
CGGAAGCTTC AAGGAGGTCA AGGGTCCAAC ACTTGAGATT GTTAGTGCTG TTGGTGGATA CTGCAGAATA
TCCAGTGGAG CCTCAGATGA AGAACATGAG GCCCCGTTTA GATCCAAGGA TCAGAGGGGG CTCTGTAAGA
CCCAGGGGAG TCAGGTGCAC TGGAGCGCGG GCTGCAGAAA ACAGCCTGAG CTCCACCTCG GCTTCTCCTT
GCCCTGGCTG GTTGTCCTTA ACCCCTGTCT CCTTCTGGAC CAGTTTTTGT CCTTCCCTTG TGACCTGAGG
GGTAACAGCC TCTTTTCCAC TTTCTTTCAG CGCCGACATG CTCAATGTCA CCTTGCAAGG GCCCACTCTT
AACGGGACCT TTGCCCAGAG CAAATGCCCC CAAGTGGAGT GGCTGGGCTG GCTCAACACC ATCCAGCCCC
CCTTCCTCTG GGTGCTGTTC GTGCTGGCCA CCCTAGAGAA CATCTTTGTC CTCAGCGTCT TCTGCCTGCA
CAAGAGCAGC TGCACGGTGG CAGAGATCTA CCTGGGGAAC CTGGCCGCAG CAGACCTGAT CCTGGCCTGC
GGGCTGCCCT TCTGGGCCAT CACCATCTCC AACAACTTCG ACTGGCTCTT TGGGGAGACG CTCTGCCGCG
TGGTGAATGC CATTATCTCC ATGAACCTGT ACAGCAGCAT CTGTTTCCTG ATGCTGGTGA GCATCGACCG
CTACCTGGCC CTGGTGAAAA CCATGTCCAT GGGCCGGATG CGCGGCGTGC GCTGGGCCAA GCTCTACAGC
TTGGTGATCT GGGGGTGTAC GCTGCTCCTG AGCTCACCCA TGCTGGTGTT CCGGACCATG AAGGAGTACA
GCGATGAGGG CCACAACGTC ACCGCTTGTG TCATCAGCTA CCCATCCCTC ATCTGGGAAG TGTTCACCAA
CATGCTCCTG AATGTCGTGG GCTTCCTGCT GCCCCTGAGT GTCATCACCT TCTGCACGAT GCAGATCATG
CAGGTGCTGC GGAACAACGA GATGCAGAAG TTCAAGGAGA TCCAGACGGA GAGGAGGGCC ACGGTGCTAG
TCCTGGTTGT GCTGCTGCTA TTCATCATCT GCTGGCTGCC CTTCCAGATC AGCACCTTCC TGGATACGCT
GCATCGCCTC GGCATCCTCT CCAGCTGCCA GGACGAGCGC ATCATCGATG TAATCACACA GATCGCCTCC
TTCATGGCCT ACAGCAACAG CTGCCTCAAC CCACTGGTGT ACGTGATCGT GGGCAAGCGC TTCCGAAAGA
AGTCTTGGGA GGTGTACCAG GGAGTGTGCC AGAAAGGGGG CTGCAGGTCA GAACCCATTC AGATGGAGAA
CTCCATGGGC ACACTGCGGA CCTCCATCTC CGTGGAACGC CAGATTCACA AACTGCAGGA CTGGGCAGGG
AGCAGACAGT GAGCAAACGC CAGCAGGGCT GCTGTGAATT TGTGTAAGGA TTGAGGGACA GTTGCTTTTC
AGCATGGGCC CAGGAATGCC AAGGAGACAT CTATGCACGA CCTTGGGAAA TGAGTGTTGA TGTCTCCGGT
AAAACACCGG AGACTAATTC CTGCCCTGCC CAATTTTCGA GGGAGCATGG CTGTGAGGAT GGGGTGAACT
CACGCACAGC CAAGGACTCC AAAATCACAA CAGCATTACT GTTCTTATTT GCTGCCACAC CTGAGCCAGC
CTGCTCCTTC CCAGGAGTGG AGGAGGCCTG GGGGAGGGAG AGGAGTGACT GAGCTTCCCT CCCGTGTGTT
CTCCGTCCCT GCCCCAGCAA GACAACTTAG ATCTCCAGGA GAACTGCCAT CCACGTTTGG TGCAATGGCT
GAGTGCACAA GTGAGTTGTT GCCCTGGGTT TCTTTAATCT ATCAGCTAGA ACTTTGAAGG ACAATTTCTT
GCATTAATAA AGGTTAAGCC CTGAGGGGTC CCTTGATAAC AACCTGGAGA CCAGGATTTT ATGGCTCCCC
TCACTGATGG ACAAGGAGGT CTGTGCCAAA GAAGAATCAA TAAGCACATA TGAGCACTTC TGTATATCAG
TATTGAGCAC TGTAGGCA ATGTTCTCTC CCTGGAAGAT ATCAATGTTT CTGTCTGTTT GTGAGGACTC
CGTGCCCACC ACGGCCTCTT TCAGCGCCGA CATGCTCAAT GTCACCTTGC AAGGGCCCAC TCTTAACGGG
ACCTTTGCCC AGAGCAAATG CCCCCAAGTG GAGTGGCTGG GCTGGCTCAA CACCATCCAG CCCCCCTTCC
TCTGGGTGCT GTTCGTGCTG GCCACCCTAG AGAACATCTT TGTCCTCAGC GTCTTCTGCC TGCACAAGAG
CAGCTGCACG GTGGCAGAGA TCTACCTGGG GAACCTGGCC GCAGCAGACC TGATCCTGGC CTGCGGGCTG
CCCTTCTGGG CCATCACCAT CTCCAACAAC TTCGACTGGC TCTTTGGGGA CGCTCTGCGC GCGTGGTGA
ATGCCATTAT CTCCATGAAC CTGTACAGCA GCATCTGTTT CCTGATGCTG GTGAGCATCG ACCGCTACCT
GGCCCTGGTG AAAACCATGT CCATGGGCCG GATGCGCGGC GTGCGCTGGG CCAAGCTCTA CAGCTTGGTG
ATCTGGGGGT GTACGCTGCT CCTGAGCTCA CCCATGCTGG TGTTCCGGAC CATGAAGGAG TACAGCGATG
AGGGCCACAA CGTCACCGCT TGTGTCATCA GCTACCCATC CCTCATCTGG GAAGTGTTCA CCAACATGCT
```

-continued

```
CCTGAATGTC GTGGGCTTCC TGCTGCCCCT GAGTGTCATC ACCTTCTGCA CGATGCAGAT CATGCAGGTG

CTGCGGAACA ACGAGATGCA GAAGTTCAAG GAGATCCAGA CGGAGAGGAG GGCCACGGTG CTAGTCCTGG

TTGTGCTGCT GCTATTCATC ATCTGCTGGC TGCCCTTCCA GATCAGCACC TTCCTGGATA CGCTGCATCG

CCTCGGCATC CTCTCCAGCT GCCAGGACGA GCGCATCATC GATGTAATCA CACAGATCGC CTCCTTCATG

GCCTACAGCA ACAGCTGCCT CAACCCACTG GTGTACGTGA TCGTGGGCAA GCGCTTCCGA AAGAAGTCTT

GGGAGGTGTA CCAGGGAGTG TGCCAGAAAG GGGGCTGCAG GTCAGAACCC ATTCAGATGG AGAACTCCAT

GGGCACACTG CGGACCTCCA TCTCCGTGGA ACGCCAGATT CACAAACTGC AGGACTGGGC AGGGAGCAGA

CAGTGAGCAA ACGCCAGCAG GGCTGCTGTG AATTTGTGTA AGGATTGAGG ACAGTTGCT T ATGTTCTCTC

CCTGGAAGAT ATCAATGTTT CTGTCTGTTC GTGAGGACTC CGTGCCCACC ACGGCCTCTT TCAGCGCCGA

CATGCTCAAT GTCACCTTGC AAGGGCCCAC TCTTAACGGG ACCTTTGCCC AGAGCAAATG CCCCCAAGTG

GAGTGGCTGG GCTGGCTCAA CACCATCCAG CCCCCCTTCC TCTGGGTGCT GTTCGTGCTG GCCACCCTAG

AGAACATCTT TGTCCTCAGC GTCTTCTGCC TGCACAAGAG CAGCTGCACG GTGGCAGAGA TCTACCTGGG

GAACCTGGCC GCAGCAGACC TGATCCTGGC CTGCGGGCTG CCCTTCTGGG CCATCACCAT CTCCAACAAC

TTCGACTGGC TCTTTGGGGA GACGCTCTGC CGCGTGGTGA ATGCCATTAT CTCCATGAAC CTGTACAGCA

GCATCTGTTT CCTGATGCTG GTGAGCATCG ACCGCTACCT GGCCCTGGTG AAAACCATGT CCATGGGCCG

GATGCGCGGC GTGCGCTGGG CCAAGCTCTA CAGCTTGGTG ATCTGGGGGT GTACGCTGCT CCTGAGCTCA

CCCATGCTGG TGTTCCGGAC CATGAAGGAG TACAGCGATG AGGGCCACAA CGTCACCGCT TGTGTCATCA

GCTACCCATC CCTCATCTGG GAAGTGTTCA CCAACATGCT CCTGAATGTC GTGGGCTTCC TGCTGCCCCT

GAGTGTCATC ACCTTCTGCA CGATGCAGAT CATGCAGGTG CTGCGGAACA ACGAGATGCA GAAGTTCAAG

GAGATCCAGA CGGAGAGGAG GGCCACGGTG CTAGTCCTGG TTGTGCTGCT GCTATTCATC ATCTGCTGGC

TGCCCTTCCA GATCAGCACC TTCCTGGATA CGCTGCATCG CCTCGGCATC CTCTCCAGCT GCCAGGACGA

GCGCATCATC GATGTAATCA CACAGATCGC CTCCTTCATG GCCTACAGCA ACAGCTGCCT CAACCCACTG

GTGTACGTGA TCGTGGGCAA GCGCTTCCGA AAGAAGTCTT GGGAGGTGTA CCAGGGAGTG TGCCAGAAAG

GGGGCTGCAG GTCAGAACCC ATTCAGATGG AGAACTCCAT GGGCACACTG CGGACCTCCA TCTCCGTGGA

ACGCCAGATT CACAAACTGC AGGACTGGGC AGGGAGCAGA CAGTGAGCAA ACGCCAGCAG GGCTGCTGTG

AATTTGTGTA AGGATTGAGG ACAGTTGCT T GCCCTTCAAA GATGAGCTGT TCCCGCCGCC ACTCCAGCTC

TGGCTTCTGG GCTCCGAGGA GGGGTGGGGA CGGTGGGGAC ATCAGGCTGC CCCGCAGTAC CAGGGAGCGA

CTGAAGTGCC CATGCCGCTT GCTCCGGAGA AGGTGGGTGC CGGGCAGGGG CTGCTCCAGC CGCCTCACCT

CTGCTGGGAG GACAAACTGT CCCAGCACAG AGGGAGGGAG GGAGGGCAGG CAGCGGGGAG AAGTTTCCCT

GTGGTCGTGG GGAGTT GCCCTTCAAA GATGAGCTGT TCCCGCCGCC ACTCCAGCTC TGGCTTCTGG

GCTCCGAGGA GGGGTGGGGA CGGTGGTGAC GGTGGGGACA TCAGGCTGCC CCGCAGTACC AGGGAGCGAC

TGAAGTGCCC ATGCCGCTTG CTCCGGAGAA GGTGGGTGCC GGGCAGGGGC TGCTCCAGCC GCCTCACCTC

TGCTGGGAGG ACAAACTGTC CCAGCACAGA GGGAGGGAGG GAGGGCAGGC AGCGGGGAGA AGTTTCCCTG

TGGTCGTGGG GAGTT GAGCTCTTCA ATATTTTAGT GAAAGCTATA GATGAGGCTC CATAGGGGAT AAAGCACAGA

CACACCTTTT CAGAGGGCTT GTGGACTCTG GGCAGCCTGT CCATAGACCT CTGTCCCCAA CTGGCAAGTC

AGGAAACTCC AGATTAAGGA GCCCCAATGT GGTTGAACAG CCAGGTGCAC AGATGAGTCA ACCACACAGC

CAGGCCAGGG AGGGCCTTCA CTCAAGAGCC TACAGCCAGT TCACAGCCAA GCCAGGGCTA GCGCCAGGCC

ACCCATAAAC TGATCTGAGA CTCTGTTTCC CTGTCTCCAT GATGATGGGA TCAGGCTTGA TTGCTGGTTT

GTAGGCTTGT TATGAATCAA GTCACAGGGA AGAGGAGCTG ATGGGCTGGG GGACGTCCT CTGGCCCTCC

TGTCTCTTCC CCAGATCCAC TGGGCCCACT CTTATCTGTT CTCTTCTGAA GGAAGGGTTT TAAGGCTTCA
```

```
AAAAAAAATG TTTTGAAAGT CCCTGCCCTT TCCAGCTCCT ACCGTCTCAG CCCTGGGAGT GTAAAGTGCT

GCAGATAGTT AGTAAGTCTT TGAGCAAAAC TGAGAAAGCC AGCCTGAGCC TTGACATGGG AGAAACCTCC

GCCATACATC TCCGAAGAAA CGGCCGCGTG TCTCAGGGGA GCGCAAACAC CCGTACCCAG GAAACAGGAC

AGCTTCTGCC ACTGTCGCCC TTGGGAGCCG TACGTGGCAT GACAAAGAAA TCCCAGGACT CCGCCTGCCC

ACCTGGCCAC CCTCTGTTTA CACCTTCCGC GTAAACGCCC ACTGTTTACA TCCAAAACTC AGACACAAAA

TAACCACCTC AAGAAGATAA ATAATGATAA GAAATAAATG TTACGCGAGG CAAATTTATT CACATGGGGC

TTCCCAGGCC ACTTTGTGGT CAGCCGGGAG GGACGTTTTT GCCGTCCCAC GACTCCAACG GGCAGCCGGG

CCTACGCAAA CATGGAAATC TTCCAAGAGC CTCCCTGGCC CCCAGGGCTC AGAGGGTGGC AGAGCGGAGA

GCGAAGGTGG CCGCAGCCTT CCCGGCCCCA CAGCCAGCCT GGCTCCAGCT GGGCAGGAGT GCAGAGCTCA

GCTGGAGGCG AGGGGGAAGT GCCCAGGAGG CTGATGACAT CACTACCCAG CCCTTCAAAG ATGAGCTGTT

CCCGCCGCCA CTCCAGCTCT GGCTTCTGGG CTCCGAGGAG GGGTGGGGAC GGTGGTGACG GTGGGGACAT

CAGGCTGCCC CGCAGTACCA GGGAGCGACT GAAGTGCCCA TGCCGCTTGC TCCGGAGAAG GTGGGTGCCG

GGCAGGGGCT GCTCCAGCCG CCTCACCTCT GCTGGGAGGA CAAACTGTCC CAGCACAGAG GGAGGGAGGG

AGGGCAGGCA GCGGGGAGAA GTTTCCCTGT GGTCGTGGGG AGTTGGGAAA AGTTCCCTTC CTTCCGGAGG GAGG

GAATTCGGGA AAAAGTGAAG GTGTAAAAGC AGCACAAGTG CAATAAGAGA TATTTCCTCA AATTTGCCTC

AAGATGGAAA CCCTTTGCCT CAGGGCATCC TTTTGGCTGG CACTGGTTGG ATGTGTAATC AGTGATAATC

CTGAGAGATA CAGCACAAAT CTAAGCAATC ATGTGGATGA TTTCACCACT TTTCGTGGCA CAGAGCTCAG

CTTCCTGGTT ACCACTCATC AACCCACTAA TTTGGTCCTA CCCAGCAATG GCTCAATGCA CAACTATTGC

CCACAGCAGA CTAAAATTAC TTCAGCTTTC AAATACATTA ACACTGTGAT ATCTTGTACT ATTTTCATCG

TGGGAATGGT GGGGAATGCA ACTCTGCTCA GGATCATTTA CCAGAACAAA TGTATGAGGA ATGGCCCCAA

CGCGCTGATA GCCAGTCTTG CCCTTGGAGA CCTTATCTAT GTGGTCATTG ATCTCCCTAT CAATGTATTT

AAGCTGCTGG CTGGGCGCTG GCCTTTTGAT CACAATGACT TTGGCGTATT CTTTTGCAAG CTGTTCCCCT

TTTTGCAGAA GTCCTCGGTG GGGATCACCG TCCTCAACCT CTGCGCTCTT AGTGTTGACA GGTACAGAGC

AGTTGCCTCC TGGAGTCGTG TTCAGGGAAT TGGGATTCCT TTGGTAACTG CCATTGAAAT TGTCTCCATC

TGGATCCTGT CCTTTATCCT GGCCATTCCT GAAGCGATTG GCTTCGTCAT GGTACCCTTT GAATATAGGG

GTGAACAGCA TAAAACCTGT ATGCTCAATG CCACATCAAA ATTCATGGAG TTCTACCAAG ATGTAAAGGA

CTGGTGGCTC TTCGGGTTCT ATTTCTGTAT GCCCTTGGTG TGCACTGCGA TCTTCTACAC CCTCATGACT

TGTGAGATGT TGAACAGAAG GAATGGCAGC TTGAGAATTG CCCTCAGTGA ACATCTTAAG CAGCGTCGAG

AAGTGGCAAA AACAGTTTTC TGCTTGGTTG TAATTTTTGC TCTTTGCTGG TTCCCTCTTC ATTTAAGCCG

TATATTGAAG AAAACTGTGT ATAACGAGAT GGACAAGAAC CGATGTGAAT TACTTAGTTT CTTACTGCTC

ATGGATTACA TCGGTATTAA CTTGGCAACC ATGAATTCAT GTATAAACCC CATAGCTCTG TATTTTGTGA

GCAAGAAATT TAAAAATTGT TTCCAGTCAT GCCTCTGCTG CTGCTGTTAC CAGTCCAAAA GTCTGATGAC

CTCGGTCCCC ATGAACGGAA CAAGCATCCA GTGGAAGAAC CACGATCAAA ACAACCACAA CACAGACCGG

AGCAGCCATA AGGACAGCAT GAACTGACCA CCCTTAGAAG CACTCCTCGG TACTCCCATA ATCCTCTCGG

AGAAAAAAAT CACAAGGCAA CTGTGAGTCC GGGAATCTCT TCTCTGATCC TTCTTCCTTA ATTCACTCCC

ACACCCAAGA AGAAATGCTT TCCAAAACCG CAAGGGTAGA CTGGTTTATC CACCCACAAC ATCTACGAAT

CGTACTTCTT TAATTGATCT AATTTACATA TTCTGCGTGT TGTATTCAGC ACTAAAAAAT GGTGGGAGCT

GGGGGAGAAT GAAGACTGTT AAATGAAACC AGAAGGATAT TTACTACTTT TGCATGAAAA TAGAGCTTTC

AAGTACATGG CTAGCTTTTA TGGCAGTTCT GGTGAATGTT CAATGGGAAC TGGTCACCAT GAAACTTTAG
```

-continued

```
AGATTAACGA CAAGATTTTC TACTTTTTTT AAGTGATTTT TTTGTCCTTC AGCCAAACAC AATATGGGCT
CAAGTCACTT TTATTTGAAA TGTCATTTGG TGCCAGTATC CCGAATTC GCCACCATGG AAACCCTTTG
CCTCAGGGCA TCCTTTTGGC TGGCACTGGT TGGATGTGTA ATCAGTGATA ATCCTGAGAG ATACAGCACA
AATCTAAGCA ATCATGTGGA TGATTTCACC ACTTTTCGTG GCACAGAGCT CAGCTTCCTG GTTACCACTC
ATCAACCCAC TAATTTGGTC CTACCCAGCA ATGGCTCAAT GCACAACTAT TGCCCACAGC AGACTAAAAT
TACTTCAGCT TTCAAATACA TTAACACTGT GATATCTTGT ACTATTTTCA TCGTGGGAAT GGTGGGGAAT
GCAACTCTGC TCAGGATCAT TTACCAGAAC AAATGTATGA GGAATGGCCC CAACGCGCTG ATAGCCAGTC
TTGCCCTTGG AGACCTTATC TATGTGGTCA TTGATCTCCC TATCAATGTA TTTAAGCTGC TGGCTGGGCG
CTGGCCTTTT GATCACAATG ACTTTGGCGT ATTTCTTTGC AAGCTGTTCC CCTTTTTGCA GAAGTCCTCG
GTGGGGATCA CCGTCCTCAA CCTCTGCGCT CTTAGTGTTG ACAGGTACAG AGCAGTTGCC TCCTGGAGTC
GTGTTCAGGG AATTGGGATT CCTTTGGTAA CTGCCATTGA AATTGCCTCC ATCTGGATCC TGTCCTTTAT
CCTGGCCATT CCTGAAGCGA TTGGCTTCGT CATGGTACCC TTTGAATATA GGGGTGGACA GCATAAAACC
TGTATGCTCA ATGCCACATC AAAATTCATG GAGTTCTACC AAGATGTAAA GGACTGGTGG CTCTTCGGGT
TCTATTTCTG TATGCCCTTG GTGTGCACTG CGATCTTCTA CACCCTCATG ACTGGTGAGA TGTTGAACAG
AAGGAATGGC AGCTTGAGAA TTGCCCTCAG TGAACATCTT AAGCAGCGTC GAGAAGTGGC AAAAACAGTT
TTCTGCTTGG TTGTAATTTT TGCTCTTTGC TGGTTCCCTC TTCATTTAAG CCGTATATTG AAGAAACTG
TGTATAACGA GATGGACAAG AACCGATGTG AATTACTTAG TTTCTTACTG CTCATGGATT ACATCGGTAT
TAACTTGGCA ACCATGAATT CATGTATAAA CCCCATAGCT CTGTATTTTG TGAGCAAGAA ATTTAAAAAT
TGTTTCCAGT CATGCCTCTG CTGCTGCTGT TACCAGTCCA AAAGTCTGAT GACCTCGGTC CCCATGAACG
GAACAAGCAT CCAGTGGAAG AACCACGATC AAAACAACCA CAACACAGAC CGGAGCAGCC ATAAGGACAG
CATGAACTGA CCACCCTTAG AAGCACTCCT GAATTCGGGA AAAAGTGAAG GTGTAAAAGC AGCACAAGTG
CAATAAGAGA TATTTCCTCA AATTTGCCTC AAGATGGAAA CCCTTTGCCT CAGGGCATCC TTTTGGCTGG
CACTGGTTGG ATGTGTAATC AGTGATAATC CTGAGAGATA CAGCACAAAT CTAAGCAATC ATGTGGATGA
TTTCACCACT TTTCGTGGCA CAGAGCTCAG CTTCCTGGTT ACCACTCATC AACCCACTAA TTTGGTCCTA
CCCAGCAATG GCTCAATGCA CAACTATTGC CCACAGCAGA CTAAAATTAC TTCAGCTTTC AAATACATTA
ACACTGTGAT ATCTTGTACT ATTTTCATCG TGGGAATGGT GGGGAATGCA ACTCTGCTCA GGATCATTTA
CCAGAACAAA TGTATGAGGA ATGGCCCCAA CGCGCTGATA GCCAGTCTTG CCCTTGGAGA CCTTATCTAT
GTGGTCATTG ATCTCCCTAT CAATGTATTT AAGCTGCTGG CTGGGCGCTG GCCTTTTGAT CACAATGACT
TTGGCGTATT TCTTTGCAAG CTGTTCCCCT TTTTGCAGAA GTCCTCGGTG GGGATCACCG TCCTCAACCT
CTGCGCTCTT AGTGTTGACA GGTACAGAGC AGTTGCCTCC TGGAGTCGTG TTCAGGGAAT TGGGATTCCT
TTGGTAACTG CCATTGAAAT TGTCTCCATC TGGATCCTGT CCTTTATCCT GGCCATTCCT GAAGCGATTG
GCTTCGTCAT GGTACCCTTT GAATATAGGG GTGAACAGCA TAAAACCTGT ATGCTCAATG CCACATCAAA
ATTCATGGAG TTCTACCAAG ATGTAAAGGA CTGGTGGCTC TTCGGGTTCT ATTTCTGTAT GCCCTTGGTG
TGCACTGCGA TCTTCTACAC CCTCATGACT GTGAGATGT TGAACAGAAG GAATGGCAGC TTGAGAATTG
CCCTCAGTGA ACATCTTAAG CAGCGTCGAG AAGTGGCAAA ACAGTTTTC TGCTTGGTTG TAATTTTTGC
TCTTTGCTGG TTCCCTCTTC ATTTAAGCCG TATATTGAAG AAACTGTGT ATAACGAGAT GGACAAGAAC
CGATGTGAAT TACTTAGTTT CTTACTGCTC ATGGATTACA TCGGTATTAA CTTGGCAACC ATGAATTCAT
GTATAAACCC CATAGCTCTG TATTTTGTGA GCAAGAAATT TAAAAATTGT TTCCAGTCAT GCCTCTGCTG
CTGCTGTTAC CAGTCCAAAA GTCTGATGAC CTCGGTCCCC ATGAACGAA CAAGCATCCA GTGGAAGAAC
CACGATCAAA ACAACCACAA CACAGACCGG AGCAGCCATA AGGACAGCAT GAACTGACCA CCCTTAGAAG
```

-continued

```
CACTCCTCGG TACTCCCATA ATCCTCTCGG AGAAAAAAAT CACAAGGCAA CTGTGAGTCC GGGAATCTCT
TCTCTGATCC TTCTTCCTTA ATTCACTCCC ACACCCAAGA AGAAATGCTT TCCAAAACCG CAAGGGTAGA
CTGGTTTATC CACCCACAAC ATCTACGAAT CGTACTTCTT TAATTGATCT AATTTACATA TTCTGCGTGT
TGTATTCAGC ACTAAAAAAT GGTGGGAGCT GGGGGAGAAT GAAGACTGTT AAATGAAACC AGAAGGATAT
TTACTACTTT TGCATGAAAA TAGAGCTTTC AAGTACATGG CTAGCTTTTA TGGCAGTTCT GGTGAATGTT
CAATGGGAAC TGGTCACCAT GAAACTTTAG AGATTAACGA CAAGATTTTC TACTTTTTTT AAGTGATTTT
TTTGTCCTTC AGCCAAACAC AATATGGGCT CAAGTCACTT TTATTTGAAA TGTCATTTGG TGCCAGTATC
CCGAATTC AACAAGAAAA GCGTTGGTAG CTCTGGTGAA TCCCAAAAGA ATGTGGCAGT TGCTAGCCAT
GCTCCTGAAT ATGTATAAAC AGTACATCAT ATGACTAAGA GTTTGACTTA GGGGTTAGAT TTTATGTGTT
TGAACCCCAA ATTAGTTATT TAATAGTTGG CACCCCAAAA CAAGTTACTT AACCTCACTA AGGTTCAGTT
TTCCTGTTTA TAAAATGTAG ATAGTGATAG TATGTACTTT ATAGGATTAT TGTGAAAAAT AAATGAAATA
TCAGATTTAT TTAGGATAAC ACCTGGCATA TGTTTGGTAT TCAGAATTAG TTGCTGCTGT TTTATTCTGC
TCTCCCTTGC ATCCCACTTT TCTAAGTTGT AAACTAAATA GTTGTACACA GATTGACAGA TTAAGAAAGG
CTTGTGATTG TGCTAGACCT ATGCCTATGC CTCTGTCTCA CCAGATTCCA GGTGTATATG TGGAGGTGGG
ATAGGGAGTG GAGTAAGTGG GTAAATATTA AATTGCCCAG TTGGGCACCA TCCTGAATAT TATCTCTAAA
GAAAGAAGCA AAACCAGGCA CAGCTGATGG GTTAACCAGA TATGATACAG AAAACATTTC CTTCTGCTTT
TTGGTTTTAA GCCTATATTT GAAGCCTTAG ATCTCTCCAG CACAGTAAGC ACCAGGAGTC CATGAAGAAG ATG
GATCTTCATG TGGAATGACT GGTTTCATTC AATAGACTTA ATTCAGCAGT CTGTGGGAA GAGCAAGGTA
TGATAGAATG GTTCCTCAAG TGCTTCAGAT GTGAAGTGGG TTTAAATATA CTGTCCCTGT CTTCTTCAGA
GTTTTGGTAA AGATAAAATA GGACACTCAT TTAAAAGCAA TCTTTGCAAA TGACAAGCCA CTATAGACAT
TAATAGAGTT TTCATTTCCA GTATTATCAT TAATATCAGA TCCTGGAAGA AGGTTGAGCC TTGACCTAGA
GCAAAAAAAC AGAAGAATTA GTAAAGGAAT CCTGGAGAAA GCCCCTGCTG TGTATTTAAA GGAGAAAGGG
AGATCATGTT GGGAAATTAT AATATTAAAA GTAAACAAAA GCTAGGAAGT AAAATAAAAT AAATTATATG
GCCTAGATCC CCATAAGTAA TGGTTTAACT TCTGCCTTCC TGTGTTCTGA GCCAGATTAG GGCACAGTAG
AGAAAGAGGA GTCTCTGAAA ATGTTTCCAA TTTCGCTGGT CAGACAGCGG ATCATCAGTG AATCAGATGA
AAATTTGTGG ATTTATGCAC TAACTGATCA GCAGGAAATT AAACAAGAAA AGCGTTGGTA GCTCTGGTGA
ATCCCAAAAG AATTTGGCAG TTGCTAGCCA TGCTCCTGAA TATGTATAAA CAGTACATCA TATGACTAAG
AGTTTGACTT AGGGGTTAGA TTTTATGTGT TTGAACCCCA AATTAGTTAT TTAATAGTTG CACCCCAAA
ACAAGTTACT TAACCTCACT AAGATTCAGT TTTCCTGTTT ATAAAATGTA GATAGTGATA GTATGTACTT
TATAGGATTA TTGTGAAAAA TAAATGAAAT ATCAGATTTA TTTAGGATAA CACCTGGCAT ATGTTTGGTA
TTCAGTAATT AGTTGCTGCT GTTTTATTCT GCTCTCCCTT GCATCCCACT TTTCTAAGTT GTAAACTAAA
TAGTTGTACA CAGATTGACA GATTAAGAAA GGCTTGTGAT TGTGCTAGAC CTATGCCTCT CTCTCACCAG
ATTCCAGGTG TATATGTGGA GGTGGGATAG GGAGTGGAGT AAGTGGGTAA ATATTAAATT GCCCAGTTGG
GCACCATCCT GAATATTATC TCTAAAGAAA GAAGCAAAAC CAGGCACAGC TGATGGGTTA ACCAGATATG
ATACAGAAAA CATTTCCTTC TGCTTTTTGG TTTTAAGCCT ATATTTGAAG CCTTAGATCT CTCCAGCACA
GTAAGCACCA GGAGTCCATG AAGAAGATGG CTCCTGCCAT GGAATCCCCT ACTCTACTGT GTGTAGCCTT
ACTGTTCTTC GGTAAGTAGA GATTCAATTA CCCCTCCCAG GGAGGCCCAA ATGAATTTGG GGAGCAGCTG
GGGTAGGAAC CTTTACTGTG GGTGGTGACT TTTTCTAGGA CATGTGCAAA CTATTGGGCA TTTCCCAGGG
ACTCTGTAGT GGAGCCAAGC TAGAAAGCAG AGGCAAGTGG GCTGAGCAAC ACCTAAGGAG GAAGCCAGAC
```

```
TGAAAGCTTG GTTCCTTGCA TTTGCTCTGG CATCTTCCAG AGTGCAAATT TCCTACCAAG GTAATGAGGG

TAGAGGAGAG AAAGAAGCTC TTTCTTCCCC TGATTCTCAT TCCTGAAAAG ACGGTTGGTC CTTAAAATTC

CATGGATGTA GATCTTATCC CCACACCCAG ATTCTAGTCC TCTGGAGATA AGAAGACTG CTGGCACACTA

ATGTATCCTC TCTGGACTTT TGCAGCTCCA GATGGCGTGT TAGCAGGTGA GTCCTCTGTT CTTGTTCCCT

TGGTGTATCA ACATGTCTGG GCATTGCTTT CCTCTCACTA TTTTCTTCGT CCCATCACTT CTGCTTTCTA

ATGAGCATGA ATCTGTTCCT TGGCCAGACT ACTTTCCCTC TCCACCTTGC CTTGTCTTTC TTTTTTTCCC

TGATTCATTG CATTCTCTCA AGTCATTCTC TCCTCTGTTT TAGTCAATAA CCATGTCTGT TGCACATATA

CATGTCTCAT TCTCTCTCCT AGACACTTTG GCATGATCTC GCTCAATAAT TACATTATTA TTATTATTGC

CATTTTATAA TTGAGGATGC TGAAACTCAG TGATTTTCTG GTGGTTACAT GGCTAAGGAA CTGGATTTCA

ACGTAAGTTC CTTGGATCTA AGTCCAGTTC TCTTCTGACT ATATCACCCT TTTGTTATCA CCATGTATCT

ACTTCTTTGG TCTCTGTTCA AATTTGCACT ACATCCCCTT GTTCCAGGAA GCCATTCAAG ACTGACTTTC

TTAGTGCCTC TCACTACTTT CTGGAACTGA CATATGTTTT TCACTCTGTA TATACTTACA ATTAAATAGT

CATAAATATT CAGAGCTTGG AGAAACCTTA TATTTCATCC AGTCCAGTAA ATTTATCCAT CCATAATTCA

CTCATTCATT CACATAATAA ATATTTAATG TAACAATGGT TGAACATGGC AGACAGTGTT TCTACCTCAA

AAGAGATTGC AGTCCTCATT TACAGATACT GAATTGAAAT TAACAGAAGT AGAGTGAGTC AGCTCAAATC

ACATAGTGAA TTGGTTTCTT TGTTTTTAAA TCTCCTGCAT ATGTGTCCTG TCTTTCTCCC TGTGTTGGGC

GTTCCCTGGG GCACCAATAC TAATTTCTCC TTCCCCTAGA AATCAAAACA GGGTCTTATC ACCAACAGAA

TAAGGACAGG TTGACCACTG ATTGTCAGAA TATTGCTTCG TTTGTACTTT TAAGCCTAGA CAGTTTTCAA

TGACTTTTTT TCTCTCTACA TGTCTTTTCA TATTTTTATC TTCTTGAAGT CCCTCAGAAA CCTAAGGTCT

CCTTGAACCC TCCATGGAAT AGAATATTTA AAGGAGAGAA TGTGACTCTT ACATGTAATG GAACAATTT

CTTTGAAGTC AGTTCCACCA AATGGTTCCA CAATGGCAGC CTTTCAGAAG AGACAAATTC AAGTTTGAAT

ATTGTGAATG CCAAATTTGA AGACAGTGGA GAATACAAAT GTCAGCACCA ACAAGTTAAT GAGAGTGAAC

CTGTGTACCT GGAAGTCTTC AGTGGTAAGT TCCAGGGATA TGGAAATACA GATCTCTCAT GTGAGGGATG

GCTCATCTGA AGATGGGAAA AAACAGGTTA TTCCAAGGGT TAGGACACCA GAGTGGGATT CAAGGCCTCT

CATTTTTAAG ACCCCTGCAT TGGCTGGGCA CAGTGGCTCA CGCCTGTAAT CCCAGCACTT TGGGAGGCTG

AGGCAGGTGG ATCACGAGGT CAGGAGATCG AGACCATCCG GCTAACATGG TGAAACCCCA TCTCTGCTAA

AAAATATATA TATATAAAAT TAGCCGGGCG TAGTGGTGGG CACCTGTAGT CCCAGGTACT CGGGAGGCTG

AGGCAGGAGA ATGGTGTGAA CCCAGGAGGT GGAGGTTGCA GTGAGCTGAG ATCACGCCAC TGCCCTCCAG

CCTGGGCTAC AGAGCAAGAC TCCGTCTCAA AAAATAAATA AATAAATAAA AAAGACCCCT GCATCTCTTT

TCTTCTACCC CCTTCCCTTT TGATTACTTG TATGCCTTCT TTCAATATTC TAGTCATCTC TCAATATTAT

TCCTCCACCC TATTTTCCTC TATCTTTTCT GCCTAGATTC AGGTATATAT TATGTGGTCA AACAGCATGA

CATATATGTG AACATTTCAA AGAGCTGTGT ATCTGGAATA GGATCAAAAG GTTTGACTTA AAGTTTTGCT

CTGCATAATC CATATGGCAG GACCTGAATA TTAGGTTGTA CTCTTCGTTA TGAAACATAT CTGGGTACAT

TTCCTTATGT CCTCTGTTGT TACTTAAGAA CACATATTTC ATGCTTGTTT CATTTTTATC ACTCCTACTG

CCAACAAATA GCATAGCATG CTTAGGCACA TGTGGCTTAA TTAGCAAATG TTGAATAAAC AAATTAATGA

TTTTGAATAG TGACCAATAG GTCTCTTTTA TACTCTATAT TTTTCTCTTG AGTGAAAAAA AATGTTTCAA

CCTCCATATG TAAATTCCAA ACACAAACTA AAGCAATGTA GAATAGCTTC TTTATTCCCT GGAGTAGGTT

CTAGAGAAGT CCTAAAGGAT TGGTCCTAAA TTAATTATGC TTATTATGCT AGCGATATTT CCTTTCAAAA

TTCTCCTTTA ATGAATGCTT TTTAATTTTT ACAAAAGCAT TAACCATAGA ATGTGATTCT TGTCTTTCAC

TGACTCATTA GTGACAAATA TTTGTTGAGT ACCTACCAAC TCCTAAGTAT TGCTACCAAC TCCTAAATAC
```

-continued

```
TGTGTTGGGC ATTCAGAATA GAATGTAGAA CTAGACAGGG TCCCTGACTT CTTGGAGCAC AGAGCAGTAT
GGGAAGAGGA CATTAAATAA AGAATTACAT AAGTAATTAA TTTAAATTAT ACATGTTTTG AAGAAGTTTT
TTTTTGACAA CTATAATTAA CACTAGAACT GGGAAGTTTC TATAAGGTAA GAGAGGACAA AATAGACACT
CTCCTAAGCT AAAATTCCCA AGAAAGACTG TTTATTTTCC CCTAACTAAC TAGAACTAGC AACAGAAGAT
CTGAAAGGAA TTCTGGCTTT CAAGTGTTCC ATGTATGGAC TCATCAGGGA GGTCCGAGAG GCTTTGTGGC
CCCAGACTGA CTTTTCAGGA GGGGAAAGGA TTTATCAATA CACAAGACAG GCTCTAAGCA TTATTTTGTG
CCCTTTAAAA ATCCACTTTA TGAGCCAAAA AGTGAGTTAA TGATAATTCA TAGTTTCTGA CACATGCTCT
ATGCGTGGCT CTCTTTTCTC TATTCATTCT CTCTCTCTTC ATTTATTGTT AAATAAATAA TGTAATGAAT
GTTCTTCAGA CTGGCTGCTC CTTCAGGCCT CTGCTGAGGT GGTGATGGAG GCCAGCCCC TCTTCCTCAG
GTGCCATGGT TGGAGGAACT GGGATGTGTA CAAGGTGATC TATTATAAGG ATGGTGAAGC TCTCAAGTAC
TGGTATGAGA ACCACAACAT CTCCATTACA AATGCCACAG TTGAAGACAG TGGAACCTAC TACTGTACGG
GCAAAGTGTG GCAGCTGGAC TATGAGTCTG AGCCCCTCAA CATTACTGTA ATAAAAGGTG AGTTGGTAAA
GGAAAGGAAA AGCATCCATA GCAGGGGAAG GAAGAGAGAA CTTCTGAGCC TGAGCAGTTG CAGCTTGTAG
AAGGGGGGCA CCTGTGATAC ACTGGAAAGC CTACCAGACT TGCAATGAGG AGACCTGGGT GATAGTATAT
ATCTCAATCT CTGTTTCAAA GCCTTGACTT GTTAAATGGT GATAGTAATA CCTGCTTGCA CTATGAAATT
TTTATGAAGA TTAATGTGGT AATATTTGTG AAATGACTTT GTAAACTGTT AAGCACTACC CAAGCATAAC
AGATTGTGAT TACTATTTTG ATCTCAAAGT CATCTGTTGC TCCTGGGGGA ACACTTATAT TTATCAAATT
GAAAAAAAGT TTCAAAGTTG AATGAAGAAA GGATATAAAG AGCTTGAGGA GCCCATTCCA GCTTAGGAGG
GCTGGGAAAG GAAACCAGCA AGTCAGTAAG CTGTGTGCCT GTGTATTGAG GGAGGAGGGA ATGGACTTGA
TATGGAGAGG GTAGGGAGGT GGACTGCCTC TATGGCCTGT AAGAAAAACT GCTCTCTCCA AACTCTTTAT
AAGAGAGGGA GCCTGTGAAG TATTCACTTT TGAAGGAGAA AGTTAGACTT TTCCTTCACA CACTTTGTAC
ATAATAATGT TTAAAAAAGC ATGAGGTCAA AATACATAAT TAAGTCCTAG CAGTTCTCTG TTAACTAATT
TGAGACTGAA GTGCTATGTA CTTGTCTCTA GGCTTCCAGT ATCTTCATCT GTAAAACAGA ATATTTGGTC
TAGATTCCAT TAGAATCATT TGATAACTTA AAAAATATAT TGATGCTCAT GTCTCATTTC TTGAGATTCT
GATTTAATTG GTTTGGGGTG CAGCCTGGGT ATACGTATTT TTCATAGGTC TTTCACATAA TGGTAATGGG
TAGCCAATAT TGAGAATCAC TTGTCTAGGT GATCTTTAAA TGATTTCTGG ATGTAATATT CTGAGGCTCT
ATAATTTGAG ACTAATCACA AAAATCGGTA CAGTTTATAA ACAGACTAAC AGAACCACAA AATAATAGAA
TTGGAAGGCA ATTTAACTAG TGCAATTTCT TCATTTTGCC TAACAGGCAT GTAAGAAATG ATGATTGATT
GAGTAATAGG CATTGATGAC CCCTGTCCTC ACTTTGTCCC CTTTCCACCC CTTAATTATA TGTGAATTCT
GGTCTTGTCA TTTCGAATAA GGGGTTTATC TTTCCTATTG TCTTCCCCTC TGGGCACGGC ACACTGGCTA
CTGGAGTTAA GAGGAAATGC TTAGGACTCC CTGTGGCTCC AGGGAGCACC AACAGAGCAA CTCAACCTAG
TGTTAATCTG AGTGTTTTCT CTGTGCTTCT GGATGCCACA TCACGCTAAA ATGAAGGAC AAAGCTTGGT
CTTTCTCTTA GGGAGGATGA AACTCTGAAC CTCATTTTTC AGTTCCCAAG ATGAATTATG TTTCTCATTG
CATCTGTGTT CCACTACAGC TCCGCGTGAG AAGTACTGGC TACAATTTTT TATCCCATTG TTGGTGGTGA
TTCTGTTTGC TGTGGACACA GGATTATTTA TCTCAACTCA GCAGCAGGTC ACATTTCTCT TGAAGATTAA
GAGAACCAGG AAAGGCTTCA GACTTCTGAA CCCACATCCT AAGCCAAACC CCAAAAACAA CTGATATAAT
TACTCAAGAA ATATTTGCAA CATTAGTTTT TTTCCAGCAT CAGCAATTGC TACTCAATTG TCAAACACAG
CTTGCAATAT ACATAGAAAC GTCTGTGCTC AAGGATTTAT AGAATGCTT CATTAAACTG AGTGAAACTG
GTTAAGTGGC ATGTAATAGT AAGTGCTCAA TTAACATTGG TTGAATAAAT GAGAGAATGA ATAGATTCAT
```

```
TTATTAGCAT TTGTAAAAGA GATGTTCAAT TTCAATAAAA TAAATATAAA ACCATGTAAC AGAATGCTTC
TGAGTATTCA AGGCTTGCTA GTTTGTTTGT TTGTTTTCTA CTAAAGGCAA GGACCATGAA GTTCTAGATT
GGAAATGTCC TCTCTTGACT ATTGCAAGTG CGATCTAGGA ATGAAAAGAC ATAGGAGGAT GCCAGTGAGG
TGGATCATTT TTATGCTTCT TCTTCAGCTT ACTAAATATG AACTTTCAGT TCTTGGCAGA ATCAGGGACA
GTCTCAAGAC ATAGGACTCT CAGGATGAAG TAGAGTCCAG GATTCCTCTG TGATTGTTTT GCCCCTCCCA
AATTTATATC TTGAACTTAT GTCTTGTATC TTTATACAGC ACCTGAACCA AGCATTTTGG AGAAATTCCA
GCTAATAATA ATAACCAAAA CCTTCGGCTC TGAAAACAGT CCAGGACTGA ATAAGATCTT GGGCAAAAGA
ACTAGACAGT TTTGGTTTAT TTTCCCTTTC ATTTTATGTC TTCATCATAG TCATTGGAGG CTCATTCTTC
TTGTCATGGA GTAAATGGGA TTAAAGTTC TACTAAGAGT CTCCAGCATC CTCCACCTGT CTACCACCGA
GCATGGGCCT ATATTTGAAG CCTTAGATCT CTCCAGCACA GTAAGCACCA GGAGTCCATG AAGAAGATGG
CTCCTGCCAT GGAATCCCCT ACTCTACTGT GTGTAGCCTT ACTGTTCTTC GCTCCAGATG GCGTGTTAGC
AGTCCCTCAG AAACCTAAGG TCTCCTTGAA CCCTCCATGG AATAGAATAT TTAAAGGAGA GAATGTGACT
CTTACATGTA ATGGGAACAA TTTCTTTGAA GTCAGTTCCA CCAAATGGTT CCACAATGGC AGCCTTTCAG
AAGAGACAAA TTCAAGTTTG AATATTGTGA ATGCCAAATT TGAAGACAGT GGAGAATACA AATGTCAGCA
CCAACAAGTT AATGAGAGTG AACCTGTGTA CCTGGAAGTC TTCAGTGACT GGCTGCTCCT TCAGGCCTCT
GCTGAGGTGG TGATGGAGGG CCAGCCCCTC TTCCTCAGGT GCCATGGTTG GAGGAACTGG GATGTGTACA
AGGTGATCTA TTATAAGGAT GGTGAAGCTC TCAAGTACTG GTATGAGAAC CACAACATCT CCATTACAAA
TGCCACAGTT GAAGACAGTG GAACCTACTA CTGTACGGGC AAAGTGTGGC AGCTGGACTA TGAGTCTGAG
CCCCTCAACA TTACTGTAAT AAAAGCTCCG CGTGAGAAGT ACTGGCTACA ATTTTTTATC CCATTGTTGG
TGGTGATTCT GTTTGCTGTG GACACAGGAT TATTTATCTC AACTCAGCAG CAGGTCACAT TTCTCTTGAA
GATTAAGAGA ACCAGGAAAG GCTTCAGACT TCTGAACCCA CATCCTAAGC CAAACCCCAA AACAACTGA
TATAATTACT CAAGAAATAT TTGCAACATT AGTTTTTTTC CAGCATCAGC AATTGCTACT CAATTGTCAA
ACACAGCTTG CAATATACAT AGAAACGTCT GTGCTCAAGG ATTTATAGAA ATGCTTCATT AAACTGAGTG
AAACTGGTTA AGTGGCATGT AATAGTAAGT GCTCAATTAA CATTGGTTGA ATAAATGAGA GAATGAATAG
ATTCATTTAT TAGCATTTGT AAAAGAGATG TTCAATTTCA ATAAAATAAA TATAAAACCA TGTAACAGAA
TGCTTCTGAG TAAAAAAAAA AAAAAAAAA AAAAAAA TCTCAATATA ATAATATTCT TTATTCCTGG
ACAGCTCGGT TAATGAAAAA ATGGACACAG AAAGTAATAG GAGAGCAAAT CTTGCTCTCC CACAGGAGCC
TTCCAGTGTG CCTGCATTTG AAGTCTTGGA AATATCTCCC CAGGAAGTAT CTTCAGGCAG ACTATTGAAG
TCGGCCTCAT CCCCACCACT GCATACATGG CTGACAGTTT TGAAAAAAGA GCAGGAGTTC CTGGGGGTAA
CACAAATTCT GACTGCTATG ATATGCCTTT GTTTTGGAAC AGTTGTCTGC TCTGTACTTA ATATTTCACA
CATTGAGGGA GACATTTTTT CATCATTTAA AGCAGGTTAT CCATTCTGGG GAGCCATATT TTTTTCTATT
TCTGGAATGT TGTCAATTAT ATCTGAAAGG AGAAATGCAA CATATCTGGT GAGAGGAAGC CTGGGAGCAA
ACACTGCCAG CAGCATAGCT GGGGGAACGG GAATTACCAT CCTGATCATC AACCTGAAGA AGAGCTTGGC
CTATATCCAC ATCCACAGTT GCCAGAAATT TTTTGAGACC AAGTGCTTTA TGGCTTCCTT TTCCACTGAA
ATTGTAGTGA TGATGCTGTT TCTCACCATT CTGGGACTTG GTAGTGCTGT GTCACTCACA ATCTGTGGAG
CTGGGGAAGA ACTCAAAGGA AACAAGGTTC CAGAGGATCG TGTTTATGAA GAATTAAACA TATATTCAGC
TACTTACAGT GAGTTGGAAG ACCCAGGGGA AATGTCTCCT CCCATTGATT TATAAGAATC ACGTGTCCAG
AACACTCTGA TTCACAGCCA AGGATCCAGA AGGCCAAGGT CTTGTTAAGG GGCTACTGGA AAAATTTCTA
TTCTCTCCAC AGCCTGCTGG TTTT AAGCTTTTCA AAGGTGCAAT TGGATAACTT CTGCCATGAG AAATGGCTGA
ATTGGGACAC AAGTGGGGAC AATTCCAGAA GAAGGGCACA TCTCTTTCTT TTCTGCAGTT CTTTCTCACC
```

```
TTCTCAACTC CTACTAAAAT GTCTCATTTT CAGGTTCTGT AAATCCTGCT AGTCTCAGGC AAAATTATGC
TCCAGGAGTC TCAAATTTTC TTATTTCATA TTAGTCTTTA TTTAGTAGAC TTCTCAATTT TTCTATTCAT
CACAAGTAAA AGCCTGTTGA TCTTAATCAG CCAAGAAACT TATCTGTCTG GCAAATGACT TATGTATAAA
GAGAATCATC AATGTCATGA GGTAACCCAT TTCAACTGCC TATTCAGAGC ATGCAGTAAG AGGAAATCCA
CCAAGTCTCA ATATAATAAT ATTCTTTATT CCTGGACAGC TCGGTTAATG AAAAAATGGA CACAGAAAGT
AATAGGAGAG CAAATCTTGC TCTCCCACAG GAGCCTTCCA GGTAGGTACA AGGTATTATT TTTTTCTACC
CTCAGTCACT TGTGGCAGGG GAAGTCATAG TCACGGTGCT TAGGAGATGA AACTTTATTG ATTTAGGCAT
GGATCCATCT AGTTTAATTA ATATATTGGG TATGAGGAAG CTACTTGCTG TACTTTCCAT GTGGTTCTCT
CTCCCTGGAG AGGAACATTT TTACTCAGCT TGCAAACTGG AAATAGATTT CTCACATTA GAAGCTCATT
TTCTGGGTAT GAGACAGGAG AGTTCATACT GTGTATGTAG ATCTCTGGCT TCTGGGTCTG ACATGTGCTG
AGGGACACAT ATCCTTCACA CATGCTTTTA TAAATACTTG ATAAAGTAAC CTGCTTCTTG ATTGGTCTTT
ATAATCCATA AGCTGTGGGA TGCTTCTCTG AAGATGAAAA TAGTAATAGA GTCCCATCTA GCTATTCAAA
GCCATTCCTT CATTGTATTC TGTGCACATG AAGTTGGGGT TTGTTACTGA CAAAATATAT TCAGATACAT
TTCTATGTTA AAAGGATTGT GAGATGCATA GGTAAATGTG TTTATTTTCA GTTTTACTTG TCAACATAGA
TGAATGAGAA AGAACTTGAA AGTAACACTG GATTAAGAAT AGGAAAATTT GGCATGGATT TTGCTCCATT
TTGTCCCATC TAATCACTTG GATAGTGTTC AGGTGTTCTT GGTCAGTTAC TTGGATGCTC TGAGCTTTAG
TTTCTTGGTG ATTACAATGA AGATTTGAAT TACAGGATGG CTTTGAAAAA ATAAACAAAA CTCCCCTTTC
TGTCTGTCGA GAATGTTGCA CAGGGAGTTA CAGAATGTTC TCATGACTGA ATTGCTTTTA AATTTCACAG
TGTGCCTGCA TTTGAAGTCT TGGAAATATC TCCCCAGGAA GTATCTTCAG GCAGACTATT GAAGTCGGCC
TCATCCCCAC CACTGCATAC ATGGCTGACA GTTTTGAAAA AAGAGCAGGA GTTCCTGGGG GTGAGTGAGC
CTCCTCCAAC TTTGACTAGA GTAAGGGTTG GGTCTAGAAA AGAATATTGA GTTGCATCAA CTGTTTTCCC
ACTTGGATTC ATGAGAGGTG TTAGGTCCTT TAAAAAACAT GGTAGATAAA GAGTTGCAC TAACTGGGTC
CTTTTGGGAA GAGCCAGAAG CATTTCCTCA TAAAGACTTT AAATTGCTAG GACGAGAATG GCCAACAGGA
GTGAAGGATT CATAACTTTA TCTTTACTTA GATGTAAAGA ACAATTACTG ATGTTCAACA TGACTACATA
CATAAAGGCG CATGGAGAAA AGTATTGGCC TTCCATGCAT TAGGTAGTGC TTGTATCAAT TCTTATAGTG
GCTAGGGTAT CCTGGAAAAT CTTACGTGTG GATCATTTCT CAGGACAGTC TAGGACACTA ACGCAGTTTC
TCATGTTTGG CTTCTATTAT TAAAAAATGA TACAATCTCG GGAAAATTTT TTTGATTTTC ATGAAATTCA
TGTGTTTTTC TATAGGTAAC ACAAATTCTG ACTGCTATGA TATGCCTTTG TTTTGGAACA GTTGTCTGCT
CTGTACTTGA TATTTCACAC ATTGAGGGAG ACATTTTTTC ATCATTTAAA GCAGGTTATC CATTCTGGGG
AGCCATATTT GTGAGTATAT ATCTATAATT GTTTCTGAAA TAACACTGAA CATAGGTTTT TCTCTTTCTC
AGATCTAACC AGTTGTTTAT TCCCAGTATT AAGATGATAT TTATAATTCT TAATTATAAA TATATGTGAG
CATATATAAC ATAGATATGC TCATTAACAA CAACAAAAGA TTCTTTTTAC AATTAACGGT GGGTTAAACA
TTTAGCCCAC AGTTTTATCC CATGAGAAAC CTGAATCTAA TACAAGTTAA ATGACTTGCC TAAGGGCCAC
TTGACTAATA GTAATTGAAC CTAAACTTTC AGAATCCAAC TCCAGGAACA TACTTCTAGC ACTATTCATC
AATAAAGTTA TATGATAAAT ACATACAACT TTATCTGTCA ACTAAAAATA ACAACAGAGG CTGGGCATGG
TGGCTCACAC CCGTAATCCC AGCACTTTGG GAGGCTGAGG CAGGTGGATC ACCTGAGGTC AGGAGTTTGA
GACCAGCCTG ACCAACATGG TGAAACCTCA TCTCTACTAA ATATAAAAAA TTAGCTGAGT GTGATAGTGC
ATACCTGTAA TCCAGCTACT TAAGAGGCTG AGGCAGGAGG CTTGTTTGAA CCTGGAAGGC AGAGGTTGCA
GTGAGCTGAG ATTGTGCCAT TGCACTCCAG CCTGGGCAAT AAGTGCGAAC TCTGTCTCAA AATAATAATA
```

-continued

```
ATAATAATAG AAAATAAAGT TGTCTTCATG AAAAATGAGG AAAGAGATTG CTGGGGTGAG AAACATTAAG
ATCAATGGGC ATATGGTGAC CTTCTATGCC CTAGAAACTC TTTTANGGTA TTTTCTCCTG GTATCTCTTT
TACNCATCGT TCTATCTGGA AAAATAGGTG GATGAGTGAG ATAATAACGG TATATACTTT TTAAAGGTCT
AATTGACATA TATAAATTGC AAGTATTTCA GATGTCAATT TGCTAACCTT GACACACATA GACACACATG
AAAACATCAC CACATTAATA CAATGTATGT ATCCATCATT CCAAAAGCTT CCCTGTGTAT CTTTGTAACT
CTTTCTTCCT CCCTCCACTC CTTGTCCTCT CGTTCCCAAG AAAACATTGA TCTGCTTCCT GTGAATATAA
ATTAACTTAC ATTTTTTAGA GCTTTATATA AGTATGTTCT CTTTACTGTT TGTCTTCCTT CGCTGCACAG
TTATTTTGAG ATTCTTCAAG TTTTTTCTTT ATATCGATAC TTCATTCACA AGAATATATT TTAATTCTAG
ACTATGTCAC ATTGACTTTG TCGTCTGCTA AATCCTTAGT GCTCAGATGA CTTGTTCAGG ACTCTCCTTG
AACCTGTACC TCTGTTANAT TGAAACTTGT CTCTACTGTC TTTTTATTTC AAACACAGCT TATTAGGTGT
CTCTCAACCC ATCAAACNCA CAATCTGAGT CTTTAGGAGA TTGCTTTGAA TTTGTGCTAT TGACTTATAT
NTATATNAAA TNTGTAAATG TTTGGTAAAA ATATCATCAT GTACNTTTTC ATAATTACGC TATNTNCACA
TGATATATGT CAGACTCTGG AAATATGCAT GCCACAGACA CGTGTTTCTT GCCTAAAGGG GCTGATGGAA
GACNCACATA CNAATAGACG ATTGCAGTAG AATGAGAGTG GTGGTCTAAN CAGTACATGT CCTGATGTTG
CTCGGACAGT TACTACNCCA AGAGTACCCC CTGCATTGTC AGGGTTAGCA TCTCCTGGAA GCCTCATGTA
AATGAAGAAT TCATGCTCC ATCCAGGACC TAATGAATAA GAATCTGCAT TTAGCAAGA CCCTCATATG
ATTCATATAC ACTTTTTTTT TTTTTTTTA GATGGAGTCT CACTCTTGTC GCCCAGGCTG GAGTGCAATG
GCATGATCTT GGCTCACTGC AACCTCTGCC TCCCGGGTTC AAGTGATTCT CCTGTCTCAG CCTCCCTAGT
AGCTGGGACT ACAGGTGCAT GCCACAGTGG CTGGCTAATT TTTGTATTTT TAGTAGAGAC AGGGTTTCAC
CATTTTGGTC AGGCTGGTCT TGAACTCATG ACCTCCGGTG ATTCCCCGC CTCGGCTTCC CAAAGTGCTG
GGATTACAGA CATGAGCCAC CACACCCGCC TTATTCGTAT ACNCATTTAA TTCTGAGAAG CACTCTATAG
AAAATAAGAA TAAGAAAATA TTGGGCTCAC AGGTGACATT AATAAGTAAC TTTATCGAGT ACCCCAAATT
TTACCTATGT TTGGAAGATG GGGTTAAAAG GACACATTGA AAACAAGAAC TCATTGTGGC TTTTTTTTCC
TCCTTTTTGA ACAGTTTTCT ATTTCTGGAA TGTTGTCAAT TATATCTGAA AGGAGAAATG CAACATATCT
GGTGAGTTGC CCGTTTCTGT CTTTGTCCAT CCTTGAAAAG ATAAGAAGAA CAGAGTTTTA AGAGTCTTAA
GGGAAACACA TCTTTGTCTC CTATATTACT TGTGAATGTG GATATATGAT TTTGTTTCAA TCTATTTTGT
GTCCTAAGGC TTTTTGCAAC AGAAGTTGGA TATATCATTA GAAACATAAA TTGTACCATT TAACATACAT
GAAGTTTATG TTTACCTTGA CGTTCTTCTA AAAAGTGTCC TACACCGGCA TTGTCCTTGT AGGCATATTC
ACATGATCAA ATAAAATAAT TAGTTTTCAA TTAAGGAGAA TATTTGAGGA AAGACCGTAC GTGTTCATGT
GGTTCCTGAA GGCAGTCCAG TGAGAAAGTA ATATATGCTT CATTAAACAA TGCGGACATT TTCAGGGTTT
CCCTTTTTAA CCAAAATTTG GAAGCAATGT GGAATTTACT GGATGCATCC AGCCCTGAAA TGAAGATAGG
TTTATTGAAT GTGCCAGCAA GTGCAGGCCC AGGTCTGAGT GTTCTTCATT ATTATCAGGT GAGAGGAAGC
CTGGGAGCAA ACACTGCCAG CAGCATAGCT GGGGGAACGG GAATTACCAT CCTGATCATC AACCTGAAGA
AGAGCTTGGC CTATATCCAC ATCCACAGTT GCCAGAAATT TTTTGAGACC AAGTGCTTTA TGGCTTCCTT
TTCCACTGTA TGTATTTTTT TTTGTGTGGG AAGACTAAGA TTCTGGGTCC TAATGTAAGT AAGAAGCCCT
CTTCTCCTGT TCCATGAACA CCATCCTTTT CTGTAACTTC TATTACACAG TATAGTGGTT CTGTAAGTTC
ACACAGCCCA GGGAGATGCT GGCTGCCCAC TCCCCTCAAC CCAGGCAAAT TCCTCGGGGT TAAAGTTATC
TACTGCAAGT GACGATCTCT GGGTTTTTCT GTGCCTGTGT TTGTGTGTGT GTGTGTGTGT GTGTGTGTGT
GTATGTGTCA CTTTAAAAGG ACTGGTCAGA TGGTAGGGAG ATGAAAACAG GAGATGCTAT AAGAAAATAA
ACTTTTGGGG CGAATACCAA TGTGACTCTT TTTGTTTGTC ATTTGTTGCT GTTCAATAGG AAATTGTAGT
```

```
GATGATGCTG TTTCTCACCA TTCTGGGACT TGGTAGTGCT GTGTCACTCA CAATCTGTGG AGCTGGGGAA

GAACTCAAAG GAAACAAGGT AGATAGAAGC CCGATATAAA ATCTTGAATG ACAGGTTAAC GAATTGGAGC

TTTATTCCTT AAAATATGGC CTGGGTTTTC TGAAACATTT CTTCCAGAAA ATAGTTTCTC CAAGTTTTAT

TACTTTGGTT TACAAATCTC ACATTTAAAT CACATTTTAT ACCATAAGTA GCACACATTT CATAATATTC

CTCTGAATGA GGGTTGGGAT AATAGGACTG ATATGTTAGA AATGCCTTAA AGTGTGTGGA GCATGAGAGA

TGGATGTACA GAAGGCTTGT GAGGAAACCA CCCAGGTATC TGGCCTTGTT TTCTGCCCCA GAACTAGCCG

CCTATTCCTG TTTCTGTTTT ATTCCTTTGT TTCTTGACTT TTCCTTTCCA ACTTGCTCTA AAACCTCAGT

TTTCTTTCCT TTCTGATTCA TGACTACCAA ATGTTTTCAC TTGCCTCACC CGTCCATTAC ACCTTTGATA

AGAACCACCA GACCTTGTGC TCATGTACTT GCCCATGTCT GATGGAAGAA ACATACTCTC TCCATCTGTC

CACTTTCCTG AGGCATTCAA GTCTAGCCAC CTTTTAAAAT CACTCTCCTC CAGGCTGGGC ACGGTGTCAC

GCCTGTAATC TCAGCACTTT GTGAGGCTGA GGAGGGCGGA TCACTTGAAG TCAGGAGTTC AAAACCAGCC

TGGCCAAATG GCAAAACCAA ATCTTCTTCA ATTATAACCA AATCTTAAAC CAAATCTCTA CTAAAAAATA

CAACAAAACA AAACAACAAC AACAAAAACA GAAAAGGAAA CATTAGCCCA GCGTGGTGGC AGGTACCTGA

GGTTCCAGAT ACTTGGGAGG CTGAAGCAGG AGAATCGCTT GAGCCCAAGA GATGGAGGTT GCAGTGAGCC

GAGATCATGC CACTGCACCA CAGCCAGGGT GACAGAGCCA TACTTCCCAG CACATTGGGA GGCCAAAGCT

GAAGAATAAT TTGAGGTGAG GATTTGGAGA CCAGCCTGGC AACATGGTG AAACTCCGTC TGTACTAAAA

ATATAAAACT TAGTGGGGCA TGGGGGCACA CACCTGTAAT TTCAGCTACT TAGGAGGCTG AGGCAGGAGA

ATTGCTTGAA CCCGGGAGGC GGAAGTTGCA GTGAGCCAAG ATCGTGGCCA CTGCACTCCA GCCTGGGTGA

CATAGTGAGA TTCTGTCTCA AAAAAAATAA AAGAAATTTA AAAATCACT CTCTTCCAAA GATAGATAAA

TAAGACAGCA GATATACTAA GGAATAACCT CACCAACTTG TCATTGACTG ACATGATTTC TTTTGGCCCA

CTTGGCCAGC TAGTCTGGTT TGGTTTTCTG GAAATGAAAG AAATAATCAG AGTTTAATGA CAGAGAGCGT

GAGACCCAGA AAGACAAAAG TAGATGAGGT AAGTCTCTTG AGCGAGACTT CTAGGGATGG GAAATTTGTG

GTGATTGATA TGAAATGATT TTTCCCTTAT CAGGTTCCAG AGGATCGTGT TTATGAAGAA TTAAACATAT

ATTCAGCTAC TTACAGTGAG TTGGAAGACC CAGGGGAAAT GTCTCCTCCC ATTGATTTAT AAGAATCACG

TGTCCAGAAC ACTCTGATTC ACAGCCAAGG ATCCAGAAGG CCAAGGTTTT GTTAAGGGGC TACTGGAAAA

ATTTCTATTC TCTCCACAGC CTGCTGGTTT TACATTAGAT TTATTCGCCT GATAAGAATA TTTTGTTTCT

GCTGCTTCTG TCCACCTTAA TATGCTCCTT CTATTTGTAG ATATGATAGA CTCCTATTTT TCTTGTTTTA

TATTATGACC ACACACATCT CTGCTGGAAA GTCAACATGT AGTAAGCAAG ATTTAACTGT TTGATTATAA

CTGTGCAAAT ACAGAAAAAA AGAAGGCTGG CTGAAAGTTG AGTTAAACTT TGACAGTTTG ATAATATTTG

GTTCTTAGGG TTTTTTTTTT TTTTAGCATT CTTAATAGTT ACAGTTGGGC ATGATTTGTA CCATCCACCC

ATACCCACAC AGTCACAGTC ACACACACAT ATGTATTACT TACACTATAT ATAACTTCCT ATGCAAATAT

TTTACCACCA GTCAATAATA CATTTTTGCC AAGACATGAA GTTTTATAAA GATCTGTATA ATTGCCTGAA

TCACCAGCAC ATTCACTGAC ATGATATTAT TTGCAGATTG ACAAGTAGGA AGTGGGGAAC TTTTATTAAG

TTACTCGTTG TCTGGGGAGG TAAATAGGTT AAAAACAGGG AAATTATAAG TGCAGAGATT AACATTTCAC

AAATGTTTAG TGAAACATTT GTGAAAAAAG AAGACTAAAT TAAGACCTGA GCTGAAATAA AGTGACGTGG

AAATGGAAAT AATGGTTATA TCTAAAACAT GTAGAAAAAG AGTAACTGGT AGATTTGTT AACAAATTAA

AGAATAAAGT TAGACAAGCA ACTGGTTGAC TAATACATTA AGCGTTTGAG TCTAAGATGA AAGGAGAACA

CTGGTTATGT TGATAGAATG ATAAAAAGGG TCGGGCGCGG AGGCTCACGC CTGTAATCCC AGCCCTTTGG

GAGGCCGAGG TGGGCAGATC ACGAAGTCAG TAGTTTGAGA CCAGCCTGGC AACATAGTG AAACCCCGTC
```

```
TCTACTAAAA ATACAAAAAA AAAATTAGCT GGGTGTGGTG GCAGTCACCT GTAGTCCCAG CTACTTGGGA
GGATGAGGCA GGAGAATCGC TTGAACCTGG GAGGCGGAGG TTGCAGTGAG CCGAGATCGC ACCAGTGCAC
TCCAGCCTTG GTGACAATGG GAGACTCCAT CTCAAAAAAA AAAAAAAAAA AAAAAAGATA AAAAGTCAGA
AATCTGAAAA GTGGAGGAAG AGTACAAATA GACCTAAATT AAGTCTCATT TTTTGGCTTT GATTTTGGGG
AGACAAAGGG AAATGCAGCC ATAGAGGGCC TGATGACATC CAATACATGA GTTCTGGTAA AGATAAAATT
TGATACACGG TTTGGTGTCA TTATAAGAGA AATCATTATT AAATGAAGCA AGTTAACACT CTAAGAGAAT
TATTTTGAGA TAGAAGTGAA GCTAAGCTAA ACTTCACATG CCTATAATTG GAGGGAAAAA CTAAGGATAA
AATCTAGCCT AGAAGATACA ATAATTAGTC ATAAACATGC ATTGTGAAAC TGTAGAGAGC AGGTAGCCCA
AAATAGAGAA AGATTAGATA AAGAGAAAAT AAGTATCCAT CAGAGACAGT ATCTCTAGGC TTGGGCAAGA
GAAAAGTCCA CAGTGATAAG CAACTCCACC TAAGGCATGA ATATGCGGCA GAGAAAACAG CAATAGTGAA
TGAATGCAAA AGGTGCTGAG CAAATTCCAC ACATGAGTAT TGTGCATGAG TAAATGAATA AAACATTTGC
AAAGACCTTT AGAGAAAGAG AATGGGAGCA TATGTGCGAA ATAAGATAGT TGATTATGAA TAGAAGGTAG
TGAAGAAAAG CAAGCTAAGA AAAAATTCTG TTTATAAAAG AAGGAAAAGA TAGTTTATGT TTTTAGCCTA
AGTATAAGAG TCCTACAGAT GGACTGAAAA AAATCAGTCT GAGAGTATTA GTCACAATTA ATGAAATAAT
TACATTTTAT GTATTGAGGA TGCCAAGATT AAAAGGTGAC AGGTAGATGT TAATTTCCCT AGATTGTGAA
AGTGATCACG ACAATCACAC AACAAATAAT TAAGTGACTT GGTATGCTTT ATTTAATTGT AGGGCCTGAG
GTTTTCCATT CTCATTTTTC TAAAATACAA TTTTGTTTCT CCAAATTTGA CAGCAGAATA AAAACCCTAC
CCTTTCACTG TGTATCATGC TAAGCTGCAT CTCTACTCTT GATCATCTGT AGGTATTAAT CACATCACTT
CCATGGCATG GATGTTCACA TACAGACTCT TAACCCTGGT TTACCAGGAC CTCTAGGAGT GGATCCAATC
TATATCTTTA CAGTTGTATA GTATATGATA TCTCTTTTAT TTCACTCAAT TTATATTTTC ATCATTGACT
ACATATTTCT TATACACAAC ACACAATTTA TGAATTTTTT CTCAAGATCA TTCTGAGAGT TGCCCCACCC
TACCTGCCTT TTATAGTACG CCCACCTCAG GCAGACACAG AGCACAATGC TGGGGTTCTC TTCACACTAT
CACTGCCCCA AATTGTCTTT CTAAATTTCA ACTTCAATGT CATCTTCTCC ATGAAGACCA CTGAATGAAC
ACCTTTTCAT CCAGCCTTAA TTTCTTGCTC CATAACTACT CTATCCCACG ATGCAGTATT GTATCATTAA
TTATTAGTGT GCTTGTGACC TCCTTATGTA TTCTCAATTA CCTGTATTTG TGCAATAAAT TGGAATAATG
TAACTTGATT TCTTATCTGT GTTTGTGTTG GCATGCAAGA TTTAGGTACT TATCAAGATA ATGGGGAATT
AAGGCATCAA TAAAATGATG CCAAAGACCA AGAGCAGTTT CTGAAGTCCT CCTTTTCATC AGCTCTTTAT
CAAACAGAAC ACTCTATAAA CAACCCATAG CCAGAAAACA GGATGTAGGA ACAATCACCA GCACACTCTA
TAAACAACCC ATAGCCAGAA AACAGAATGT AAGGACAATC ACCAGCCATC TTTTGTCAAT AATTGATGGA
ATAGAGTTGA AAGGAACTGG AGCATGAGTC ATATTTGACC AGTCAGTCCT CACTCTTATT TACTTGCTAT
GTAAACTTGA GAAAGCTTTT TTCTCTTTGT GAACCTCAGG TTTTACATCT GAAAATGAGA AATTTGGAAC
AAAAGATTCC TAACTGGTCT TTCTGTTCCC ATATTCTGTG ATTTTTCAAT ATTTAGGATT TTTGGTAATC
ACAATTACTT AGTTTGTGGT TGAGATAGCA ACACGAATCA GAACTATTTG GTGGACATAT TTTCAAAGGA
GTAGCTCTCC ACTTTGGGTA AAGAAGTGAT GCNGGTCGTG GTGGCTCACG CCTGTAATCC CAGCACTTTA
GGGAGGCCAA GGCGGGTGGA TCACGAGGTC AGGAGATCGA GACCATCCTG GCTAACACGG TGAAACCCCG
TCTCTACTAA AAAATACAAA AAATTAGCCA GGCGTGGTGG CGGGCGCCTG TAGTCCCACG TACTCGGGAG
GCTGAGGCAG GAGAATGGCA TGAACCAGGG AGGCGGAGCT TGCCGTGAGC CGAGATAGCC CACTGCAGT
CCCTCCTGGG CAAAAGAGCA AGACTGCGTC TCAAAAAAAA AAAAAAAAAA AAAAAAGAA GTGTGTGGAG
TAGCAGGACA CCTGCAACAA TAATATTTTT CTAAATCCCT CTGAAAAATG CTAATCAAAG GGTTTTTTTC
CTAAAAATTG TCTTAGAAAT AAAATTTCCC CTTTGGGAGA CCGAGGCTGG CAGATCACGA GGTCAGGAGA
```

```
TAGAGACCAC GGTGAAACCC CGTCTCTACT AAAAATACTA AAAATTAGCC GGGGNGTGGT GGTGGGTACA
CCTGTAGTCC CAGCTACTTG GAGGCTGAGG CTGGAGAATC ACGTGAAC GCCACGTGCT GCTGGGTCTC
AGTCCTCCAC TTCCCGTGTC CTCTGGAAGT TGTCAGGAGC AATGTTGCGC TTGTACGTGT TGGTAATGGG
AGTTTCTGCC TTCACCCTTC AGCCTGCGGC ACACACAGGG GCTGCCAGAA GCTGCCGGTT TCGTGGGAGG
CATTACAAGC GGGAGTTCAG GCTGGAAGGG GAGCCTGTAG CCCTGAGGTG CCCCCAGGTG CCCTACTGGT
TGTGGGCCTC TGTCAGCCCC CGCATCAACC TGACATGGCA TAAAAATGAC TCTGCTAGGA CGGTCCCAGG
AGAAGAAGAG ACACGGATGT GGGCCCAGGA CGGTGCTCTG TGGCTTCTGC CAGCCTTGCA GGAGGACTCT
GGCACCTACG TCTGCACTAC TAGAAATGCT TCTTACTGTG ACAAAATGTC CATTGAGCTC AGAGTTTTTG
AGAATACAGA TGCTTTCCTG CCGTTCATCT CATACCCGCA AATTTTAACC TTGTCAACCT CTGGGGTATT
AGTATGCCCT GACCTGAGTG AATTCACCCG TGACAAAACT GACGTGAAGA TTCAATGGTA CAAGGATTCT
CTTCTTTTGG ATAAAGACAA TGAGAAATTT CTAAGTGTGA GGGGACCAC TCACTTACTC GTACACGATG
TGGCCCTGGA AGATGCTGGC TATTACCGCT GTGTCCTGAC ATTTGCCCAT GAAGGCCAGC AATACAACAT
CACTAGGAGT ATTGAGCTAC GCATCAAGAA AAAAAAAGAA GAGACCATTC CTGTGATCAT TTCCCCCCTC
AAGACCATAT CAGCTTCTCT GGGGTCAAGA CTGACAATCC CGTGTAAGGT GTTTCTGGGA ACCGGCACAC
CCTTAACCAC CATGCTGTGG TGGACGGCCA ATGACACCCA CATAGAGAGC GCCTACCCGG GAGGCCGCGT
GACCGAGGGG CCACGCCAGG AATATTCAGA AAATAATGAG AACTACATTG AAGTGCCATT GATTTTTGAT
CCTGTCACAA GAGAGGATTT GCACATGGAT TTTAAATGTG TTGTCCATAA TACCCTGAGT TTTCAGACAC
TACGCACCAC AGTCAAGGAA GCCTCCTCCA CGTTCTCCTG GGGCATTGTG CTGGCCCCAC TTTCACTGGC
CTTCTTGGTT TTGGGGGAA TATGGATGCA CAGACGGTGC AAACACAGAA CTGGAAAAGC AGATGGTCTG
ACTGTGCTAT GGCCTCATCA TCAAGACTTT CAATCCTATC CCAAGTGAAA TAAATGGAAT GAAATAATTC
AAACACAAAA AAAAAAAAA AAAAAAA GCCGGAGCCG ACTCGGAGCG CGCGGCGCGG CCGGGAGGAG
CCGAGCGCGC CGGGCGCGGC GTGGGGGCGC CGGCTGCCCC GCGCGCCCAG GGAGCGGCAG GAATGTGACA
ATCGCGCGCC CGCACCGTAG CACTCCTCGC TCGGCTCCTA GGGCTCTCGC CCTCTGAGCT GAGCCGGGTT
CCGCCCGGGC TGGGATCCCA TCACCCTCCA CGGCCGTCCG TCCAGGTAGA CGCACCCTCT GAAGATGGTG
ACTCCCTCCT GAGAAGCTGG ACCCCTTGGT AAAAGACAAG GCCTTCTCCA AGAAGAATAT GAAAGTGTTA
CTCAGACTTA TTTGTTTCAT AGCTCTACTG ATTTCTTCTC TGGAGGCTGA TAAATGCAAG GAACGTGAAG
AAAAAATAAT TTTAGTGTCA TCTGCAAATG AAATTGATGT TCGTCCCTGT CCTCTTAACC CAAATGAACA
CAAAGGCACT ATAACTTGGT ATAAAGATGA CAGCAAGACA CCTGTATCTA CAGAACAAGC CTCCAGGATT
CATCAACACA AAGAGAAACT TTGGTTTGTT CCTGCTAAGG TGGAGGATTC AGGACATTAC TATTGCGTGG
TAAGAAATTC ATCTTACTGC CTCAGAATTA AAATAAGTGC AAAATTTGTG GAGAATGAGC CTAACTTATG
TTATAATGCA CAAGCCATAT TTAAGCAGAA ACTACCCGTT GCAGGAGACG GAGGACTTGT GTGCCCTTAT
ATGGAGTTTT TTAAAAATGA AAATAATGAG TTACCTAAAT TACAGTGGTA TAAGGATTGC AAACCTCTAC
TTCTTGACAA TATACACTTT AGTGGAGTCA AGATAGGCT CATCGTGATG AATGTGGCTG AAAAGCATAG
AGGGAACTAT ACTTGTCATG CATCCTACAC ATACTTGGGC AAGCAATATC CTATTACCCG GGTAATAGAA
TTTATTACTC TAGAGGAAAA CAAACCCACA AGGCCTGTGA TTGTGAGCCC AGCTAATGAG ACAATGGAAG
TAGACTTGGG ATCCCAGATA CAATTGATCT GTAATGTCAC CGGCCAGTTG AGTGACATTG CTTACTGGAA
GTGGAATGGG TCAGTAATTG ATGAAGATGA CCCAGTGCTA GGGGAAGACT ATTACAGTGT GGAAAATCCT
GCAAACAAAA GAAGGAGTAC CCTCATCACA GTGCTTAATA TATCGGAAAT TGAAAGTAGA TTTTATAAAC
ATCCATTTAC CTGTTTTGCC AAGAATACAC ATGGTATAGA TGCAGCATAT ATCCAGTTAA TATATCCAGT
```

-continued

CACTAATTTC CAGAAGCACA TGATTGGTAT ATGTGTCACG TTGACAGTCA TAATTGTGTG TTCTGTTTTC
ATCTATAAAA TCTTCAAGAT TGACATTGTG CTTTGGTACA GGGATTCCTG CTATGATTTT CTCCCAATAA
AAGCTTCAGA TGGAAAGACC TATGACGCAT ATATACTGTA TCCAAAGACT GTTGGGGAAG GGTCTACCTC
TGACTGTGAT ATTTTTGTGT TTAAAGTCTT GCCTGAGGTC TTGGAAAAAC AGTGTGGATA TAAGCTGTTC
ATTTATGGAA GGGATGACTA CGTTGGGGAA GACATTGTTG AGGTCATTAA TGAAAACGTA AAGAAAAGCA
GAAGACTGAT TATCATTTTA GTCAGAGAAA CATCAGGCTT CAGCTGGCTG GGTGGTTCAT CTGAAGAGCA
AATAGCCATG TATAATGCTC TTGTTCAGGA TGGAATTAAA GTTGTCCTGC TTGAGCTGGA GAAAATCCAA
GACTATGAGA AAATGCCAGA ATCGATTAAA TTCATTAAGC AGAAACATGG GGCTATCCGC TGGTCAGGGG
ACTTTACACA GGGACCACAG TCTGCAAAGA CAAGGTTCTG GAAGAATGTC AGGTACCACA TGCCAGTCCA
GCGACGGTCA CCTTCATCTA AACACCAGTT ACTGTCACCA GCCACTAAGG AGAAACTGCA AAGAGAGGCT
CACGTGCCTC TCGGGTAGCA TGGAGAAGTT GCCAAGAGTT CTTTAGGTGC CTCCTGTCTT ATGGCGTTGC
AGGCCAGGTT ATGCCTCATG CTGACTTGCA GAGTTCATGG AATGTAACTA TATCATCCTT TATCCCTGAG
GTCACCAGGA ATCAGG-3'(SEQ ID NO: 3002)

Human Enzyme-related Antisense Polynucleotide

5'- CTT GCT CCT GGG GGC CTC CTG GTC CCT CTG GCT G TT CCC GGC CCT GGB CTG GGG CBG GGG CCG CGT
BGG CGC GGC TCG CCB GGB CGG GCB GCG CCB GCB GCB GCB GGC TCB GCB TCC TGG CCB CGG BBT TCC GGT
GTG CGG GGC CTG GTG CC CCT GGG CCT CGG GTG CTG CCT GT GCG CTG CCT TCT TCT CCT GG GTC CTC GCC
GGG GCC CTT GCT GCC CTG GCT GT GCC CTG GGG GTC TGG GTT CGG CTG T CCC CBG CBG GBC CBG TCC CBT
CCB CBG CGT GTG BTG BGT BGC CBT TCT CCT GCB GCC GBG GGG CGC GGG CGB GCB TCG C TTT GGG CTT
TTC TCC TTT GGT T TGB GCG CCB GGB CCG CGC BCB GCB GCB GGG CGC GGG CGB GCB TCG CBG CGG CGG
GCB GGG GGCTCCCGC CGCGBGBGGT TBTGGGCTCC CBGGBCCBCC CGCBCCGCGC GGBCGTTTBC
BTTCGCCBCG CBGTGCGCGG CCGBCBTGBC GBBGTTGGGC GCBBTCBGGG TGGCGCCGCB GBBGTGGCCT
CCGCGCBGCT GCBGGGBCBC CBTGBBGGGC CBCGCGTGGG GCCGCGCTCG CCGGCCCCCC BCBBTCTCCG
BGGCCBGCGC GGTGCCCCCC BGCBGCBBGG CCGGCBGGBC BCBGGCGBGG BGBCBCGCGB GTCGGCGGCC
GBGGGTCBTG GTGGGGCTGG GGCTCCGGGG TCTCTGCCCC TCCGTGCTGG TGGGGCTGGG GCTCCGGGG
TCTCTGCCCC TCCGTGCCGC GTGGGGCCGC GCTCGCCGGC CCCCCCCTGC CGGGTGGGCT CCCGCCGCGC
GCCGGCCTGC CGGCCCCTCG TGGGTCCTGC TGGCCGGGTC CGGGTCCCGG GGGTGGGGCG CGBGTCGGCG
GCCGBGGGTC CCCTCCBCBT CTGCTCTGBC CTGCTGGBCT CTGGBTCTGB BGBTBCGCCB TGTBGGGGCG
GGBGTGGGGC CTGCTCTCCC GGCCTCCGBT GBTCTCCCCT GCCTCBGCCC CBGTGGGTBG GBGBBBGGCC
GBCBGBBGCB GGBGTGGCTG CBTCTTTCCT GGTGGGGCCT GCTCTCCCGG CCTCCGTGTG TTGCTGGGTG
TTTTCCCGTC TCTGGTCTGC CTTCGGGGGT CGT CCGGGGCTGC BGCBBCCTCB TCBGCTCTTG CCTGGBGTGG
CTCBGCCTGG GCCTGCBGGG CCBCCBGGBG BBTGGCBGCB BGGBTGGCGB GGGTCCTCBT GGCTGGGGTC
BCBGBTCCTC TBGCTBGGCB GGGTGBCCBG BGBGGGC GGG TCC TCB TGG CTG GGG GCC TGG GCC TGC BGG
GCC GCT CTT GCC TGG BGT GGC TC GCC CBG BGT CTT CCC TGG T CGCTGCBBTC TGCTCCGGGG CTGCBGCBBC
CTCBTCBGCTC TTGCCTGGBGTG GCTCBGCCTGG GCCTGCBGGG CCBCCBGGBGB BTGGCBGCBBG GBTGGCGBGGG
TCCTCBTGGC TGGGGTCBCCT GGBGGBGGGB GBGCBGGGGG TCCTCBTGGC TGGGGTCCCT CTCTCCCGTC CT
CGG TTT CCT TTG CGG TC TTG GCC CGG GCT CCG GGT G CCC GCC CGC CCG CCG GCC GCC GC CCC GCC GGG
CTG TCC CCG CCC CGC CCC GGC CCG GGG CGC GGG GG CGG CCC TCC CGC CCC TCT GG GCC GGC GCG GGC
GTC GG CCG CTC GCG CCT GGG GTT CCC TCT CCT CCC CCT GTG C GCC TGC CTC TTG CTC TTCTGC GTC CGC
TGC CTT CTC CC CTC TCC TCG GCC GTT GCC TGT GC TGT CCG TCC TGT CGC CCT TCC GTG GTG C TGT TGT

CTC TTC TGC CCT C GGT GTG CTG GTG CTG GTG GTG GTG CCT CTG CCC GTG CTC GCCCTG CCT GGG CTG
GCC TCT TCG GGT GTG GCT TTG GGG CTC TCT TGG TTG CCC TTT CTT CTC GTG GTG CCT CTC CTC CCT GGC
TTG GTC GT TGT CTG GGG TGG TGC TCC TCT CCC TTT CCC TGC TGG CCG TTT GT CCT GTT TTC TGT CTT CCT
CT TTC CTC CTG TTT CTC CGT TTG GCT TGC TGC TTG CGG GGC TGT CTC C CTT GCC CCT GTG GGC TTT CCC
TGG TCC GGT CTT CTC CTT GGG GGT C GCC CTT CTT GGT GGG CTGGCT CGT CTG TCT TTT TCC TTC C TGG
GGG TGG CCG TTG TGG GCG GTG TGG TCC GCC T TGC CTC TGC TGG TCT TTC CTCGGTBGBC GCGCTCGBBC
TCGGGTGGGC CGGTGGTGBG CGGCGGCGBCB CGCGGBBGGC CCTGCGCGCC GBGBTCBCCTG CBGGGBGBBG
TBGGCTTGCB GCBGGBCTCC CBGGBGGGTG BCBGCBGCCB GTBGBGCTBC CTCGTCCTTC BTGGTBCCGT
CGGTGTGGTG GCBCGGGCTG TGTGTGBBGG CGBGCTGGGC CCCGTCTGCT GCTCCTCGTG CCGCCTCGTC CTTCA
TGG TA CCGTCGGTGT GGTGGCCTCG GGTGGGCCGG TGGTGGGGCG CGCGCGCTCG CGTGGCTCCG GCTCTTCTTT
CCCGGCTCCGT CGGCCCGGGG GCCTTGGTCT CCCTCGTCCT TCBTGGTBCC G BCCGGCGGBG CCGCCBGGGT
GGBCTGGGBG TGGGTTTCTC CCCGCCGTTC TCBCCCBCCG CGCTGBGCTC BCGCCTBBG BCTGCTGTTT
CTGGBGCTCC TTGGCBBGCC BCBBBCBGCB GBGBGBBBBT CBTGBGCBBB TBBTCCBTTC TGBBBBBBBG
GGBTCBBBBB CCTCCCGTTC CCCGTTCGCC TGGCGCGCGC TGCGGGTTCC TCGTGGGTTT CTCCCCGCCG
TTCTCCGGTC TGTTGCCTTT GTGGGCTTCT TGTCTTTTTG GCTGTTCTTT TCCTGCTTGG CGTCTTTTCC
TTTCTTTGTG CTCGGTTGTG GGTCCGCTGG TCCTTTGCCC TGTGTGTTTC TGCTGCCCGT TCGCCTGGCG
CGCGCTGCGG GTTCCTCGTG GGTTTCTCCC CGCCGTTCTC CGGTCTGTTG CCTTTGTGGG CTTCTTGTCT
TTTTGGCTGT TCTTTTCCTG CTTGGCGTCT TTTCCTTTCT TTGTGCTCGG TTGTGGGTCC GCTGGTCCTT
TGCCCTGTGT GTTTCTGCTG GGBGCTGBTB CTGCBGATTT CBGBGGGBBG BBCCCTGBTB CTCBCCBGCT
TCBGCTCTGG BGCBCBBGBG BBBGBGCBGC BGGGGBGBG GBBGBBGCBG CBTCTTCCCB GBGBGGCTGC
CTGBGCBBBT GCTGGTTTTC CTTTCCBGTC TTGGGTTTTB BBCTCCCBG BBGGCBBGBG BGGGGCBBGG
CGTTTTCTTC TCTCGCTGGT TTTCCTTTCC TGGCAGTGGG TGGGGTGGG GGTGGGGTGG CTTCCTTGTT
CCTGGGGGTG TCCTCTTGCT CTGGGCTTTT CTCCCCTTTT CCTTCCTGTC TGTTTTCCTG GGGCTCTCCT
CTGTCTCTGT GTCCTTGCCC TGGCCCTCTT CCCTCTCCTG TCTCCTGTCC CTGTGTTCCG CCCGTCTTCC
CTCTCCTGAC CTCCTTTTCC TCCGCTGGGT GGGGCCCTGC CTGTTCTCTG CTCCCTGGCT TGGGGTTTCT
TCTGTGTGTC TTCTTCCTCT GTTGGCTGGC TTTCTCCTTC TTTTGTCTTC CTGGGTGCCC CTTCTTCCTT
TCTTGGGTCC TTGGTGCTTG GGCTGGG GCGTCTTGGG GTGCBGGGCC CBTCCTGCTG CGCCTGGGCG
CTGCTGTGCG TCCGTCTGCT GGGGGCCGG GGTGGCTGGG CCCTGCTTGC CGCACGACCC CGGGCCGACC
CGAGGCTCGG GGGGCTGTGT TCTGGCGCTG GTGGGCTTGG GCCCCTCTGG GGGCTGGGTT CCTGCTGCG
CCTGGGCGCT GGCGTCTTGG GGTGCGGGGC CGGGGGGCCG GGGGGCCGCT GTTCGTGGGC CTGGGGGTGC
CTGTGGCTGC CGGTTGCCCC GGTTGGTGGC GCCGTCCTGC TGCCGGTCGT TGGCTGGGTC CCCCCGCCCG
TTTCCTGGGG TCCGCGTGGG GTGCTCCGGT TCCTCGTGCC GCTGCTGCCT TGTCTTTCCG GCCGTGGCGG
CGTGGTGGTC CGCCCCCCCT GGCCTTCTGC TCGGGTCTG GCTGGTTGCC GGTGCCCTTG GCGGCGGTCT
TCTTCCTGGT GGCTCTGGGC CCGGCCGGTC TCGGGCGTCT CGTGTTCGCT CTTGTGCTGT TCCGGCCGCT
CCTTCCTCTT CCGCCGCCGC CGCTCCCCGC CCGCTCGTCG CCCTGGCCCG GCCTCCTCCT GGCCGCTGTC
TCGGCGGCG GCCTTGGCGC TCCGTTTGGG GCTGCCTCTG GCGCTTCCGG CCCTCGGCCT GGGCGCTCTC
TTCCGCCTGT GCTGGTGGCC CTCGTGGGCC CCTCCTGGCC TCCGGTGTCC TGTGGTCCCC CGGCTGGTGG
CCGGGCCGGT TGGGCGGGCG TGGGCGCCGG CGGGTCCTCC GGGCTGCCCT TCTCCGCCGG GGGTCCCGCG
CTCCTGCTGT TCCCTGGGCT CTTCTGCCTC TCTCCTGGGT GGGTGCTGGG TGCCGGGGTC TCCGGGCTTG

```
CCCCGCGCTG CTGGGCGTTC TGCGGTCTTG GGGTTGTCTG TGGCCCCGCT CGTGTCGCCC TCCGTCGCCC
GTCGCCGGCC TCGTCCCCTC CTGGGTGCGC GGCGGGCTGG TCCTGGCGTT TTGCTCCTTC CTGGGCGTCT
TGGGGTGCBG GGCCCBTCCT GCTGCGCCTG GGCGCTGCTG TGCGTCCGTC TGCTGGGGGG CCGGGGTGGC
TGGGCCCTGC TTGCCGCACG ACCCCGGGCC GACCCGAGGC TCGGGGGGCT GTGTTCTGGC GCTGGTGGGC
TTGGGCCCCT CTGGGGGCTG GGTTTCCTGC TGCGCCTGGG CGCTGGCGTC TTGGGGTGCG GGGCCGGGGG
GCCGGGGGGC CGCTGTTCGT GGGCCTGGGG GTGCCTGTGG CTGCCGGTTG CCCCGGTTGG TGGCGCCGTC
CTGCTGCCGG TCGTTGGCTG GGTCCCCCCG CCCGTTTCCT GGGGTCCGCG TGGGGTGCTC CGGTTCCTCG
TGCCGCTGCT GCCTTGTCTT TCCGGCCGTG GCGGCGTGGT GGTCCGCCCC CCTGGCCTT CTGCTCGGGG
TCTGGCTGGT TGCCGGTGCC CTTGGCGGCG GTCTTCTTCC TGGTGGCTCT GGGCCCGGCC GGTCTCGGGC
GTCTCGTGTT CGCTCTTGTG CTGTTCCGGC CGCTCCTTCC TCTTCCGCCG CCGCCGCTCC CCGCCCGCTC
GTCGCCCTGG CCCGGCCTCC TCCTGGCCGC TGTCTCGGGC GGCGGCCTTG GCGCTCCGTT TGGGGCTGCC
TCTGGCGCTT CCGGCCCTCG GCCTGGGCGC TCTCTTCCGC CTGTGCTGGT GGCCCTCGTG GGCCCCTCCT
GGCCTCCGGT GTCCTGTGGT CCCCCGGCTG GTGGCCGGGC CGGTTGGGCG GGCGTGGGCG CCGGCGGGTC
CTCCGGGCTG CCCTTCTCCG CCGGGGGTCC CGCGCTCCTG CTGTTCCCTG GCTCTTCTG CCTCTCTCCT
GGGTGGGTGC TGGGTGCCGG GGTCTCCGGG CTTGCCCCGC GCTGCTGGGC GTTCTGCGGT CTTGGGGTTG
TCTGTGCCC CGCTCGTGTC GCCCTCCGTC GCCCGTCGCC GGCCTCGTCC CCTCCTGGGT GCGCGGCGGG
CTGGTCCTGG CGTTTTGCTC CTTCCTGG CTGCCCCBGT TTTTGBTCCT CBCBTGCCGT GGGGBGGBCB
BTGGCTGCCT CCCCGGGGTT TCTGCTGCTT GCTGCTTCTT TCCCGTCTCC CTTCTTTCCC GTCTCCTTTT
TGCCTCTTTG GGTTCCTGTT GTTTCTGGCC TGCTTGGTGG CGGCTTGTGC GTTTCCTCTC TCTTCTCTTG
GGTCTCCGCT TCTCGTCCTG CCTTTTCCTG TCTCTGTCGC GCCGTTCCTC CTCCGGCGTC CTCCTGCCCT
GTGCTGTTTG CCTCGGGTGG TGCGGGTCCC GGTGCTCCCC CGGCGGGCCG GCTGGTTGCC TGGGCCTGTC
TGGTGGGGTG TGGGGCCGCT GGGTTGGGGG TGTGGTGGGC TCTTCTGTGG CCTGTGGGGC TGTTGGTGTC
TCTGTGGGCG TGTGCTGGGT CTTGGGGCTT CCTCCCTTGT GCTGGGTGCG GCCTCCCCGC CCCCCTTCTG
GGCCGGTGGC CTGGCTCCTT GTGGGCGCTT CTGGCTCTTG CCCTGTCCTT CTTCGCCTCG TGGCTGCTGG GCTGC
GCCGCCGCCG CCAAGATGGC GGACCTGGAG GCGGTGCTGG CCGACGTGAG CTACCTGATG GCCATGGAGA
AGAGCAAGGC CACGCCGGCC GCGCGCGCCA GCAAGAAGAT ACTGCTGCCC GAGCCCAGCA TCCGCAGTGT
CATGCAGAAG TACCTGGAGG ACCGGGGCGA GGTGACCTTT GAGAAGATCT TTTCCCAGAA GCTGGGGTAC
CTGCTCTTCC GAGACTTCTG CCTGAACCAC CTGGAGGAGG CCAGGCCCTT GGTGGAATTC TATGAGGAGA
TCAAGAAGTA CGAGAAGCTG GAGACGGAGG AGGAGCGTGT GGCCCGCAGC CGGGAGATCT TCGACTCATA
CATCATGAAG GAGCTGCTGG CCTGCTCGCA TCCCTTCTCG AAGAGTGCCA CTGAGCATGT CCAAGGCCAC
CTGGGGAAGA AGCAGGTGCC TCCGGATCTC TTCCAGCCAT ACATCGAAGA GATTTGTCAA AACCTCCGAG
GGGACGTGTT CCAGAAATTC ATTGAGAGCG ATAAGTTCAC ACGGTTTTGC CAGTGGAAGA ATGTGGAGCT
CAACATCCAC CTGACCATGA ATGACTTCAG CGTGCATCGC ATCATTGGGC GCGGGGCTT TGGCGAGGTC
TATGGGTGCC GGAAGGCTGA CACAGGCAAG ATGTACGCCA TGAAGTGCCT GGACAAAAAG CGCATCAAGA
TGAAGCAGGG GGAGACCCTG GCCCTGAACG AGCGCATCAT GCTCTCGCTC GTCAGCACTG GGGACTGCCC
ATTCATTGTC TGCATGTCAT ACGCGTTCCA CACGCCAGAC AAGCTCAGCT TCATCCTGGA CCTCATGAAC
GGTGGGGACC TGCACTACCA CCTCTCCCAG CACGGGGTCT TCTCAGAGGC TGACATGCGC TTCTATGCGG
CCGAGATCAT CCTGGGCCTG GAGCACATGC ACAACCGCTT CGTGGTCTAC CGGGACCTGA AGCCAGCCAA
CATCCTTCTG GACGAGCATG GCCACGTGCG GATCTCGGAC CTGGGCCTGG CCTGTGACTT CTCCAAGAAG
AAGCCCCATG CCAGCGTGGG CACCCACGGG TACATGGCTC CGGAGGTCCT GCAGAAGGGC GTGGCCTACG
```

```
ACAGCAGTGC CGACTGGTTC TCTCTGGGGT GCATGCTCTT CAAGTTGCTG CGGGGGCACA GCCCCTTCCG
GCAGCACAAG ACCAAAGACA AGCATGAGAT CGACCGCATG ACGCTGACGA TGGCCGTGGA GCTGCCCGAC
TCCTTCTCCC CTGAACTACG CTCCCTGCTG GAGGGGTTGC TGCAGAGGGA TGTCAACCGG AGATTGGGCT
GCCTGGGCCG AGGGGCTCAG GAGGTGAAAG AGAGCCCCTT TTTCCGCTCC CTGGACTGGC AGATGGTCTT
CTTGCAGAAG TACCCTCCCC CGCTGATCCC CCCACGAGGG GAGGTGAACG CGGCCGACGC CTTCGACATT
GGCTCCTTCG ATGAGGAGGA CACAAAAGGA ATCAAGTTAC TGGACAGTGA TCAGGAGCTC TACCGCAACT
TCCCCCTCAC CATCTCGGAG CGGTGGCAGC AGGAGGTGGC AGAGACTGTC TTCGACACCA TCAACGCTGA
GACAGACCGG CTGGAGGCTC GCAAGAAAGC CAAGAACAAG CAGCTGGGCC ATGAGGAAGA CTACGCCCTG
GGCAAGGACT GCATCATGCA TGGCTACATG TCCAAGATGG GCAACCCCTT CCTGACCCAG TGGCAGCGGC
GGTACTTCTA CCTGTTCCCC AACCGCCTCG AGTGGCGGGG CGAGGGCGAG GCCCCGCAGA GCCTGCTGAC
CATGGAGGAG ATCCAGTCGG TGGAGGAGAC GCAGATCAAG GAGCGCAAGT GCCTGCTCCT CAAGATCCGC
GGTGGGAAAC AGTTCATTTT GCAGTGCGAT AGCGACCCTG AGCTGGTGCA GTGGAAGAAG GAGCTGCGCG
ACGCCTACCG CGAGGCCCAG CAGCTGGTGC AGCGGGTGCC CAAGATGAAG AACAAGCCGC GCTCGCCCGT
GGTGGAGCTG AGCAAGGTGC CGCTGGTCCA GCGCGGCAGT GCCAACGGCC TCTGACCCGC CCACCCGCCT
CCAGGAAGCT ACCTGGAGGA GGTGAGTCTT AGCGGATGAG TAGGAGTTGT CCACGGAGGA AGGTACACAG
AAGGGCTTCC AGGCCCAGGA AACAGCAGAG GCACAGAAGT GAGAATGGGT GGGTGAGTTG GTGGGAAAC
TCCAGGTGCA GAGGATGGTA GCGAAACAAA CTGGAGCATT AAGGTCCAAG TCCTCCAAGA TCTTGACTTG
CAGATTAAGG AGTTTGTTCA CCTAATCTGC TTTGGGCAGA GTGTGGTGAG TCCTAGAGAC CCCTCTAGGT
CTCTCCTCTC AGTAGCCCCA GAAGGCCTGG AGAGCTGCTT CTGGGTGCCA AGCAGGCAGT GACTCCATCA
GATCTAGATT TGGGAAAAGC ATCCCTGGTC AGGGCCTGCA TCAGGGCAGT GGCTGGCCAT GAGGACCCTG
AGAAGTAGAC AGATTCACGG AGATTCTCAG GAGGCCAGAC AGGAGACTAT GGTGACAAAT TAGATTAGAG
AAGGGGAGAG AATGAAGGAG CAGTTGGGGT AAAAGAAAAC TGAGGCTGAC ATGGGTATAT GGGTGGCGAG
TGACTCACCA CCCACTGAGA GGAGAACCTC ACAAGCTCTG ACATGCTCTG GTTCCAGGTT CTGTTGGGGC
TGATCCAAGA TGGTAGCCTA GAGGTGCACA GAGATGGGGG CCTTGCTTTG CAAAAGGATG CTGGCTGCTG
GCCCACAGCA TGGTAATGAG ATTTGAGCTT TATGTGCCCA GGGCTGGGAG GAGGGTCCTG TCACTTTGAA
AGCAAAGAGA GGCTCTAGAG AGGGGCATGT TGAGATAGGA ATGCTGCCTT GAGACACCTG GCTTTCCCCA
CTCTGGGTGG CTCTCAGCAG GGTGGGTTTC CCCTGCCAGG CAGCACTGAA CCTCTGTGCG CTTCCGGCTG
GGAGAGTTTT TACCGTAACT ACATGTGGAA CCATCCTGAA GGAACATCTG ATGGGATGG GGTACAGGGA
AGGGAGCTGC CAAGAGTGCT GGCCAGGGAC CTGGGTCTAT GAGCTGGTTG GGGGGTGGGG TTGGGTGCAG
GGTACTTGAT CCTGAGTGGG CCTTCTGCGG CCAGGATTGG TTCTAGAGTA GGAGGGGTGG GATCGGGGAT
GGGGGAAGCC TGTAACTGCG CTGCAGTTGT CAGGTCCCAG GTTCTGGGTG ACCTACTAAG GATTCTGGGT
CCAGTGTGGG TCCCAGGTTA GACGTCCTAG TCCTGAGTCC GTGTCCACAG TTCTGGGTGT TGAGTCTAGG
ACAGTGATCT GGAGTTGACA GTCCAATCTA GGTCTGAGTC CTGACCCCAA GTCTAGAGTT CAGGGTCATG
GTAGTAGCCT AGGGTCAGAA TCAAGGTTGG GGTCAGTAAC CAGGATGGGA TCGAGGTCAT GGTCCAAAAT
CTGGATCTGG GGACCTGTTG GGGGTCTGAG GTGAGTGTCG CAGTCTGGGT ATGGCGTTGG AGACCCAGGG
CTGTGATCTG AGGTCATGGT TAGAGTCTCA GGTGGTGGGC CAAGGTTTGA GTCTGGGTC CTGTTTGGAG
TCTGGTGTCA GGTCGTGGAC TGCGTCCAAG GTCAGGGAGT CCGGGGTTAT AGCCAGGGTC TGAGATGAAA
GTCCAGATGA GTGTTCAGAG GTCTGAATCT GTGTCTTGGT GAGCGTCCAG GTTCCCTGTG ATCACGTTTG
GTGTCAGGGC TGCGGCCCGA CTGGGGAGCC TGGGATCCAG AGATGTGACC CGAGGTTGTG GTCAGAGAAT
```

-continued

```
GGGTCTCGGG TCGTCTTCGT GCCGGGTCCC TGTCGTGTTC CAGGCCCGGG TCTCCGTCCA GCATCGAGGG

CCGAGGTCAC GGCCAGGGTC TGAGCCCGCG GTCGCAGGTC TGGTTCGGGG TCAGATTCCG CGCGGCCTCC

AGGGGGCGCC GTCGCCGCCC GGCTCGGCCC CTCGCGGGCT CGCTGGCGTT GTGCGCGGCA GGCGGGGCCG

GAGGCGGCGG CGGCTCCGGG GGCGCGGGCC GGGCGGCGGC GGCGGCGGCG CCCCGACTGC AGTCCCGGCG

GGAGCGGAGC GCGAAGCGCG GGGCCGGGCC CGGAGCCGGC GCCATGGGGC GGCGCCGCCT GTGAGCGGCG

GCGAGCGGAG CCGCGGGCGC CGAGCAGGGC CAGGCGGGAG CGTCGGCGCC CGAGGCCGAG CGAGCCGCGG

CCGGGCCGGG CCGAGCGCCG AGCGAGCAGG AGCGGCGGCG GCGGCGGCGG CGGCGGGAGG AGGCAGCGCC

GCCGCCAAGA TGGCGGACCT GGAGGCGGTG CTGGCCGACG TGAGCTACCT GATGGCCATG GAGAAGAGCA

AGGCCACGCC GGCCGCGCGC GCCAGCAAGA AGATACTGCT GCCCGAGCCC AGGTGAGGAG AAGCT

TCCCAGTTAA TACATAATCA ATATGCAATT TATTAATACA TCTCTCCATG TCCACTCCCC CTGTATCTTG

CCATTCTTGA CCTGCATTTC CATCCTCCTT ACCTTCCCTA GAGGCCAACT CATTTTCTTT GAAAAACCTG

GCATTTCCCA GAAAAAAAAG TGAAGGGCTG GGAGCTGTCC GTTGTCCTGA TTTGCTCCCT CTGCCCTTGC

TTCCAAATGT GGTTGGAAAG AAGCACTATT GAAAAATCCC TAAACGCACC CCTGCAGGGT TGGCTCTACC

CTGTAGCCAT GGACACATGC TGTTGATACC ACCTGCCTCA TGAGTCTCAC ATAATTTGCC CTTTCACACT

ATCTACCCCA TCAGCCTTAC CAAAACCATA CCTGCATCCT GGGCAGCATC TGCCCTTCAA GAGACTAAGG

AATCTCCTTG CAACCAAGAA TGACTAGACC AATGAGACAC CCTTTAAGGC CCCAGCACAA TATAGAAATC

CCACAATATG GTAATCCCAG TAAGGAGCTA TCAAGCCATT GCAGGACCAT CTAGAATACA ACTAGAGTAT

AGTTCCTTTC AATCCAGGAA CTATACTCTA ACAGCTTGGC TCACAGGAAC CAGAAGTGAA GATGATGAGG

ATCAGGGCTG AGCCTGTGAG CACCAGCTCC ACCACTGACA CCAACCACAG ATTAAACAAG CATCTTGTGG

ACCCCTGGGA TGGAAAGAAT AGTTGTTGCC TTATCAACCT CCCCCACAGC CCACACAGAA AAGATAAAAT

CATCATGGCT ACAGTGTTAC AGAAGATGAT GACCCAAGGA GTAGGCCTGC CTGAGTGAAT GCTGAGAGTG

ATAATGGGAG CAGTAGCATC TCAGAGACTA CAGCAGAAAC CATCCACATA AGAGCTTTG CCCAAACTTA

TGATAAAGGG CACCCTCAGA GACTCTCCCT ACTTTAATAT TAGCCCATTG CAGAAATGGT GAGTGGAAAG

AGAAATCTTA GGAAGAACCC CTTAAAAAAG CAAAATGCTT TTTAGGTTTG TGCTGAAGAG CCTGGAAAAG

AAATAAGGAC ACACACGCTG AGAAATCTTC CTCCTGCCCC AACACTGGGA TAATCTCCAA GGATCTCTCC

ATATCTCATT CTCCTGGATA CACTGTCCAC TCAGAAATAT TGTGCAGAGT GCAGTAATTC AAAAGTGAGC

TATTGTGTTA GGAGTGAAGG CAAGAGTATC GTAAATAAA TCAAATTTGA AATGAATTCT CTTAAATTGC

TTTATAGATG TTTAATGTAA GCCAGCAGCT ATTAAACGAT AAACCTTAAA TTCGAGAAAA ACTTGGTCAT

TCAGAAACTA TAGAAACAGG CAGGACTTAT TGCGAGGGCA AACACAGAGT GAGCTCCAGC CTGCTTCAGG

AAAATCTGCC AGTGCCATGA AGGATGTACT CTGTCTGCTC CACTGCACTA CTGCTCAGTA TGAGCCCATG

CCATCAGCTG TCCCTGACCC ACAGGAGTTC TTTAGAAGAG ACTGGTCAAC AAAAGTTTCT AGGGTGTTTT

ATACCTGCCA ACTCGAGGGT TAAAACAAGT TGCATAGAAA TGCTCAATCA AGAAAGACAC AGTCATTACT

CAGAGAATAA TAAACAGCCT GGCAGCACAT GAATGAATAG AAAAAAGATG TTACATGCAA AGCATGAAAT

AACCAAATTC CATAACAGAT GTTAATCTGT AATGTGTTTA GGAGAATTTA GAGGAAGTAT AAGATTTATT

CTTTCATCAA AAAATTATA GCCAATGAGG ATATATCTAT CAATTATCCA TCAAGTGGTG ATATGGCAGC

ACAAGGTAAA ACACAAGGA ATAAAACCAA GGTTTATTAA GAACCAATCA TGTGGCATTT CACATTGAGC

ATCATATTTA ATTCTGAAAA AAATCCTTGT ACTGTATCAT TCTTCATATT TTATGGATGC AGTAACTAAG

GCTGAGAACT TTAAAATTTT TCCTAAGTTC AGACACATAG CTAAGTGGCA GAACCAAGAT TCAAACTCAC

CCCATCTAAC TGCAGAGCAA ACTGCATGCC TTAAATGTCA AAGTGAATAC TAGCACAGTT AATACAATGT

TTGGAAACTC AGAGAAGGAA TGATCCCTCT GCATTATAGT TACTAAGGAA TCATTGCCAT TATTTAAATG
```

```
CCAGTGCTTC TACATCAGGC CCAAATTTTC TGTCCTACTA ACTGTGAATC AAGACTTGAT TCAACCTCTA
CTTGAGTATC TGCCGCAATG AGAAATCACT TACCTCCACT AACCACACAT TTATTTTATA ACAACAGATT
GTTAGTAAGT CCTTTCTTAT ACATACTCAA CAGCTGCTTC CCAAGATGCT GTAGGATTAT GTCTAGAGTC
AAACTAGCCA GAAGCAATGT CCAAAATACA CCATAACACT GTGCAGCAAA GGTCCTACTA CCACTTGTTT
GGCCCAAACA TTCTAGGCAG CACTGGATAT CTGAATCATC AATTATTTCC ACAAACACTG ACCCCTCTAC
CAGTCACCCT CACTAGAAGA ATTAATTCCA CATGATAATA GCTCCCTCAT GTTACTCCCT TCTAAGTCAA
ATTGTACACC CCTTTATCTG ATTAACAGAG TCTAAGTCAC ATGACCTAAA TGCAAGAGAA CTGGGAATGG
ACGTTTGTGG ATTCTACCTT AGTAAGGCAA AGTTATCATT GGGAATTCCT CTAATACAGG AAGGGTGTTC
CAGAGACATT AAGGAGCCAT ATAAATGGAA AATGTCCACT ACAATCCATC ACTTGGTTGC CCCACATCAA
CATTCATTCT TTTGCCACAC TTAAAGTTTC CAAGAACAAA ATTATCCCA CTGAACATAA TCTTTACTAT
CTTTTATATA AAGGAAAATT AGACTTGACT CAGCAGAACT GAAATAACCC AGCTCTAACA GTTACTGCTT
TTAACTTCAA GTACTGTGTC TCTAGGTGAT ACCTGCTCCA ACAATAGTTT GGTCACATTT TCAATTTGAT
ATTCTCTAGT CTCCCAACTT GATAACTGTA CCCTAAACCA TAAAGTTCAC TACCAACATG CTATATATAA
AATAACCAAA GGGGGAAGAA GAAAGAGAAA AAGGAAATCT CTTAAAATAC ACAGGTATAC ATATGACAAA
GCAAAGAAGG AAATGTGAGC AGATAGTGCA GTCCTCGTTT CTGAAATTGG TCCCCTGACT GGGGCTATAC
CTATTCCATT TCCTCACCCT CAGCCAGGCA GGTGGAGCAA AAACTTAAGT CTTGGTGGAT CTGAATCTTG
ATGCTGTGGA GCTGTCTTAC TAGCCCCAGA CTACCTGCCT CTCAATTTCT AATTATATCA GTGAAAGCAA
ACAGCTTTGA TTTGTTTAAG CCTCTGATTT TTTGGTCTAA CTGATGTAAG ACCACAAGGA CAAGAGTTCT
CCAGCTCCGG ATTCTCTTCT GTTCTGTTAA TGGTGAAATG CCCGAGAGAA GAGTTGCCAA CTTTGGCAAA
TAAAAAATAC AGGATTCCAG TTAAATTCAA ATTTAGATAA ACAACAATTT TTTAGTATTA GTGTGTCCCA
TTCAATATTT GGACATACTT AACTAAAAAA TGATTTGTTG TTCATCTGAA ATACAAATTT AACTGGGCAT
TCTGAATATT CTCTGGCAAC CCCCGAGAGA GTGAAGAAAG TGGTACAAGG ACACTTAAGA AGACCAGATT
TGAAAAGACA TTACGGATGT GTTTAAATGT CTTATTCTAG AGAGAGTTAG AGCTGTAGGT AGAACTTGGG
AAATTAAGTT AAAAGCAGAC ACAGAGACCT GGCCAATATA TACTAAGGAG TGGATCACTC TGGTCACAAG
CCCAACCTGA GACCAAGGGC ATAGTGAGAT GATTTGGGAA AGGCACTTAT ACACTACTCA TCCCCGTCTT
TGAACTAAAT GCCTTATAAA TCTCCAAGAG AAATGACAGT CCACCATGTG GACTGCTTTC TGTAAGTCCA
GGGAAAATAA AAGCTATGTG CTTGAAACCC ACTTCTGATA TTATAAGGTG TGTGATCTTT GTCATGTTAA
TGGGTCTGAG TATCAATTCT ACAATTGTAA AGTGACAGTA ATGGTGTGTC CCCAGGTTGT TGTGGAAAGC
TTGATTCTTA ATGCAACAGT AGGAAACCCC AGCCTCTCTG GAGCAAACAC CCTTCTACAT CTTTACTTCC
CCTGCACATT GGCAGGACTC TATTCCTCTA TTTCTCTCTA GTGCTAGAGC AGAAAGGGAC CTTGATTTGA
TATCAGGAAA ATCTATTTCT GAACCATAAG CTATGATAGC TGATTTAAAA AATTGACTAT CATGACATGA
TAATGATCAT AATGGTAATA CATATTGATA GGGTTGCCGT GAAAGTAATA ATATATCTAA GAGTTGTGAC
AATATATGAT ACGCCTAGAC TCTCAGAAAA TGCTAATTCC AATCCCAATT GCTCTTTGCA TAAAGTTCTG
TCCTAGGGTC TGTTCTTTTC CCACATCTAC CCTCCTTGGA TCTCTCTTCT GTCTTTTTCA TGTGGTTCAG
AGGAGGAGAG AGATCCAGGT CAATGTTTTT CAAATTACAA GGAATTATCA TTTAAATGGG AAGAAGCTC
AAGTTTTGAC GTGTAGTGGA ATTGGAGTGG AGTGGAGTGG AATGGAAACT AACAGGAAGA CACTGCACAT
GGTTAAGATA AAGATTGTTT CCTGAAACCT TTAATTTGTG CTTACATACT CACACATACA TATGTGCATG
CACTGGGACT CTGCAATATG CATTTCTGAC TATGGAACAT AGCCATAAAA GTCTTTGCAC TGAACGTTCA
GTGGGCCTTT CACAAGCTGC CCTAATTGGG AAAGAAAAAC ATGGTCCCTC CATTTCCTGC CCCCAACTCC
```

```
AGAAAAGTCA CCATAGTTGA GGGTACATCT GAGAAGCCAG CACTTGGGAG TTCAGGGCTC AAGTTCCTTT
CTAGAAAAAC ACTGGGTGAT TCTAGGGGAA CTTCCGATCA GAAACAGCCA ATTCAGAGTG AGAGAAGAAA
ACGTGACCAT GCAGTTCCTG TGGTTACCAG CCTTGCCCCT CTCTTGCCTT CTGGGAGTTA TAAAACCCAA
GACTGGAAAG GAAAACCAGC ATTTGCTCAG GCAGCCTCTC TGGGAAGATG CTGCTTCTTC CTCTCCCCCT
GCTGCTCTTT CTCTTGTGCT CCAGAGCTGA AGCTGGTGAG TATCAGGGTT CTTCCCTCTG AAATCTGCAG
TATCAGCTCC TGAAACAAAG ATGTTTAGTC TGAAATAGCT GACTCCTAAA CAGGGTTCCA AGATCTCTCT
TCAAGAGTCC CACAGAGGAA ATTTCCACTT GGGATGTGTG CCACCCCACC CCCACCCCCA CCCACTGCCA
TTCTCTACAG CCTAGGACAC CCCCAGGAAC AAGGAATTTC ACCTCAATTG TAGAAAAGCC CAGAGCAAGT
GGAAGGAAAA GGGGTATCCC CAGGAAAACA GACATGTCCT CTTAATCTTC TGAGCATCAG GGCTACCCAT
TACTTTGTGA CTTTCTCACT CTGTGACCAT GCTCAAGAGC TATGGAGAAA TCTAAAACAG GAACCTGGAC
AGTGGGTCCT ACACAGAGAC AGAGGAGAGT GGGCCAGGGC AAGGTGGGAG TGGGAGAAGT CTGAGATGAA
AACATCAGAA TGGAGCAGAG GCAAGAATGA GATTTCACCT GGGAGGTTAT GGGTGGGGAA AGATACGAAA
TACAGGAGAC AGGAGAGGGA AGATGGGCGG AACACAGGGT GAGAATGAGA TTCCAGGGAA GCCTAGCTCA
GCTTTAACCC AATTTGTCCA TTCATTGGAG AGAGTATCTA TGGCCGTGTT CAAACCCTGG GGTGCTCTGT
TCCAGGGGAG ATCATCGGGG GCACAGAATG CAAGCCACAT TCCCGCCCCT ACATGGCCTA CCTGGAAATT
GTAACTTCCA ACGGTCCCTC AAAATTTTGT GGTGGTTTCC TTATAAGACG GAACTTTGTG CTGACGGCTG
CTCATTGTGC AGGAAGGTGA GACAACAGGG TCTATTTATC TCCAAATGGG AGATGAACAA CCAGAGTAGC
ATCCAGGAAT ACACCTGCAC TGGGGACTGA AGAGGGGGTC CTGGGTCTTG TCAACTTTCA GGAGAGGGAA
GACTTTGGGC TGAAAGACTT TAGTCTGTGT TTGAATAGTT CCTTGAGCCT CAGTCACTGA GCTAAGCTCC
CTTCGGAGGA AAAGGAGGTC CTGTCCGAAG GTCCCTCTTG TTGCAGTAGC ACCCCTCACC CCTACCCAAC
TCAAGACACA CGGCTCACTT TTCAGGGCCC CACCCAGTCT CAGGGCCACT TCCTCTATGG CCTTTTCAAG
AACACTGGCT CTAGTTCTCA GGGTCCTGAA CCCATCATTT TATGGGAGCA GAGAACAGGT CTACATAAGA
CCCCCACTTT CCCGTTTTAA CTGATATCTC CTGCTTCAGG GGCTGGCCCT CATGCAGGGT TCCCTGAATT
AGGAAGTGTG AACCCTGTCC CCTGAGTCCT CCCTGGCCTG TTCAGTCCCC AGCAATTCCA GGGGTCGTAG
AAATTGTGTC TGTTTCCTGA GAAAGCTCTT TCATGAGTTA AGCCTGAGCC CTCAAATGCC ACAAGTGGCC
CATGAAAAGG GAGATGGGTA GAGTCCGGCN ACCCAGTGAC AGAGTTTAGT CCTCTTTTCT CAGAATGAGC
TCACCTCAGA AGAAACCCCA AGCCATCACT GTCGCCTCCT TTTCCTTCCT TCTTCCTCAC AGCAGGTCTA
TAACAGTCAC CCTTGGAGCC CATAACATAA CAGAGGAAGA AGACACATGG CAGAAGCTTG AGGTTATAAA
GCAATTCCGT CATCCAAAAT ATAACACTTC TACTCTTCAC CACGATATCA TGTTACTAAA GGTGACAACA
CCTCTCTTCT CCCTTTCCAC TTCCCATTCT CCTAAGCTTC TCCTTCAGGT CCTCATTGCC CTGAATTTTT
CTTAGGACTT GGCTATAACA TGAAGCTACT CACCCTGTCC CTCCCTGATC ACCTCCAACT GTCCAGAGCC
CATTTCGAGG ACTGACAGTC CTTCATTCCC TTCACAGTTG AAGGAGAAAG CCAGCCTGAC CCTGGCTGTG
GGGACACTCC CCTTCCCATC ACAATTCAAC TTTGTCCCAC CTGGGAGAAT GTGCCGGGTG GCTGGCTGGG
GAAGAACAGG TGTGTTGAAG CCGGGCTCAG ACACTCTGCA AGAGGTGAAG CTGAGACTCA TGGATCCCCA
GGCCTGCAGC CACTTCAGAG ACTTTGACCA CAATCTTCAG CTGTGTGTGG GCAATCCCAG GAAGACAAAA
TCTGCATTTA AGGTGATCCT CCAACTAGGT TTCCTCTCCA AAACTCACTG TTCAGGGACC TGAATGCTCT
TAGAAGGAGA TGGGGTCAGC AGGTTGTCAG TCAGGTGACA GGGTGAGCAT CACAGGAATT GCTGTCCTCC
CGTGGTCCAA GACAGCCTCT GACCATCCAT TCCAGTCTAC TGCACTGGGG GCATGGGGTG ACTGTGGAGA
ATGTGGATGA CGGTCCCAAG AAAGGAAGAA GGGGCATCAG AACTAGATGT ATAAGTGAGG AGCTCCACCT
CCTGGGTCTG ACTTTAGGTC TCACTGTGAC TCCAAGCTGG CTGGCAGACA GGAGTGGAGG ACTTCCCGGG
```

```
CTCACCTTCT TCTCTCTCTC CTCCCCCTAC AGGGAGACTC TGGGGGCCCT CTTCTGTGTG CTGGGGTGGC

CCAGGGCATC GTATCCTATG GACGGTCGGA TGCAAAGCCC CCTGCTGTCT TCACCCGAAT CTCCCATTAC

CGGCCCTGGA TCAACCAGAT CCTGCAGGCA AATTAATCCT GGATCCTGAG CCAGCCTGAA GGGAAGCTGG

AACTGGACCT TAGCAGCAAA GTGTGTGCAA CTCATTCTGG TTCTACCCTT GGTTCCCTCA GCCACAACCC

TAAGCCTCCA AGAGGTCTCC TACAGGTAAC AGAACTTTCA ATAAACTTCA GTGAAGACAC AGCTTCTAGT

CGTGAGTGTG TGTCCCTCTC TGCTGCTCTC TTCTCCTGCA CATGTGACCT GATTCCCAGC CAAGCACCA AGGA

CACCGCTCCT GTCAGCCAAC AAATATCCAT TGAGCGACAC CTGTGTCCCA GGTGCTGCTC TGGGCCCTGG

GAGAAGTGCA TCAGTGGGCT TGGTAGTAGA GGGTAGGGAT GGAGTGAAGG GTAGGCAGGA AGAATGTCCC

CAGGCTGGTA GGAGGTGGGG TGGGGGGTTT CAGTCTCAAA ACTCCCATGA AAACCAGAGA GAAGTTTCAG

AACTCCACCC AAGAGGCTGG GTTTCTAGGG CCCAGAGCTG CCCTCCCCCA CCCTAGAATG GGCTATAAAA

GTCCCTTCCC AGCTACGTCC AGAGAAGAGC TGGAGGAAGT GAGAGGTCGG CTGGGGGTCC TCAAAGTGAG

AGGGGAGCAG AGGATCCTCC CGTGCAGGCT GTGGATGTCA CTCACTTCCC AGCTGGTGAA GCCTCGCTGC

AGAGATGCAT CTGCTCCCAG CCCTGGCAGG GGTCCTGGCC ACACTCGTCC TCGCCCAGCC CTGTGAGGGC

ACTGACCCAG GTAATAGTCC CCTAGACAGG CAAGGAGGAG GGAGGGGAAA TGGAAGGGGA AGCACTTGGG

TCTTGGAGGG GGTCTTGTGG CTTGCTGAAC CCTGAGTCCC CATCTCTTTG AACAGCCTCC CCTGGGGCAG

TGGAGACCTC GGTCCTGCGA GACTGCATAG CAGAGGCCAA GTTGCTGGTG GATGCTGCCT ACAATTGGAC

CCAGAAGAGG TGGACTTGGG TCTGGGGGCT GCATGGGCCT GGGAGGATCA GT TAATACCTTG TGGGGTCAGG

GAGCCCATGT CCCGTGCTGA TGTTATTTCC CCACCAGGTC CGGGCTGTCT CCAACCAGAT TGTGCGCTTC

CCCAATGAGA GACTGACCTC CGACCGTGGC CGAGCCCTCA TGTTCATGCA GTGGGGCCAG TTCATTGACC

ATGACCTGGA CTTCTCCCCG GAGTCCCCGG CCAGAGTGGC CTTCACTGCA GGCGTTGACT GTGAGAGGAC

CTGCGCCCAG CTGCCCCCCT GCTTTCCCAT CAAGGTACCT ACCCTCAGCC AATCTCCCAT GCCCTTGTGT

GGCCTCCCCC AAAGGCAAGG TGCTGGGGGT GGGGATCTGG AAGACTGGAG CACCATCCTT AAGGAGCTGC

CTGTGGAGCT AGGGTATGAG ACAGAGACAC AAG CACTGTCTCC TCTTCCATCT CAGATCCCAC CCAATGACCC

CCGCATCAAG AACCAGCGTG ACTGCATCCC TTTCTTCCGC TCGGCACCCT CATGCCCCCA AAACAAGAAC

AGAGTCCGCA ACCAGATCAA CGCGCTCACC TCCTTTGTGG ACGCCAGCAT GGTGTATGGC AGTGAGGTCT

CCCTCTCGCT GCGGCTCCGC AACCGGACCA ACTACCTGGG GCTGCTGGCC ATCAACCAGC GCTTTCAAGA

CAACGGCCGG GCCCTGCTGC CCTTCGACAA CCTGCACGAT GACCCCTGTC TCCTCACCAA CCGCTCGGCG

CGCATCCCCT GCTTCCTGGC AGGTCAGACA GGGAGGAAGG TGGTGTCTTC CCAGGAAACA GCCATCCCTG

GGTCCCAAC TGGGAAGCAA TGGTGGGATG TGGTGAAGGT ACATGGTTTG GGACCTCAGT ATTAGGCACA

CCATAAGCAT GGATCTGTGC AC TGAAGAGATG GAGGTCCAGT GAGGGCCAGG AGTTTGGCCC ACCCCGTCTC

TCCCATCCCC AGCCCTGGGT CTACCCTGGT AGAAAGACAT TTCTCTGGGA AAGGCTGCAG TAAATCTGAG

CTTGGGGTTT TCAAGGTGAC ACCCGATCAA CGGAAACCCC CAAACTGGCA GCCATGCACA CCCTCTTTAT

GCGAGAGCAC AACCGGCTGG CCACCGAGCT GAGACGCCTG AATCCCCGGT GGAATGGAGA CAAACTGTAC

AATGAGGCTC GGAAGATCAT GGGGGCCATG GTCCAGGTAA GGAGCTCTGC ATCCCAGCAT CCCCC CTTTGTATCT

CCACCCACCA ATAGTAAATT AATGTTGTCA CATTTGACGT GATGACAATA AAGAATATGT CTGAGCCACC

CTTTGAAAAG GCAAGGGTAT GGGTGAGTAG CCTCTGGGA ATGTTCCTCC TGTCTTCCCT TCCAGATCAT

CACCTACCGA GACTTTCTGC CCCTGGTTCT GGGCAAGGCC CGGGCCAGGA GAACCCTGGG GCACTACAGG

GGGTACTGCT CCAATGTGGA CCCACGGGTG GCCAATGTCT TCACCCTGGC CTTCCGCTTT GGCCACACAA

TGCTCCAGCC CTTCATGTTC CGCTTGGACA GTCAGTACCG GGCCTCCGCA CCCAACTCGC ATGTCCCACT
```

```
TAGCTCTGCC TTCTTTGCCA GCTGGCGGAT CGTGTATGAA GGTGACCAGG TTTTCCAGGG GGCAAATGGG
GGTGAGGGTG GGGAGCATGC CCTCCCCTAG GTGG TCCAGCTGCT TCATGTCTCT CCAGAACTCT GTTTCCTGAC
AAACGTTACT AACATACCCG ACTGGCTTGT CCAGCTCTGG GCTAGCTTGG CATCATGTGA TAACCCAAGT
AGCTTCCCAG AGGCTGGTCC AATCTGTGCT GCTCACATTC CCTGCCACCA GGGGGCATCG ACCCCATCCT
CCGGGGCCTC ATGGCCACCC CTGCCAAGCT GAACCGTCAG GATGCCATGT TAGTGGATGA GCTCCGGGAC
CGGCTGTTTC GGCAAGTGAG GAGGATTGGG CTGGACCTGG CAGCTCTCAA CATGCAACGA AGCCGGGACC
ACGGCCTTCC AGGTGAGGGG GCTGTCCACC TCTTCTCCCA GCTTTGCTCG GCCAGGCTG CTCAAGGGGT
TCTGGGAAGA CCCTGGTACC CGACTGCCTG GTAGGTTCTG GTGGCAGAAA CGAGGTGTTT TCACCAAAAG
ACAGCGCAAG GCCCTGAGCA GAATTTCCTT GTCTCGAATT ATATGTGACA ATACCGGTAT CACCACGGTT
TCAAGGGACA TCTTCAGAGC CAACATCTAC CCTCGGGGCT TTGTGAACTG CAGCCGTATC CCCAGGTTGA
ACCTATCAGC CTGGCGAGGG ACATGAGGCT TCTGCAGGTA AGGGGAGGCC ACCTCCAGCA CCCTGGGCTG
GTTAAGCCTC ACATCCTTCC CTGGATGGAT GGCTGAGTCC TCTTAGGTCT CTAAGCAGAG AAAACAGAAC
TTGTCACTAG GTACTCTTTC CAAGTGGCTT CCCAATGTGC TAGTTTCTGG GCTGACAGTC AATTCCAGGC
CCTAGGACTT TGGGGGAAA TTAGGAGCAT CCAACTA GAATTCCGTG GCCAGGACCC CTGCCAGGGC
ACTGACCCAG CCTCCCCTGG GGCAGTGGAG ACCTCGGTCC TGCGAGACTG CATAGCAGAG GCCAAGTTGC
TGGTGGATGC TGCCTACAAT TGGACCCAGA AGAGCATCAA GCAGCGGCTT CGCAGCGGTT CAGCCAGCCC
CATGGACCTC CTGTCCTACT TCAAACAACC GGTAGCAGCC ACCAGGACAG TTGTTCGGGC CGCAGATTAT
ATGCATGTGG CTTTGGGGCT GCTTGAAGAG AAGTTACAAC CCCAGCGGTC CGGACCCTTC ATTGTCACTG
ATGTGCTAAC AGAACCACAG CTGCGGCTGC TGTCCCAGGC CAGTGGCTGT GCTCTCCGGG ACCAGGCCGA
GCGCTGCAGC GACAAGTACC GCACCATCAC TGGACGGTGC AACAACAAGA GGAGACCCTT GCTAGGGGCC
TCCAACCAGG CTCTGGCTCG CTGGCTGCCC GCCGAGTATG AGGATGGGCT GTCGCTCCCC TTCGGCTGGA
CCCCCAGCAG GAGGCGCAAT GGCTTCCTTC TCCCTCTTGT CCGGGCTGTC TCCAACCAGA TTGTGCGCTT
CCCCAATGAG AGACTGACCT CCGACCGTGG CCGAGCCCTC ATGTTCATGC AGTGGGGCCA GTTCATTGAC
CATGACCTGG ACTTCTCCCC GGAGTCCCCG GCCAGAGTGG CCTTCACTGC AGGCGTTGAC TGTGAGAGGA
CCTGCGCCCA GCTGCCCCCC TGCTTTCCCA TCAAGATCCC ACCCAATGAC CCCCGCATCA AGAACCAGCG
TGACTGCATC CCTTTCTTCC GCTCGGCACC CTCATGCCCC CAAAACAAGA ACAGAGTCCG CAACCAGATC
AACGCGCTCA CCTCCTTTGT GGACGCCAGC ATGGTGTATG GCAGTGAGGT CTCCCTCTCG CTGCGGCTCC
GCAACCGGAC CAACTACCTG GGGCTGCTGG CCATCAACCA GCGCTTTCAA GACAACGGCG GGGCCCTGCT
GCCCTTCGAC AACCTGCACG ATGACCCCTG TCTCCTCACC AACCGCTCGG CGCGCATCCC CTGCTTCCTG
GCAGGTGACA CCCGATCAAC GGAAACCCCC AAACTGGCAG CCATGCACAC CCTCTTTATG CGAGAGCACA
ACCGGCTGGC CACCGAGCTG AGACGCCTGA ATCCCCGGTG GAATGGAGAC AAACTGTACA ATGAGGCTCG
GAAGATCATG GGGGCCATGG TCCAGATCAT CACCTACCGA GACTTTCTGC CCTGGTTCT GGGCAAGGCC
CGGGCCAGGA GAACCCTGGG GCACTACAGG GGGTACTGCT CCAATGTGGA CCCACGGGTG GCCAATGTCT
TCACCCTGGC CTTCCGCTTT GGCCACACAA TGCTCCAGCC CTTCATGTTC CGCTTGGACA GTCAGTACCG
GGCCTCCGCA CCCAACTCGC ATGTCCCACT TAGCTCTGCC TTCTTTGCCA GCTGGCGGAT CGTGTATGAA
GGGGGCATCG ACCCCATCCT CCGGGGCCTC ATGGCCACCC CTGCCAAGCT GAACCGTCAG GATGCCATGT
TAGTGGATGA GCTCCGGGAC CGGCTGTTTC GGCAAGTGAG GAGGATTGGG CTGGACCTGG CAGCTCTCAA
CATGCAACGA AGCCGGGACC ACGGCCTTCC AGGGTACAAT GCTTGGAGGC GCTTCTGTGG GCTCTCCCAG
CCCCGGAATT TGGCACAGCT TAGCCGGGTG CTGAAAAACC AGGACTTGGC AAGGAAGTTC CTGAATTTGT
ATGGAACACC TGACAACATT GACATCTGGA TTGGGGCCAT CGCTGAGCCT CTTTTGCCGG GGGCTCGAGT
```

```
GGGGCCTCTT CTGGCTTGTC TGTTCGAGAA CCAGTTCAGA AGAGCCGAGA CGGAGACAGG TTCTGGTGGC

AGAACGAGGT GTTTTCACCA AAGACAGCGC AAGGCCCTGA GCAGAATTTC CTTGTCTCGA ATTATATGTG

ACAATACCGG TATCACCACG GTTTCAAGGG ACATCTTCAG AGCCAACATC TACCCTCGGG GCTTTGTGAA

CTGCAGCCGT ATCCCCAGGT TGAACCTATC AGCCTGGCGA GGGACATGAG GCTTCTGCAG GAGTCTATCC

CAAGTCTCCA ACTTTTGGAG ACAAGGGGAA GGGGAGGACC ATGAGGCTGC CTTGTCTCCC TGGAGCAAGT

GCAGGCTCGT GACGCTTCTG CTGGCTACAG CTCAGAGCTG GGTTCCCCAG CCAGGAGTGA AGGCTGGGGG

CTCCTATCAG CAATGGACCT TCCGCCTTGG GAGCCTCTTA GGTATTAGGC TATGAATCAG CGCCACGTGC

AAAGGCTTGG GAGCCAAGCC ATGTGGTCTT GCACCCCAGG CAAGAAAAGT CAGCTGGAGG GTTTACAGCA

CTTTCTACTG TTTCCCAGCC CTCCCTCCCC TCCCTCACCA TGACTAAGAG ACCACTCGGT CCTAGCCTCC

AGACACCCCA CAATACTCCT CTGAGCCTGA GGCCAGGCAG CATGCTCTGC TTCTACCAAT AAAGCACTGC

CGGAATTC CATATGTATG GAATACTGT ATTTCAGGCA TTATAAGGAA TGAAATTATA GGCCGGGCAT

TGTGGCTAAC CCTTCTAATC CTAGCACTTT GAGAGGCTGA AGTGGGCAGA TCACTTGAGC TTCAGAGTTC

GAGACCAGCA TGGACAACAT GGTGAAACCC AGTCTCTACC AAAAACACAA AAATATTAGC TGGGTGTGGT

GGTGCATGCC TGTAGTCCCA GCTACTCAGG AGGCTGAGGT GGGAGGATCG CTTGAGCCTG GGAGGCAGAA

GTTGCAATGA GCAGAGATCG TGCCACTCCG CTCCAGTCTT GGTGACAGAA TGAGACTCCA TCTCAAAAAT

AAATAAATAA ATAAATAAAA TAAATGAAAT GAAATTATAA GAAATTACCA CTTTTTCATG TAAGAAGTGA

TCATTTCCAT TATAAGGGAA GGAATTTAAT CCTACCTGCC ATTCCACCAA AGCTTACCTA GTGCTAAAGG

ATGAGGTGTT AGTAAGACCA ACATCTCAGA GGCCTCTCTG TGCCAATAGC CTTCCTTCCT TTCCCTTCCA

AAAACCTCAA GTGACTAGTT CAGAGGCCTG TCTGGAATAA TGGCATCATC TAATATCACT GGCCTTCTGG

AACCTGGGCA TTTTCCAGTG TGTTCCATAC TGTCAATATT CCCCCAGCTT CCTGGACTCC TGTCACAAGC

TGGAAAAGTG AGAGGATGGA CAGGGATTAA CCAGAGAGCT CCCTGCTGAG GAAAAAATCT CCCAGATGCT

GAAAGTGAGG CCATGTGGCT TGGCCAAATA AAACCTGGCT CCGTGGTGCC TCTGTCTTAG CAGCCACCCT

GCTGATGAAC TGCCACCTTG GACTTGGGAC CAGAAAGAGG TGGGTTGGGT GAAGAGGCAC CACACAGAGT

GATGTAACAG CAAGATCAGG TCACCCACAG GCCCTGGCAG TCACAGTCAT AAATTAGCTA ACTGTACACA

AGCTGGGGAC ACTCCCTTTG GAAACCAAAA AAAAAAAAAA AAAAAGAGA CCTTTATGCA AAACAACTC

TCTGGATGGC ATGGGGTGAG TATAAATACT TCTTGGCTGC CAGTGTGTTC ATAACTTTGT AGCGAGTCGA

AAACTGAGGC TCCGGCCGCA GAGAACTCAG CCTCATTCCT GCTTTAAAAT CTCTCGGCCA CCTTTGATGA

GGGGACTGGG CAGTTCTAGA CAGTCCCGAA GTTCTCAAGG CACAGGTCTC TTCCTGGTTT GACTGTCCTT

ACCCCGGGGA GGCAGTGCAG CCAGCTGCAA GGTGAGTTGC C CATATGTATG GAATACTGT ATTTCAGGCA

TTATAAGGAA TGAAATTATA GGCCGGGCAT TGTGGCTAAC CCTTGTAATC CTAGCACTTT GAGAGGCTGA

AGTGGGCAGA TCACTTGAGC TTCAGAGTTC GAGACCAGCA TGGACAACAT GGTGAAACCC AGTCTCTACC

AAAAACACAA AAATATTAGC TGGGTGTGGT GGTGCATGCC TGTAGTCCCA GCTACTCAGG AGGCTGAGGT

GGGAGGATCG CTTGAGCCTG GGAGGCAGAA GTTGCAATGA GCAGAGATCG TGCCACTCCG CTCCAGTCTT

GGTGACAGAA TGAGACTCCA TCTCAAAAAT AAATAAATAA ATAAATAAAA TAAATGAAAT GAAATTATAA

GAAATTACCA CTTTTTCATG TAAGAAGTGA TCATTTCCAT TATAAGGGAA GGAATTTAAT CCTACCTGCC

ATTCCACCAA AGCTTACCTA GTGCTAAAGG ATGAGGTGTT AGTAAGACCA ACATCTCAGA GGCCTCTCTG

TGCCAATAGC CTTCCTTCCT TTCCCTTCCA AAAACCTCAA GTGACTAGTT CAGAGGCCTG TCTGGAATAA

TGGCATCATC TAATATCACT GGCCTTCTGG AACCTGGGCA TTTTCCAGTG TGTTCCATAC TGTCAATATT

CCCCCAGCTT CCTGGACTCC TGTCACAAGC TGGAAAAGTG AGAGGATGGA CAGGGATTAA CCAGAGAGCT
```

-continued

```
CCCTGCTGAG GAAAAAATCT CCCAGATGCT GAAAGTGAGG CCATGTGGCT TGGCCAAATA AAACCTGGCT
CCGTGGTGCC TCTGTCTTAG CAGCCACCCT GCTGATGAAC TGCCACCTTG GACTTGGGAC CAGAAAGAGG
TGGGTTGGGT GAAGAGGCAC CACACAGAGT GATGTAACAG CAAGATCAGG TCACCCACAG GCCCTGGCAG
TCACAGTCAT AAATTAGCTA ACTGTACACA AGCTGGGGAC ACTCCCTTTG GAAACCAAAA AAAAAAAAAA
AAAAAGAGA CCTTTATGCA AAAACAACTC TCTGGATGGC ATGGGGTGAG TATAAATACT TCTTGGCTGC
CAGTGTGTTC ATAACTTTGT AGCGAGTCGA AAACTGAGGC TCCGGCCGCA GAGAACTCAG CCTCATTCCT
GCTTTAAAAT CTCTCGGCCA CCTTTGATGA GGGGACTGGG CAGTTCTAGA CAGTCCCGAA GTTCTCAAGG
CACAGGTCTC TTCCTGGTTT GACTGTCCTT ACCCCGGGGA GGCAGTGCAG CCAGCTGCAA GGTGAGTTGC C
CTGCTTTAAA ATCTCTCGGC CACCTTTGAT GAGGGACTG GGCAGTTCTA GACAGTCCCG AAGTTCTCAA
GGCACAGGTC TCTTCCTGGT TTGACTGTCC TTACCCCGGG GAGGCAGTGC AGCCAGCTGC AAGCCCCACA
GTGAAGAACA TCTGAGCTCA ATCCAGATA AGTGACATAA GTGACCTGCT TTGTAAAGCC ATAGAGATGG
CCTGTCCTTG GAAATTTCTG TTCAAGACCA AATTCCACCA GTATGCAATG AATGGGAAA AAGACATCAA
CAACAATGTG GAGAAAGCCC CCTGTGCCAC CTCCAGTCCA GTGACACAGG ATGACCTTCA GTATCACAAC
CTCAGCAAGC AGCAGAATGA GTCCCCGCAG CCCCTCGTGG AGACGGGAAA GAAGTCTCCA GAATCTCTGG
TCAAGCTGGA TGCAACCCCA TTGTCCTCCC CACGGCATGT GAGGATCAAA ACTGGGGCA GCGGGATGAC
TTTCCAAGAC ACACTTCACC ATAAGGCCAA AGGGATTTTA ACTTGCAGGT CCAAATCTTG CCTGGGGTCC
ATTATGACTC CCAAAAGTTT GACCAGAGGA CCCAGGGACA AGCCTACCCC TCCAGATGAG CTTCTACCTC
AAGCTATCGA ATTTGTCAAC CAATATTACG GCTCCTTCAA AGAGGCAAAA ATAGAGGAAC ATCTGGCCAG
GGTGGAAGCG GTAACAAAGG AGATAGAAAC AACAGGAACC TACCAACTGA CGGGAGATGA GCTCATCTTC
GCCACCAAGC AGGCCTGGCG CAATGCCCCA CGCTGCATTG GGAGGATCCA GTGGTCCAAC CTGCAGGTCT
TCGATGCCCG CAGCTGTTCC ACTGCCCGGG AAATGTTTGA ACACATCTGC AGACACGTGC GTTACTCCAC
CAACAATGGC AACATCAGGT CGGCCATCAC CGTGTTCCCC CAGCGGAGTG ATGGCAAGCA CGACTTCCGG
GTGTGGAATG CTCAGCTCAT CCGCTATGCT GGCTACCAGA TGCCAGATGG CAGCATCAGA GGGGACCCTG
CCAACGTGGA ATTCACTCAG CTGTGCATCG ACCTGGGCTG GAAGCCCAAG TACGCCGCT TCGATGTGGT
CCCCCTGGTC CTGCAGGCCA ATGGCCGTGA CCCTGAGCTC TTCGAAATCC CACCTGACCT TGTGCTTGAG
GTGGCCATGG AACATCCCAA ATACGAGTGG TTTCGGGAAC TGGAGCTAAA GTGGTACGCC CTGCCTGCAG
TGGCCAACAT GCTGCTTGAG GTGGGCGGCC TGGAGTTCCC AGGGTGCCCC TTCAATGGCT GGTACATGGG
CACAGAGATC GGAGTCCGGG ACTTCTGTGA CGTCCAGCGC TACAACATCC TGGAGGAAGT GGGCAGGAGA
ATGGGCCTGG AAACGCACAA GCTGGCCTCG CTCTGGAAAG ACCAGGCTGT CGTTGAGATC AACATTGCTG
TGATCCATAG TTTTCAGAAG CAGAATGTGA CCATCATGGA CCACCACTCG GCTGCAGAAT CCTTCATGAA
GTACATGCAG AATGAATACC GGTCCCGTGG GGGCTGCCCG GCAGACTGGA TTTGGCTGGT CCCTCCCATG
TCTGGGAGCA TCACCCCCGT GTTTCACCAG GAGATGCTGA ACTACGTCCT GTCCCCTTTC TACTACTATC
AGGTAGAGGC CTGGAAAACC CATGTCTGGC AGGACGAGAA GCGGAGACCC AAGAGAAGAG AGATTCCATT
GAAAGTCTTG GTCAAAGCTG TGCTCTTTGC CTGTATGCTG ATGCGCAAGA CAATGGCGTC CCGAGTCAGA
GTCACCATCC TCTTTGCGAC AGAGACAGGA AAATCAGAGG CGCTGGCCTG GGACCTGGGG GCCTTATTCA
GCTGTGCCTT CAACCCCAAG GTTGTCTGCA TGGATAAGTA CAGGCTGAGC TGCCTGGAGG AGGAACGGCT
GCTGTTGGTG GTGACCAGTA CGTTTGGCAA TGGAGACTGC CCTGGCAATG GAGAGAAACT GAAGAAATCG
CTCTTCATGC TGAAAGAGCT CAACAACAAA TTCAGGTACG CTGTGTTTGG CCTCGGCTCC AGCATGTACC
CTCGGTTCTG CGCCTTTGCT CATGACATTG ATCAGAAGCT GTCCCACCTG GGGCCTCTC AGCTCACCCC
GATGGGAGAA GGGGATGAGC TCAGTGGGCA GGAGGACGCC TTCCGCAGCT GGGCCGTGCA AACCTTCAAG
```

```
GCAGCCTGTG AGACGTTTGA TGTCCGAGGC AAACAGCACA TTCAGATCCC AAGCTCTAC ACCTCCAATG

TGACCTGGGA CCCGCACCAC TACAGGCTCG TGCAGGACTC ACAGCCTTTG GACCTCAGCA AAGCCCTCAG

CAGCATGCAT GCCAAGAACG TGTTCACCAT GAGGCTCAAA TCTCGGCAGA ATCTACAAAG TCCGACATCC

AGCCGTGCCA CCATCCTGGT GGAACTCTCC TGTGAGGATG GCCAAGGCCT GAACTACCTG CCGGGGGAGC

ACCTTGGGGT TTGCCCAGGC AACCAGCCGG CCCTGGTCCA AGGCATCCTG GAGCGAGTGG TGGATGGCCC

CACACCCCAC CAGACAGTGC GCCTGGAGGA CCTGGATGAG AGTGGCAGCT ACTGGGTCAG TGACAAGAGG

CTGCCCCCCT GCTCACTCAG CCAGGCCCTC ACCTACTCCC CGGACATCAC CACACCCCCA ACCCAGCTGC

TGCTCCAAAA GCTGGCCCAG GTGGCCACAG AAGAGCCTGA GAGACAGAGG CTGGAGGCCC TGTGCCAGCC

CTCAGAGTAC AGCAAGTGGA AGTTCACCAA CAGCCCCACA TTCCTGGAGG TGCTAGAGGA GTTCCCGTCC

CTGCGGGTGT CTGCTGGCTT CCTGCTTTCC CAGCTCCCCA TTCTGAAGCC CAGGTTCTAC TCCATCAGCT

CCTCCCGGGA TCACACGCCC ACGGAGATCC ACCTGACTGT GGCCGTGGTC ACCTACCACA CCGGAGATGG

CCAGGGTCCC CTGCACCACG GTGTCTGCAG CACATGGCTC AACAGCCTGA AGCCCCAAGA CCCAGTGCCC

TGCTTTGTGC GGAATGCCAG CGCCTTCCAC CTCCCCGAGG ATCCCTCCCA TCCTTGCATC CTCATCGGGC

CTGGCACAGG CATCGTGCCC TTCCGCAGTT CTGGCAGCA ACGGCTCCAT GACTCCCAGC ACAAGGGAGT

GCGGGGAGGC CGCATGACCT TGGTGTTTGG GTGCCGCCGC CCAGATGAGG ACCACATCTA CCAGGAGGAG

ATGCTGGAGA TGGCCCAGAA GGGGGTGCTG CATGCGGTGC ACACAGCCTA TTCCCGCCTG CCTGGCAAGC

CCAAGGTCTA TGTTCAGGAC ATCCTGCGGC AGCAGCTGGC CAGCGAGGTG CTCCGTGTGC TCCACAAGGA

GCCAGGCCAC CTCTATGTTT GCGGGGATGT GCGCATGGCC CGGGACGTGG CCCACACCCT GAAGCAGCTG

GTGGCTGCCA AGCTGAAATT GAATGAGGAG CAGGTCGAGG ACTATTTCTT TCAGCTCAAG AGCCAGAAGC

GCTATCACGA AGATATCTTC GGTGCTGTAT TTCCTTACGA GGCGAAGAAG GACAGGGTGG CGGTGCAGCC

CAGCAGGCTG GAGATGTCAG CGCTCTGAGG GCCTACAGGA GGGGTTAAAG CTGCGGCAC AGAACTTAAG

GATGGAGCCA GCTCTGCATT ATCTGAGGTC ACAGGGCCTG GGGAGATGGA GGAAAGTGAT ATCCCCCAGC

CTCAAGTCTT ATTTCCTCAA CGTTGCTCCC CATCAAGCCC TTTACTTGAC CTCCTAACAA GTAGCACCCT

GGATTGATCG GAGCCTCCTC TCTCAAACTG GGGCCTCCCT GGTCCCTTGG AGACAAAATC TTAAATGCCA

GGCCTGGCGA GTGGGTGAAA GATGGAACTT GCTGCTGAGT GCACCACTTC AAGTGACCAC CAGGAGGTGC

TATCGCACCA CTGTGTATTT AACTGCCTTG TGTACAGTTA TTTATGCCTC TGTATTTAAA AAACTAACAC

CCAGTCTGTT CCCCATGGCC ACTTGGGTCT TCCCTGTATG ATTCCTTGAT GGAGATATTT ACATGAATTG

CATTTTACTT TAATC GAATTCCCAC TCTGCTGCCT GCTCCAGCAG ACGGACGCAC AGTAACATGG GCAACTTGAA

GAGCGTGGCC CAGGAGCCTG GGCCACCCTG CGGCCTGGGG CTGGGCTGG GCCTTGGGCT GTGCGGCAAG

CAGGGCCCAG CCACCCCGGC CCCTGAGCCC AGCCGGGCCC CAGCATCCCT ACTCCCACCA GCGCCAGAAC

ACAGCCCCCC GAGCTCCCCG CTAACCCAGC CCCCAGAGGG GCCCAAGTTC CCTCGTGTGA AGAACTGGGA

GGTGGGGAGC ATCACCTATG ACACCCTCAG CGCCCAGGCG CAGCAGGATG GCCCCTGCAC CCCAAGACGC

TGCCTGGGCT CCCTGGTATT CCACGGAAA CTACAGGGCC GGCCCTCCCC CGGCCCCCCG GCCCCTGAGC

AGCTGCTGAG TCAGGCCCGG GACTTCATCA ACCAGTACTA CAGCTCCATT AAGAGGAGCG GCTCCCAGGC

CCACGAACAG CGGCTTCAAG AGGTGGAAGC CGAGGTGGCA GCCACAGGCA CCTACCAGCT TAGGGAGAGC

GAGCTGGTGT TCGGGCTAA GCAGGCCTGG CGCAACGCTC CCCGCTGCGT GGGCCGGATC CAGTGGGGA

AGCTGCAGGT GTTCGATGCC CGGGACTGCA GGTCTGCACA GGAAATGTTC ACCTACATCT GCAACCACAT

CAAGTATGCC ACCAACCGGG GCAACCTTCG CTCGGCCATC ACAGTGTTCC CGCAGCGCTG CCCTGGCCGA

GGAGACTTCC GAATCTGGAA CAGCCAGCTG GTGCGCTACG CGGGCTACCG GCAGCAGGAC GGCTCTGTGC
```

```
GGGGGGACCC AGCCAACGTG GAGATCACCG AGCTCTGCAT TCAGCACGGC TGGACCCCAG GAAACGGTCG
CTTCGACGTG CTGCCCCTGC TGCTGCAGGC CCCAGATGAG CCCCCAGAAC TCTTCCTTCT GCCCCCCGAG
CTGGTCCTTG AGGTGCCCCT GGAGCACCCC ACGCTGGAGT GGTTTGCAGC CCTGGGCCTG CGCTGGTACG
CCCTCCCGGC AGTGTCCAAC ATGCTGCTGG AAATTGGGGG CCTGGAGTTC CCCGCAGCCC CCTTCAGTGG
CTGGTACATG AGCACTGAGA TCGGCACGAG GAACCTGTGT GACCCTCACC GCTACAACAT CCTGGAGGAT
GTGGCTGTCT GCATGGACCT GGATACCCGG ACCACCTCGT CCCTGTGGAA AGACAAGGCA GCAGTGGAAA
TCAACGTGGC CGTGCTGCAC AGTTACCAGC TAGCCAAAGT CACCATCGTG GACCACCACG CCGCCACGGC
CTCTTTCATG AAGCACCTGG AGAATGAGCA GAAGGCCAGG GGGGGCTGCC CTGCAGACTG GGCCTGGATC
GTGCCCCCCA TCTCGGGCAG CCTCACTCCT GTTTTCCATC AGGAGATGGT CAACTATTTC CTGTCCCCGG
CCTTCCGCTA CCAGCCAGAC CCCTGGAAGG GGAGTGCCGC CAAGGGCACC GGCATCACCA GGAAGAAGAC
CTTTAAAGAA GTGGCCAACG CCGTGAAGAT CTCCGCCTCG CTCATGGGCA CGGTGATGGC GAAGCGAGTG
AAGGCGACAA TCCTGTATGG CTCCGAGACC GGCCGGGCCC AGAGCTACGC ACAGCAGCTG GGGAGACTCT
TCCGGAAGGC TTTTGATCCC CGGGTCCTGT GTATGGATGA GTATGACGTG GTGTCCCTCG AACACGAGAC
GCTGGTGCTG GTGGTAACCA GCACATTTGG GAATGGGGAT CCCCCGGAGA ATGGAGAGAG CTTTGCAGCT
GCCCTGATGG AGATGTCCGG CCCCTACAAC AGCTCCCCTC GGCCGGAACA GCACAAGAGT TATAAGATCC
GCTTCAACAG CATCTCCTGC TCAGACCCAC TGGTGTCCTC TTGGCGGCGG AAGAGGAAGG AGTCCAGTAA
CACAGACAGT GCAGGGCCC TGGGCACCCT CAGGTTCTGT GTGTTCGGGC TCGGCTCCCG GGCATACCCC
CACTTCTGCG CCTTTGCTCG TGCCGTGGAC ACACGGCTGG AGGAACTGGG CGGGGAGCGG CTGCTGCAGC
TGGGCCAGGG CGACGAGCTG TGCGGCCAGG AGGAGGCCTT CCGAGGCTGG GCCCAGGCTG CCTTCCAGGC
CGCCTGTGAG ACCTTCTGTG TGGGAGAGGA TGCCAAGGCC GCCGCCCGAG ACATCTTCAG CCCCCAAACGG
AGCTGGAAGC GCCAGAGGTA CCGGCTGAGC GCCCAGGCCG AGGGCCTGCA GTTGCTGCCA GGTCTGATCC
ACGTGCACAG GCGGAAGATG TTCCAGGCTA CAATCCGCTC AGTGGAAAAC CTGCAAAGCA GCAAGTCCAC
GAGGGCCACC ATCCTGGTGC GCCTGGACAC CGGAGGCCAG GAGGGGCTGC AGTACCAGCC GGGGGACCAC
ATAGGTGTCT GCCCGCCCAA CCGGCCCGGC CTTGTGGAGG CGCTGCTGAG CCGCGTGGAG GACCCGCCGG
CGCCCACTGA GCCCGTGGCA GTAGAGCAGC TGGAGAAGGG CAGCCCTGGT GGCCCTCCCC CCGGCTGGGT
GCGGGACCCC CGGCTGCCCC CGTGCACGCT GCGCCAGGCT CTCACCTTCT TCCTGGACAT CACCTCCCCA
CCCAGCCCTC AGCTCTTGCG GCTGCTCAGC ACCTTGGCAG AAGAGCCCAG GGAACAGCAG GAGCTGGAGG
CCCTCAGCCA GGATCCCCGA CGCTACGAGG AGTGGAAGTG GTTCCGCTGC CCCACGCTGC TGGAGGTGCT
GGAGCAGTTC CCGTCGGTGG CGCTGCCTGC CCCACTGCTC CTCACCCAGC TGCCTCTGCT CCAGCCCCGG
TACTACTCAG TCAGCTCGGC ACCCAGCACC CACCCAGGAG AGATCCACCT CACTGTAGCT GTGCTGGCAT
ACAGGACTCA GGATGGGCTG GGCCCCCTGC ACTATGGAGT CTGCTCCACG TGGCTAAGCC AGCTCAAGCC
CGGAGACCCT GTGCCCTGCT TCATCCGGGG GGCTCCCTCC TTCCGGCTGC CACCCGATCC CAGCTTGCCC
TGCATCCTGG TGGGTCCAGG CACTGGCATT GCCCCCTTCC GGGGATTCTG GCAGGAGCGG CTGCATGACA
TTGAGAGCAA AGGGCTGCAG CCCACTCCCA TGACTTTGGT GTTCGGCTGC CGATGCTCCC AACTTGACCA
TCTCTACCGC GACGAGGTGC AGAACGCCCA GCAGCGCGGG GTGTTTGGCC GAGTCCTCAC CGCCTTCTCC
CGGGAACCTG ACAACCCCAA GACCTACGTG CAGGACATCC TGAGGACGGA GCTGGCTGCG GAGGTGCACC
GCGTGCTGTG CCTCGAGCGG GGCCACATGT TTGTCTGCGG CGATGTTACC ATGGCAACCA ACGTCCTGCA
GACCGTGCAG CGCATCCTGG CGACGGAGGG CGACATGGAG CTGGACGAGG CCGGCGACGT CATCGGCGTG
CTGCGGGATC AGCAACGCTA CCACGAAGAC ATTTTCGGGC TCACGCTGCG CACCCAGGAG GTGACAAGCC
GCATACGCAC CCAGAGCTTT TCCTTGCAGG AGCGTCAGTT GCGGGCGCA GTGCCCTGGG CGTTCGACCC
```

TCCCGGCTCA GACACCAACA GCCCCTGAGA GCCGCCTGGC TTTCCCTTCC AGTTCCGGGA GAGCGGCTGC

CCGACTCAGG TCCGCCCGAC CAGGATCAGC CCCGCTCCTC CCCTCTTGAG GTGGTGCCTT CTCACATCTG

TCCAGAGGCT GCAAGGATTC AGCATTATTC CTCCAGGAAG GAGCAAAACG CCTCTTTTCC CTCTCTAGGC

CTGTTGCCTC GGGCCTGGGT CCGCCTTAAT CTGGAAGGCC CCTCCCAGCA GCGGTACCCC AGGGCCTACT

GCCACCCGCT TCCTGTTTCT TAGTCCGAAT GTTAGATTCC TCTTGCCTCT CTCAGGAGTA TCTTACCTGT

AAAGTCTAAT CTCTAAATCA AGTATTTATT ATTGAAGATT TACCATAAGG GACTGTGCCA GATGTTAGGA

GAACTACTAA AGTGCCTACC CCAGCTC-3' (SEQ. ID NO: 3003)

Human Factor Related Anti-sense Oligonucleotide

5'-CCT CCT TCC TGG TCT GTC TGC CBG BCB BBT TTG GGB BGT GBB CBG TTT TGG BBC CBT GTT TCC CBG TCT

CTG BGC TGT GGC GCC CTG CTG CTC TTT CTG CT TCC CTT GGT GGG TTG GGC C GCT GGT TGT TCT GGG GTT

C TTG CTG CCC CTT CTG TCC C TGT TTG CTG GTG TCT GCG C CCC CBB CBG BBG BBG CBG BCB BBT TTG GGB

BGT GBB CBG TTT TGG BBC CBT GTT TCC TGT GCG CTC GGC CTG GTC CCG G GGG TCT CCT CTT GTT GTT GC

TTG CGC CTC CTG CTG GGG GT CC CTC TGT TCT TGT TTT GGG GGC GGG CCC GGC CGT TGT CTT G GTT TGG

GGG TTT CCG TTG GGG TTC TCC TGG CCC GGG CCT TGC CC GGC CGT GGT CCC GGC TTC GTTCCT GTC TCC

GTC TCG GCT CTT CTG GGG CCT TGC GCT GTC TTT GGT G GCB CCG TCC BGT GBT GGT GCG GTB CTT GTC

GCT GCB GCG CTC GGC CTG GTC CCG GBG BGC GCG CGG GCC GGG GGC TGC TGG G GGT TGG CCC GGG GTG

CCC C GCC GCT GGG TGC CCT CGT CCT CTG CGG TC GTG TCT CCT GGC TCT GGT TCC CC GCT GCG CCC GTT

GTC CTC TGG GGT GGC CTT C GCT CCC GGG TCT GGT TCT TGT GT TGG GGG TCC CTT TTT GGG CCT GTT GT

GGC GTG GCT TGT GTG TTC GGT TTC TGC CCT GTC CTC CGG CGT CCC CGG BGC CTC CCC GGG GCB GGB TGB

CTT TTG BGG GGG BCB CBG BTG TCT GGG CBT TGC CBG GTC CTG GGB BCB GBG CCC CGB GCB GGB CCB GGB

GTG CGG GCB GCG CGG GCC GGG GGC TGC TGG GBG CCB TBG CGB GGC TGB G CCT CTT TTC TGT TTT TCC C

CTC TGC CTT TGT TTG GGT TCG CTT CCT TTC TGC TTC TTC C CTG TGT CTC CTG TCT CCG CTT TTT TCT TC

GTC TTT GTT GTT TTC TCT TCC TTG CTG BGC BBG BTB TCT BGB TTC TGG GGT GGT CTC GBT TTT BBBB GCT

TGB GBB GCT GCB BBC BTT BTC CBB BGT BTB TTT GBG GCT CCB BGG BTC BCG BCC BTC TTC CCB GGC BTT

TTB BGT TGC TGT CGT BBG TGB GBG CTG BGB GBB BCT GTG BBG CBB TCB TGB CTT CBB GBG TTC TTT TCB

CCC GTT CTT GGC TTC TTC TGT C CGT TGG CTT CTC GTT GTC CC TGT GGG CTT CTC GTT GTC CC CCC TTC

GGG GGC TGG TGG GGC CGT CCT TGC CTG CTG G GTT CTT GGC TTC TTC TGT CCG T TGG CTT CTC GTT GTC

CC TGT GGG CTT CTC GTT GTC CC CCC TTC GGG GGC TGG TGG GGC CGT CCT TGC CTG CTG G TTT TCT CTT

TCG CTT TCT TTT CGT CTC CTG TTC CTC CTT TT TTG CTG TTT TTT CTC CTT CTT CTC TCC TTT CTT TTC TTT

TCT CTT TCG CTT TCT TTT CGT CTC CTG TTC CTC CTT TT TTG CTG TTT TTT CTC CTT CTT CTC TCC TTT CTT

TTC CTC TGT CTT GTT CTG GTC CTT CGT GGG GCT CTG TGT CGC GTG G GTG CGG CCG TGG CC GGC GGB

CCB GGB GTT GGB GCB GGB GCB GGB CGG GCB GGC GGC TCB TGT TTG GBT CGG CBG GBG GCB CTC CTC TGG

TTG GCT TCC TTC GCC GGC BCB TGC TBG CBG GBB GBB CBG BGG GGG BBG CBG TTG GGB GGT GBG BCC CBT

TBB TBG GTG TCG B TCCCTGTTTC CCCCCTTTCG TTCTGCGTTT GCCTTTGGCG TTTTTTGTTT GTTTTCTCTC

TCCGTCTTTC TTCTCCCCT GTGGGBBTTT CTGTGGGGBT GGCBTBCBCG TBGGCBGCTC CBBGBGCTBG

CBBBCTCBBB TGCBGBBGCB TCCTCBTGGC TCTGBBBCGG TGGGAATTTC TGTGGGGBTG GCATACACGT

AGGCAGCTCC AAGAGCTAGC AAACTCAAAT GCAGAAGCATC CTCATGGCTC TGAAACG GGGGGTGGCT

TCCTGCCGCG TCTCTGGGCC GTCCCGTCCC TCGGCCCCGC GCCGCGCTCG GCTCCTCTCC CTCTGGCCCG

GCTCGGGGCG GGGCGGGGCG GTGGGCGGGC GGCGCTGCCC TGCGCGCGGC GCTGGCCCCT GCTGGCCGTC

```
GGCTGCGCGC TGCTGGCTGC CCTGCTGGCC GCGCCGGGGC CTGTCCGCCT CTGCGGGCGC TGTCTCCTGG
CTTGTCTTCC GGCTCTTCTG CTGGGGTGGG GCTGGGCGGC CGGCCCGGTG CTGGGGCTCC TCGGGGGGGG
GGGCTCTTCC GGGCTGTCTC CCTCCGGGGC GGGGGTTTCT GGCCGTGGGG GTCTTGCCTG GCCTCCGGGC
TCCTGCTTGT CTTGCCTTCC TTCTCTGGTC GGTTGTGGCT CGGGGCTCCG TGGGTCCCTG GCGCCCGTTT
GTGTTTTGTC TTTTCCCCTG GCGTCCCTGT GCCCCTCTCC TCTCCTTCCT CTGCTTCTCG CTCTCCTTTG
TGGGGCCCTC CCTGCTGCTC TTGGTTTTGG GCTTTTTTTC TCTTCCTCCT TTTTCGTGCG TGGGCCTCC
GCACGCCTCT TGCCACCTCC TGCGCAGGGC AGCGCCTTGG GGCCAGCGCC GCTCCCGGCG CGGCCAGCAG
GGCAGCCAGC AGCGCGCAGC CGACGGCCAG CATGCTTCCT CCTCGGCTAC CACTCCATGG TCCCGCAGAG
GCGGACAGGC GCBCGCCTC TTGCCBCCTC CTGCGCBGGG CBGCGCCTTG GGGCCBGCGC CGCTCCCGGC
GCGGCCBGCB GGGCBGCCBG CBGCGCGCBG CCGBCGGCCB GCBTGCTTCC TCCTCGGCTB CCBCTCCBTG
GTCCCGCBGB GGCGGBCBGG C GGGGTGGBBB GGTTTGGBGT BTGTCTTTBT GCBCTGBCBT CTBBGTTCTT
TBGCBCTCCT TGGCBBBBCT GCBCCTTCBC BCBGBGCTGC BGBBBTCBGG BBGGCTGCCB GBGBGCCBC
GGCCBGCTTG GBBGTCBTGT TTBCBCBCBG TGBGBTGGTT CCTTCCGGGC TTGTGTGCTC TGCTGTCTCT
TGGTTCCTTC CGGTGGTTTC TTCCTGGCTC TTGTCCTTTC TCTTGG CCCT TGGC CGGGBGTGGG GGTCCTGGBC
GGCBCTGBBG GCBTCCBGGG CTCCCTTCCB GTCCTTCTTG TCCGCTGCCB GCBCCCCTTC BTTCCBGBGG
CTGBTGGCCT CCBCCBGGGB CBTGBTTBGG TBGBBBCTBG GBGGCCGGCC TCCBCCBGGG BCBTGGTCCT
TCTTGTCCGC TGCCTCTCTG GGGTTTTCGG TCTGGGTGGG CTTTCCTCCT GGGGCTGCTG CTGGGCTCTT
CTTTTTGTTT CTGGCCTGGT GCTCTCTCGT GCCCTTTCCC TTGGGTGTCT TGTTTTTGTG GCCTCCBCCB
GGGBCBTG GTCTTTGTTT CTGGGCTCGT GCCCCBTCCC GGCTTCTCTC TGGTTCCGTC CTCTGTGGTG
TTTGGCCCTG CTTCCTTTTG CCTGTTGAGG GGGCAGCAGT TGGGCCCCAA AGGCCCTCTC GTTCACCTTC
TGGCACGGAGTT GCATCCCCATA GTCAAACTCT GTGGTCGTGT CATAGTCCTC TGTGGTGTTT GGAGTTTCCA
TCCCGGCTTC TCTCTGGTTC CAAGGGAGB GGGGGCBGCB GTTGGGCCCC BBBGGCCCTC TCGTTCBCCT
TCTGGCBCGG BGTTGCBTCC CCBTBGTCBB BCTCTGTGGT CGTGTCBTBG TCCTCTGTGG TGTTTGGBGT
TTCCBTCCCG GCTTCTCTCT GGTTCCBGG GB GGGCBCGGGG CBGTGGGCGG GCBBTGTBGG CBBBGCBGCB
GGGTGTGGTG TCCBGGGBBT BTGGGGBGGC BGBTGCBGGB GCGCBGBGGG CBGTBGCBBT GBGGBTGCB
GCGBGGCGTG CCGCGGBGBC CTTCBTGGTB CCTGTGGBGB GGCTGTCGGG GGGGGTGTGG TGTCCGCTTG
GCGGTTCTTT CGGGTGTTTC TTCTCTGGGT TGGCCTGCTG CTCGTCGTGGT CGCTCCGCTC CCGGGTTCGT
CTCGCTCTGT CGCCCCTTCC TTCCTTGTCG TGTTCCTCCC TTCCTTGCCT CT GBTGTTTGTT BCCBBBGCBT
CBBGBBTBGC TTTGCTBTCT BBGGBTCBCB TTTBGCBTB GGBBBBCGCT GTBGGTCBGBB BGBTGTGCTT
BCCTTCBCBC BGBGCTGCBG BBBTCBGGBBGG CTGCCBBGBGBG CCBCGGCCBGC TTGGBGTCBT GTTTBCBCBC
BGTGBGGTGC TCCGGTGGCT TTTTGCTTGT GTGCTCTGCT GTCTCTG TTC CTTCCGGTGG TTTCTTCCTG
GCTCTTGTCC TTTCTCTTGG CCCTTGGCCC CTTGBGCBGG BBGCTCTGGG GCBGGGBGCT GGCBGGGCCC
BGGGGGGTGG CTTCCTGCBC TGTCCBGBGT GCBCTGTGCC BCBGCBGCBG CTGCBGGGCC BTCBGCTTCB
TGGGGCTCTG GGTGGCBGGT CCBGCCBTGG GTCTGGGTGG GGCTGGGCTG CBGGCTCCGG
GCGGTCCBGCCBTGGGTCTG GGGGCTGGG CTGCBGGCTC CGGGCGGGCG GGTGCGGGCT GCGTGCTGGG
GGCTGCCCCG CAGGCCCTGC GGTCCBGCCB TGGGTCTGGG GGCTGGGCTG CBGGCTCCGG GCGGGCGGGT
GCGGGCTGCG TGCTGGGGGC TGCCCCGCAG GCCCTGC GCBCCGCCTG GBGCCCTGGG GCCCCCCTGT
CTTCTTGGGG BGCGCCTCCT CGGCCBGCTC CBCGTCCCGG BTCBTGCTTT CBGTGCTCBT GGTGTCCTTT
CCBGGGGBGB GBGGGGCTGG TCCTCTGCTG TCCTTGCTGG TGCTCBTGGT GTCCTTTCCG CCCTGGGGCC
CCCCTGTCTT CTTGGGGCCT CTTCCCTCTG GGGGCCGTCT CTCTCCCTCT CTTGCGTCTC TCTCTTTCTC
```

```
TCTCTCTCTT CCCCTTTCCC GCTCTTTCTG TCTCGGTGTC TGGTTTTCTC TCTCCGCTGG CTGCCTGTCT
GGCCTGCGCT CTTGGCCTGT GCTGTTCCTC CTCCGGTTCC TGTCCTCTCT GTCTGTCGCC CCCTCTGGGG
TCTCCCTCTG GGTGGTGGTC TTGTTGCTTG GGCTGGGCTC CGTGTCTCCB GTGCTCBTGG TGTCCGCTGB
GGGBGCGTCT GCTGGCGCTG GTCCTCTGCTGTC CTTGCTGGTG CTCBTGGTGT CCTTTCCGCC CTGGGGCCCC
CCTGTCTTCT TGGGGCCTCT TCCCTCTGGG GGCCGTCTC TCTCCCTCTC TTGCGTCTCT CTCTTTCTCT
CTCTCTCTTC CCCTTTCCCG CTCTTTCTGT CTCGGTGTCT GGTTTTCTCT CTCCGCTGGC TGCCTGTCTG
GCCTGCGCTC TTGGCCTGTG CTGTTCCTCC TCCGGTTCCT GTCCTCTCTG TCTGTCGCCC CCTCTGGGGT
CTCCCTCTGG CGTGGTGGTC TTGTTGCTTG GGCTGGGCTC CGTGTCTCCB GTGCTCBTGG TGTCCGCTGB
GGGBGCGTCT GCTGGC CTGCTGBGGC TTGGGTCTCC GGGCGBTTCT CTGCBGBBGB TGCTCBBBGG GCTCCGGCBG
TTCCTCCTTG BTCTGGTCGCT GTCGTBCCBG TCGGBCCBGT BBTTCGBTC BTCBTTGGCT CCTBTTTCTT
CTGCBBBCBG CTGBGTGGBG BCBBGBBBBB BGBCTGCCBB GGCCBCGBGG BTTTTCBTGT TGGBTTTTGC
GBCGGBCBGT CCCGCGGGGT GCTGAGTTTC TCTGGTTCCT CCGBGCGCBC GTGGTCGCTC CGCGTTTCTC
TGGTTCCTCC GGTCCCGCGG GGTGCTGTCT GGTCGCTGTC GTGGCTTGGG TCTCCGGGCG GTTTCCTTCC
TTTTCCGC CGGCCCTTCT CACTGGAGGC ACCGGGCAGT CCTCCATGGG AGGGTTGGGC TTGGCCGGGG
CTGCCCGGTG CCTCCTCTTG GCTGGTCCCT CGTTGTCCTT GGGCCCCGC TCCCGCTGCT CGGCCTCCGT
GTTCTTTGGC CTCTTGCTCC GCCTGCTGTC TTGTCCCGTC CCCTCCTCGC TTGCGTTTCC CTCTTCCTTG
TCTTCCAGGC CTTCCTCCGC TTCCGCTGCT GGGGCCCGCG CCGGGGGGGC GCTCGGCTCC GCGGCTTCCT
CCCCGGCTGG GGGGTCCTGG TCTCCGGGGC CTGCGGCTCG CGGGCTCGGG GCTGCGTGCG CCGCGCGCGG
CGTCCGCGGT GGGTGGCGCT GTCCCGCCGT GGTGTGTCTC CGTTCTCGTC CTGCGCCGTC CTGGTCTGCC
CGTGGGGTCC TGGGCGTGGT GGGGGGCGTC TGGTGCCTCG TCTGCCCCGT GGGGCTTCGG GCTCGGGGCT
GTTCGTCCCC CCTGCCGCTC TGTGGCCTCC GGGGCTCCTC GTTTTCGCTG CTTCGGGTGT CCTTCTCGGC
GTGTGGCCCC GGGTCCCGGC CCTGCTGGGC TGGGCGGGGT CGCTGCCCTG GCTTCTGGCC CGTCTGGTT
GTCTGTCGGT GCTTGTCTCG GGTTTCTGGC CTCTGTGCTG GGCGCTTCTC TGCCTCCTGC TCCGCCCTCC
TGGTGGCTCG GCTGGGGGTG CCCGTGCGGG GGTGGGTGTG GGGTGTTTTC GGGGTCCTCC CCTTCCC GTT TCA
TCT TGG CTT TAT CCTCT CCC CTT GTT CCT CCC CTCT CCT GCT CTG GRG TCT CCT C TTC CCT CCC TCC CCT
GCC GTG TTG TCT GTG GGT GTC GTT TCG CTC TTG TTG CCC TGG GCC CTT CCC TGC TGG GGG GGA GTT TCA
TCT TGG GTT TCB TCT TGG CTT TBT CCTCT CCC CTT GTT CCT CCC CTCT CCT GCT CTG GRG TCT CCT C TTC
CCT CCC TCC CCT GCC GTG TTG TCT GTG GGT GTC GTT TCG CTC TTG TTG CCC TGG GCC CTT CCC TGC TGG
GGG GGB TTT TCB TCT TGG GGG GGB GTT TCB TCT TGG CTT T CCGTGTTGTC BGTGGTGCTG CCCGTTTGBG
GTBTGGCGCT CCBCCBBTTC CCTTTTCTCC TTGTTTTCCG TTTCTCTTGC CGTCTGTGGT T GCTCAGCCTC
CAAAGGAGCC AGCCTCTCCC CAGTTCCTGA AATCCTGAGT GTTGCCTGCC AGTCGCCATG AGAACTTCCT
ACCTTCTGCT GTTTACTCTC TGCTTACTTT TGTCTGAGAT GGCCTCAGGT GGTAACTTTC TCACAGGCCT
TGGCCACAGA TCTGATCATT ACAATTGCGT CAGCAGTGGA GGGCAATGTC TCTATTCTGC CTGCCCGATC
TTTACCAAAA TTCAAGGCAC CTGTTACAGA GGGAAGGCCA AGTGCTGCAA GTGAGCTGGG AGTGACCAGA
AGAAATGACG CAGAAGTGAA ATGAACTTTT TATAAGCATT CTTTTAATAA AGGAAAATTG CTTTTGAAGT AT
ATCCTTTAAG TCAATGGACT TTGCATCAGT CACACCATCT TTTGTTACTT TGGACTTCCC CAGCTATGTT
CAATAATTAC TGTTCTTCCC TTGGGCCCCA TTGTAATGGC TACAGCCTCG ACAAAAGTC TACACTTTGA
AGCATTAAGG CTCGGACATC AGCACCAAAT TTTACATCTT TACCATCACT TCAAGTGAGG TGAGGAGCCA
GTAGCCTGGA CACTGGTCTC ATCTGGTGAA AGACTGTGGG TAATGGAAGC ATTTCTGTGG GGTGCTGGCA
```

-continued

```
GGACATGTGC ATGGCGAGGC AGGTCATCAG CAGCAAGTGA GAGCTGCCTC TTACTTTCTA AAGGTGACAT
AGCAAATATA CAAAAAAAAA TAAATAAATT ATTAATTTAG GTAGAGCACA TAAAGGCTTT ATTTCATATT
CCATTTCTCT GTATGCTTTC TTCACCAGGA AGAAATAGTT TTAGTGTCAG GAATGAATGA GTCTGCCCCT
CAATTCCAGC CTGCTCAACA CACAAGGAAA CAAAGCCCTG ACAATCAGAG TGACTCCCTG GTGACTAAGC
TCCCAGTCCT GGATGCATAT TTGTTTAGCA GTTCTGACAG CATTTGACCC AGCCCTCTCT CTGCATATCC
CATCAGAACC TTCTTTTTTT TTTTTTTCTT TGAGACTGAG TCTTGCTCTG TCGGAAGCGA CTCCTGTGCC
TCAGCCTCCC AAATACCTGG AATTATAGGC GTAAGCCATC ATGCCTGGCT AATTTTTGTA TTTTTCATGG
AGATGGGGTT TTGCCATGTT GGTCAAATTG GTCTCACACT CCTGACCTCA TGTGATCCAC CTGCCTCAGC
CTCCCAAACT GCTGGGATGA CAGGTGTAAG CCACCATGCT AGGCTCAGAA ATTTCCTTTT ATAAAAATGT
CATTAAGGAT CTTGGCTGCA CAATATCGTT ACCAGCTTCC TTTAAATCCA CTTCTGGCCT GCCAGGAATC
AGGTTCTTCA GAACCTGACA TTTTAAATGA AGAGGTCAGG CAGTTCATGA GGAAAGCCTC ATTGTCCCCA
TGTCTCTGTC ACTGCTGCAC CCCTGAGACA TCACAGACAT GGACACTGGG GCCTGCTTGT TTCTCAAACT
GCCCTTAGAT CGAAAGAGGG AGGAACCAGG ATGAATGCCA CTCATTTTCC CAAGAAAGGC CCTCTCCTGA
GTGCCCGGGA TGGGGCTCTG TCCATTGCCT GGGGCCGCCA ATTGCTACTC TGGGTTACGG AGGAAGGACA
GGGTCCTGAG AGACACCAGA GACCTCACAC AGCCCTGAAA ACATGGGGCT CCTTCATAAG TGTTTCCCAT
CACCAACAGG GAGACCACGT GGAGGCCTTG CAGCCCCACT CGGTGCTTCT CCACCAAATC CCAAGGGCAG
TGACGCTGAC GTCTGTGGAA AGCAGAGAAA GCCCTGGCTC CCAAAGCCCT GAAGTCCCTG TGGAGCTGAC
ATTCCCTGAG TGACGGTGTG AATGGAAGGA ACTCAAGTGC GGGTGGTAGG CCACCTCCTG GCCCAGGCCT
GGGTGAACTC TGAGGGACA CATGTAGTCA CAATCCCATC CTCCCATTCT CCTTCTCAGA GGAAGGAAGT
GGGCATCCAT CTGCCTCATC TCTCTCCCGT GGGGAAGATG GGGAGTTTCA GGGGAACTTT CACATAAATT
TCACCAGCTC AGATCTCCTG TGAGGATGGG GCCCACCATG CTCCCGGTGC TGCCACAGGC CCTGAGCCCC
TCCCAGGGTC CCTGGGTTTG AGCCAGCCCT GTATCATCCC CAGGAGCTGA ATGTCAGAGC AATGGATAGA
ATTAGATGGA AAGAGCTCTC AATTTGACCT GAGACTGTCC CCAGATACTC AGGAAAAACA GGACGTCGCA
CAGAGTGGGC AGCAGGTGAG TGGCAGGTTA TAGGTCCTGA GTTTGAGTTT GTTCTCACGT GAGACAGACC
CAGCCCCTCA CTCCATTCAC ACACTGGGTT TTAAATGGTG CAAGATAGGA GCAATTTTCT GGTCCCAAGA
GCAGGAGGAA GGGATTTTCT GGGGTTTCCT GAGTCCAGAT TTGCATAAGA TCTCCTGAGT GTGCATTGTT
CTTTGAGGAC CATTCTCTGA CTCACCAGGT AAGTGGCTGA ATTCTAACCT CTGTAATGAG CATTGCACCC
AATACCAGTT CTGAACTCTA CCTGGTGACC AGGGACCAGG ACCTTATAAA GGTGGAAGGC TTGATGTCCT
CCCCAGACTC AGCTCCTGGT GAAGCTCCCA GCCATCAGCC ATGAGGGTCT TGTATCTCCT CTTCTCGTTC
CTCTTCATAT TCCTGATGCC TCTTCCAGGT GAGATGGGCC AGGGAAATAG GAGGGTTGGC CAAATGGAAG
AATGGCGTAG AAGTTCTCTG TCTCCTCTCA TTCCCCTCCA CCTATCTCTC CCTCATCCCT CTCTCTCCTT
CCTCTCTCTG TGTGTCCCCT CCATCCTTTT CTCCTGCTTC TCTCTCTTCT TCCCTCTCTC TCTTTTTTCT
GTCTTTCTTT TTCCTCTCTC CCTAGAGCAT GTCTTTCTTT CTTTCTCTTT CCTTTCTTCT ACCCACACTT
TTAGACTGAA TGCCCTATTT AATTGAACAA AGCATTGCTT CCTTCAATAG AAAAGGAGTT TGAGAACCCA
ATGGACACCT CACTCGTTCT TCTAAGCCAA TATGAAGGAG CCCAGTAGCT TGTAAATATC ATCTCTTCAC
TGCTTTCCAT GCTACAACTG CTGAGACTAT GGTTGAAACC TGTTAGGTGA CTTTTTAAAT AAAAGGCAGA
AATTTTGATT TTATCTAAAG AAAGTAGTAT AGAATGTCAT TTTCTAAATT TTTATATTTA AAGGGTAGAT
ACTGCAACCT AGAGAATTCC AGATAATCTT AAGGCCCAGC CTATACTGTG AGAACTACTG CAGCAAGACA
CTCTGCCTCC AGGACTTTTC TGATCAGAGG CCCTGAGAAC AGTCCCTGCC ACTAGGCCAC TGCAGGTTCA
CAGGACAGGG TACAGCCCAT TGAAACCTAC TTTTAAACCT GGATGCCTAA CCTTCATTTT CTCCTTGATA
```

```
TTATGAAAAT AAAATAAAAA CCATGAAAGG ATAAAAGAGG GAGAGTGGAA GGGAAGGATG GAGAAAGGGA
AAAAGAAAAT TTGAGAGTAA ATCCTAAAAC AATTAATCTA ATAGATATCA TCTTGTGAAA TCCTCATTTT
ACCAATCTTA TTTATGAGTC CTGGGTTTTG TGAGAACAAT GGGGTTCTGA GAGGCACCAG AGACCTCATG
TTTTCCAAAA CCTAGAACAG TATAATGAAG GAAGGCGGGG AGGCAGGGAG GCAGGGAGGC AGGGAGGCAG
GGAGGCGGGC AGGTGGGGAG GGAGGGACGG AAGGAGGGAG GGAGGGAGGG AGGGAGGGAG GGAGGGATAA
AAAAAGAAGA ATGAGGTTGA AACCAGGACT TAGATATTAG AAACAAGCCA TTACAAAATT TATTTCTATG
GTTAATTGTG GTTTTCAACT GTAAGTTACT TGGTGTTAAT TTCCTATTAA ACAATTTCAG TAAGTTGCAT
CTTTTTATCC CATCTCAGGT CAAATACTTA ACAGACTAAA TGATTTGAAA AGCAAAAGT TTACTGGCTT
GTGTGTGTTA AAATGGAGGT ATGGTGGCTT TGATATTATC TTCTTGTGGT GGAGCTGAAT TCACAAGAGA
TCGTTGCTGA GCTCCTACCA GACCCCACCT GGAGGCCCCA GTCACTCAGG AGAGATCAGG GTCTTTCACA
ATCAGGTTCT ACAAAAATAA ACATCCCCCC AACCACAGCA GTGCCAGTTT CCATGTCAGA AACTTAGATC
CAAATGACTG ACTCGCGTCT CATTATCATG ATGGAAAAGC CCAGGCTTGA GAAAGAAGCC CGCTGCGGAT
TTACTCAAGG CGATACTGAC ACAGGGTTTG TGTTTTTCCA ACATGAGTTT TGAGTTCTTA CACGCTGTTT
GCTCTTTTTG TGTGTTTTTT CCCTGTTAGG TGTTTTTGGT GGTATAGGCG ATCCTGTTAC CTGCCTTAAG
AGTGGAGCCA TATGTCATCC AGTCTTTTGC CCTAGAAGGT ATAAACAAAT TGGCACCTGT GGTCTCCCTG
GAACAAAATG CTGCAAAAAG CCATGAGGAG GCCAAGAAGC TGCTGTGGCT GATGCGGATT CAGAAAGGGC
TCCCTCATCA GAGACGTGCG ACATGTAAAC CAAATTAAAC TATGGTGTCC AAAGATACGA ATCTTTATC
CTAGTAATTG TGGTCATTGG GTGATGTTGG TTTGGGCAGG CCATCTCTAA TATCCTTGAA ACACCTTTTT
CTGCTCTCCA GGAAGGGGTC AGGGCTGCCA CAGCGGGGCT TGGAGTGCTT TCCAGGGTCA CAGGCATCTG
TATTCTTTGG ATTCCTTGAC CTTCCCCATT TATTCCCGGC ATTTTCCTAA AACGTGTGCT TTGCTCCTCC
TGCATCCTCC CCTTGCATGC CCTCACCTAC CCCACATCTT CCCTAAAAAA AGCAAGCCCA ACTCAAAGAC
CAGTTCCCTC ATGGAATCAT AGTGGATCTG CCAAGGGAGG GGATGCCCAG TCCTCTGTTC TTCACAAGAC
TCCCTTCTTC TGGCTAAGGT TTCTTATGCA ATTAT CTGCAGTGGT AAAAGATTC TATATCTGCT GTTTGATGAA
TGCAGCACCC ACTAGCCACA TAGTGCTCGT GAGCACTTGC AATGCGGCTA GGGTGATTTC AATTAACCTA
AAAGAGAACA GCCACAGGGA GCATGTGGCT GCCATATTGG ATGGTGCTGC TTTGAGAACA AAATGAGAGA
AATGAAGCCT CTATTTACCT TGGTTGGCGG AACACATTGA AGGGACTCTG TATTGATACC AGGCTTCAAA
CTTTGGGAAG TGTACTGGCC AACTTAAACA CATCCACAGG AGAATGAAGA GGTTTGGGAA GGGACCAGAA
ACCAGGCATT GAGGACAATG AGAAGAGTTT TCAAAAGTG GAATTACTGC AAAAAGTGGA AAAATAGCCT
TTGGATGGAA GTTACTGATG AGACAATTTC CATCGGTGTG AAAGCCATCT TTCCAACAGA GATCTGCAAC
ATGAGAATGT ACTGTCTCCT AGGGTAGCGA TGGCCTCTTG TATTAGTCCG CTCAGGCTAC CAGATTTATC
GTTTAAACTG CCCATAAACA GACCAGGCAG TTTAAACAAC AGAAATTTAT TCCTCGCAG TCCTGGAGGC
AGGAAGTCTG CGATCAAGGT GGAAGCAGGG TTGGCTTCTT CTCAGGTGTC TGTCCTTGGC TGGTAGATGA
CCGCCGCCTC CCTGGGTCCT CACATGGTCT TTCCTCTGTG TGTGTCTGTC CCAATCTCTT CTTATAAGGA
TGCAAGTCTT ATGGATCAGA GCACACCCCA ATGACCGTGT TAACTTGAA TCACCTCTTT AAAGTTTCTC
TCTCCAAATA CAATCACCTC CTGAGGCACT GTTAGGGCTT CGACACAGGA ATTCTTTTCC TAGGGGATTC
AGTTCAGTCC AAAACGCCTA CCAGTGGAGA CTTGCAACAT GGCGGCCTGC TGGTCCCTCG CCAGGAATAT
CACAGGCGAC TGTTCCCTGT TGCATGGAAT AGAAGGCTAT TCCAGAGTAC TGTCTCTATT TATCAGATCT
GGATACTGG GAGAAGGGCA AAATAAAGTC CAAGTAGAAA AAAAACTAT GAAAGTTTTA GAGAGTAACC
ATAATTTCAG CCCGATGTGA AACGATCCTA GATTTCAGCT GAAATAGTGA TGTGGGAAGT GAGGGGGCCG
```

```
GGATTCAAGG CAGAGGGAAC AGCGTAACTG AAGGCATGGA AGGAGGGAAG TGTAGGCTGT GTTTGAAGAG
TGGCAGCTGC TTCCACATTT CTAAAACACA GGATGTGATT TTGGGGTGTG TTGAGACAAG GCAGAAAACT
TGTTTGGAAA AATAACTTGA ATTCCCTGCA CATTTAAAAT CTCTCAGCAG AAGAAAACCC CACTCAGAAC
CCCACTGTTC ATTCCTTGGC TTGTATTTGG SCACAGCTGG CATAGCCCCA GACTGAGTAA GCTCTTCAGA
CACCTCATTT CATGAGTAGC CCCAAAGATC AATCATGGGC CAATTTCTTG GAAGAGAAGA CTCTCCGGTG
TTTTGCAGTT ATTTGTTCTG CTTTCGCGAG ATGTTCTCAA ATCGTTGCAG CTACAAGCCA TGAGTCTGAA
GTGTTTGTGT TCCCTCCTTA CAGGTGGTAA CTTTCTCACA GGCCTTGGCC ACAGATCTGA TCATTACAAT
TGCGTCAGCA GTGGAGGGCA ATGTCTCTAT TCTGCCTGCC CGATCTTTAC CAAAATTCAA GGCACCTGTT
ACAGAGGGAA GGCCAAGTGC TGCAAGTGAG CTGAGAGTGA CCAGAAGAAA TGACGCAGAA CTGAAATGAA
CTTTTTATAA GCATTCTTTT AATAAAGGAA AATTGCTTTT GAAGTATACC TCCTTTGGGC CAAAATGAAT
CTTGTGTCTC AATTGGAAGA GGTAAAGAAG TAGGGGGTTA GGGTGCATGG GTTGGAACGT GAGACAGGTC
GAACCACAAA GCCTGCCTGG AAAAGGGGAG TGACGTCCTA GGCTTCAGTG ATGTCACCTC CACTTTGTTT
GATCCACAAA CCAACAGGTG ACTGATTTTG GTCAGCTCAG CCTCCAAAGG AGCCAGCCTC TCCCCAGTTC
CTGAAATCCT GAGTGTTGCC TGCCAGTCGC CATGAGAACT TCCTACCTTC TGCTGTTTAC TCTCTGCTTA
CTTTTGTCTG AGATGGCCTC AGGTGGTAAC TTTCTCACAG GCCTTGGCCA CAGATCTGAT CATTACAATT
GCGTCAGCAG TGGAGGGCAA TGTCTCTATT CTGCCTGCCC GATCTTTACC AAAATTCAAG GCACCTGTTA
CAGAGGGAAG GCCAAGTGCT GCAAGTGAGC TGGGAGTGAC CAGAAGAAAT GACGCAGAAG TGAAATGAAC TT
GAATTCACAT TTCTCACCTT TTGATGTATT AAGAAAGTAT GGAGAAATAT ATCCTCTATC AAATTTTCAT
GCCTTCAATA ATTTCTAATT CATCAGTCAG TGTTTTTCCA TCCTTTACTG TGATGATGCC CTTTCTTCCA
AACTTTTTCA TTGCATCAGA GATGATGTTA CCAATTTCTT TGTCTCCATT TGCAGAAATT GTAGCAACCT
GTGCAATTTC TTCAGGTTTG GTCACAGGTT TAGACTGCTT TTTAAGTTCA GCAATTACAG CATCAACAGC
TAACATCACA CCTCTCTTGA TTTCCACTGG ATTAGCACCT TTGCTAACCT TCTGAAGGC TTATTTGGAA
ATAGAGCATA CCAGTACAGC AGCAGTGATA GTGCCATCCC CCAGTCTCTC CATTTGTGTT ATTGGCAACA
TCTTGGACAA GTTTAGCTCC AATGCTTTTA TATTTATCCT TTAAGTCAAT TGACTTTGCA TCAGTCACAC
CATCTTTTGT TACTTTGGGA CTTCCCCAGC TATGTTCAAT AATTACTGTT CTTCCCTTTG GCCCCATTGT
AATGGCTACA GCATCGACAA AAAGTCTACA CTTTGAAGCA TTAAGGCTCA GACATCAGCA CCAAATTTTA
CATCTTTACC ATCACTTCAA GTGAGGTGAG GAGCCAGTAG CCTGGACACT GGTCTCATCT GGTGAAAGAC
TGTGGGTAAT GGAAGCATTT CTGTGGGGTG GTGGCAGGAC ATGTGCATGG TGAGGCAGGT CATCAGCAGC
AAGTGAGAGC TGCCTCTTAC TTTCTAAAGG TGACATAGCA AGTATACAAA AAAAAATAAA ATATTAATTT
AGGCAGAGCA CATAAAGGCT TTATTTCATA TTCCATTTCT CTGTATGCTT TCTTCACCAG GAAGAAATAG
TTTTAGTGTC AGGAATGAAT GAGTCTGCCC CTCAATTCCA GCCTGCTCAG CACACAAGGA AACAAAGCCC
TGACAATCAG AGTGACTCCC TGGTGACTAA GCTCCAGTCC TGGATGCATA TTTGTTTAGC AGTTCTGACA
GCATCTGACC CAGCCCTCTC TTTGCATACC CCACCAGAAC CTTCTTTTTT TTTTTTTTC TTTGAGACTG
AGTCTTGCTC TGTCGGAAGC GATTCCCGTG CCTCAGCCTC CCAAATACCT GGAATTATAG GCGTAAGCCA
TCATGCCTGG CTAATTTTTG TATTTTTCAT GGAGATGGGG TTTTGCCATG TTGGTCAAAT TGGTCTCACA
CTCCTGACCT CATGTGATCC ACCTGCCTCA GCCTCCCAAA GTGCTGGGAT GACAGGTGTA AGCCACCATG
CTAGGCTCAG AAATTTCCTT TTATAAAAAT GTCATTAAGG ATCTTGGCTG CACATATCG TTACCAGCTT
CCTTTAAATC CACCTCTGGC CTGCCAGGAA TCAGGGTTCT TCAGAACCTG ACATTTTAAA TGAAGAGGTC
AGGCAGGTCA TGAGGAAAGC CTCATTGTCC CCATGTCTCT GTCACTGCTG CACCCCTGAG ACATCACAGA
CATGGACACT GGGGCCTGCT TGTTTCTCAA ACTGCCCTTA GATCGAAAGA GGGAGGAACC AGGATGAATG
```

-continued

```
CCACTCATTT TCCCAAGAAA GGCCCTCTCC TGAGTGCCCG GGATGGGGCT CTGTCCATTG CCTGGGGCCG
CCAATTGCTA CTCTGGGTTA CGGAAGAAGG ACAGGGTCCT GAGAGACACC AGAGACCTCA CACAGCCCTG
AAAACATGGG GCTCCTTCAT AAGTGTTTCC CATCACCAAC AGGGAGACCA CGTGGAGGCC TTGCAGCCCT
ACTCGGTGCT TCTCCACCAA ATCCCAAGGG CAGTGACGCT GACGTCTGTG GAAAGCAGAG AAAGCCCTGG
CTCCCAAAGC CCTGAAGTCC TGTGGAGCTG ACATTCCCTG AGTGACGGTG TGAATGGAAG GAACTCAAGT
GCGGGTGGTA GGCCACCTCC TGGCCCAGGC CTGGGTGAAC TCTGAGGGGA CACATGTAGT CACAATCCCA
TCCTCCCATT CTCCTTCTCA GAGGAAGGAA GTGGGCATCC ATCTGCCTCA TCTCTCTCCC GTGGGGAAGA
TGGGGAGTTT CAGGGGAACT TTCACATAAA TTTCACCAGC TCAGATCTCC TGTGAGGATG GGGCCCACCA
TGCTCCCGGT GCTGCCAGAG GCCCTGAGCC CCTCCAGGGT CCCTGGGTTT GAGCCAGCCC TGTATCATCC
CCAGGAGCTG AATGTCCGAA CAATGGATAG AATTAGATGG AAAGAGCTCT CAATTTGGCC TGAGACTGTC
CCCAGATACT CAGGAAAAAC AGGACGTCGC ACAGAGTGGG CAGCAGGTGA GTGGCAGGTT ATAGGTCCTG
AGTTTGAGTT TGTTCTCACG TGAGACAGAC CCAGCCCCTC ACTCCATTCA CACACTGGGT TTTAAATGGT
GCAAGATAGG AGGAATTTTC TGGTCCCAAG AGCAGGAGGA AGGGATTTTC TGGGGTTTCC TGAGTCCAGA
TTTGCATAAG ATCTCCTGAG TGTGCATTGT TCTTTGAGGA CCATTCTCTG ACTCACCAGG TAAGTGGCTG
AATTCTAACC TCTGTAATGA GCATTGCACC CAATACCAGT TCTGAACTCT ACCTGGTGAC CAGGGACCAG
GACCTTTATA AGGTGGAAGG CTTGATGTCC TCCCCAGACT CAGCTCCTGG TGAAGCTCCC AGCCATCAGC
CATGAGGGTC TTGTATCTCC TCTTCTCGTT CCTCTTCATA TTCCTGATGC CTCTTCCAGG TGAGATGGGC
CAGGGAAATA GGAGGGTTGG CCAAATGGAA GAATGGCGTA GAAGTTCTCT GTCTCCTCTC ATTCCCCTCC
ACCTATCTCT CCCTCATCCC TCTCTCTCCT TCCTCTCTCT GTGTGTCCCC TCCATCCTTT TCTCCTGCTT
CTCTCTCTTC TTCCCTCTCT CTCTTTTTTT CTGTCTTTCT TTTTCCTCTC TCCCTAGAGC ATGTCTTTCT
TTCTTTCTCT TTCCTTTCTT CTACCCACAC TTTTAGACTG AGTAGACTGA ATGCCCTATT TAATTGAACC
AAGCATTGCT TCCTTCAATA GAAAGGAGT TTGAGAACCC AATGGACAAC TCACTCGTTC TTCTAAGCCA
ATATGAAGGA GCCCAGTAGT TTGTAAATAT CATCTCTTCA CTGCTTTCCA TGCTACAACT GCTGAGACTA
TGGTTGAAAC CTGTTAGGTG ACTTTTTAAA TAAAAGGCAG AAATTTTGAT TTTATCTAAA GAAAGTAGTA
TAGAATGTCA TTTTCTAAAT TTTTATATTT AAAGAGTAGA TACTGCAACC TAGAGAATTC CAGATAATCT
TAAGGCCCAG CCTATACTGT GAGAACTACT GCAGCAGACA CTCTGCCCCC AGGACTTTTC TGATCAGAGG
CCCTGAGAAC AGTCCCTGCC ACTAGGCCAC TGCAGGTTCA CAGGACAGGG ACAGCCCATT GAAACCAACT
TTTAAACCTG GATGCCTAAC CTTCATTTTC TCCTTGATAT TATGAAAATA AAATAAAAAC CATGAAAGGA
TAAAAGAGGG AGAGTGGAAG GGAAGGATGG AGAAAGGGAA AAAGAAAATT TGAGAGTAAA TCCTAAAACA
ATTAATCTAA TAGATATCAT CTTGTGAAAT CCTCATTTTA CCAATCTTAT TTATGAGTCC TGGGTTTTGT
GAGAACAATG GGGTTCTGAG AGGCACCAGA GACCTCATAT TTTCCAAAAC CTAGAACAGT ATAATGAAGG
AAGGAGGGAA GGAGGGAGGG AGGGAGGGAA GGAGGGAAGG AGGGAGGGAG GGAGGGAAAC AAAAAGAAGA
ATGAGGTTGA AACCAGGACT TAGATATTAG AAACAAGCCA TTACAAAATT TATTTCTATG GTTAATTGTG
GTTTTCAACT GTAAGTTACT TGGTGTTAAT TTCCTATTAA ACAATTTCAG TAAGTTGCAT CTTTTTTATC
CCATCTCAGA TCAAATACTT AACAGACTAA ATGATTTGAA AAAGCAAAAG TTTACTGGCT TGTGTGTGTT
AAAATGGAGG TATGGTGGCT TTGATATTAT CTTCTTGTGG TGGAGCTGAA TTCACAAGAG ATCGTTGCTG
AGCTCCTGCC AGACCCCACC TGGAGGCCCC AGTCACTCAG GAGAGATCAG GGTCTTTCAC AATCAGGTTC
TACAAAAATA AACATCCCCC AAACCACAGC AGTGCCAGTT CCATGTCAG AAACTTAGAT CCAAATGACT
GACTCGCGTC TCATTATCAT GATGGAAAAG CCCAGGCTTG AGAAAGAAGC CCGCTGCGGA TTTACTCAAG
```

-continued

```
GCGATACTGA CACAGGGTTT GTGTTTTTCC AACATGAGTT TTGAGTTCTT ACACGCTGTT TGCTCTTTTT
GTGTGTTTTT TCCCTGTTAG GTGTTTTTGG TGGTATAGGC GATCCTGTTA CCTGCCTTAA GAGTGGAGCC
ATATGTCATC CAGTCTTTTG CCCTAGAAGG TATAAACAAA TTGGCACCTG TGGTCTCCCT GGAACAAAAT
GCTGCAAAAA GCCATGAGGA GGCCAAGAAG CTGCTGTGGC TGATGCGGAT TCAGAAAGGG CTCCCTCATC
AGAGACGTGC GACATGTAAA CCAAATTAAA CTATGGTGTC CAAAGATACG CAATCTTTAT CCTAGTAATT
GTGGTCATTG GGTGATGTTG GTTTGGGCAG GCCATCTCTA ATATCCTTGA AACACCTTTT TCTGCTCTCC
AGGAAGGGGT CAGGGCTGCC ACAGCGGGGC TTGGAGTGC GAATTCCCTG TAAGCCCTGT TACAGGGGCT
GCACCCCAGA TACAACCTGA CCTGTGTCCA AGGCGGGCAA CTCAACCCTT AGATATTGAA TGGGTCCCAT
GGCACCAATG CTTAAACACC AGCAGCCCTC ACAACCACAG ATCGTGTTTT AAGGATGAGG AGGTAGTTCT
CTGGATGCAC AGGCTTCAAT CCAAATGGGC TCATGACGCC GCAGCACACA CCCAGTCTGC AGCCTGAAGA
GTTGGAGCAT TGCATTCACA GAAAGCATCC AGACATGATC ATGGGCTCAG GGATACACCT GTTCTCCGAT
GTGTACCAGT GAAGGATGGA AACTCCTATG CCTCCCAGAA AGCACCACTC AAGCTTTTGC TGAATGCTTC
TCTGAAGGCC CACAAGGCTG AGAGGCTGTG CAACACCAGC AGTAAAGTGA ATGCCCAGAC TCCCACCTCC
TTTCTTGGGT GGCCATCTGG AAAGGCCACT CCCACCCTGA TGGCTAATGC CTCAGACCAG TTCTTGGCCC
AGATGATCCT AGACAATTGT TTAAGCTTAA ACTGTTCATT GGCCAAGCAA ACAGGTGATA GTACCTCTGG
GGAACCACAT GCCGCGTGTA CATCCAGATC TCAGGAGAAC CCAAAAATGT CTGTTCCACA TAGCAACAGA
AGCCCAGGTA GCACTCAGTC TCACCTGGGT GTTCTCCAAC ATCCCAGCTC AGCCAAATGG CTTTCATTAG
TTTTTATGGT TAGACCCCAG GTCCTCGGGA CACTGCTTTA GAAACACATT CCAAATCCTC CTCTGTGTGC
AGGTGGCATT CCTATCCCAA TCTCTTTGCA GGGCGTATAC TGTGATACGC AGCCAGGCTG TCCCAGAGGC
CTTAAATATT CCCTTGGTGC AGGTAGTTCA GCTTAGCCAC AGCCAATGCA TCACAGGGTC AACTGTGTTA
GGAGCCATTG AGAATCCATA GTTGGTTGCT GCCTGGGCCT GGCCAGGGCT GACCAAGGTA GATGAGAGGT
TCCTCTGTGG AGTTCTACTT TAACCTCACC TTCCCACCAA ATTTCTCAAC TGTCCTTGCC ACCACAATTA
TTTAATGGAC CCAACAGAAA GTAACCCCGG AAATTAGGAC ACCTCATCCC AAAAGACCTT TAAATAGGGG
AAGTCCACTT GTGCACGGCT GCTCCTTGCT ATAGAAGACC TGGGACAGAG GACTGCTGTC TGCCCTCTCT
GGTCACCCTG CCTAGCTAGA GGATCTGTAA GTACTACAAA ACTTAAACTT TACACTGAGT TTTCATCATT
GAAGCTATGC CTCCAATCTG ACCTCTGACT GTGGGGCCGC CCCAGAGGGA CCCAGCGGGT GAATCCCTGC
TAGGAACGTC TGTCCGGACC TCTGGTGACT GCTGGGGACG ATGGCTTCCA GCTAACTTAA TAGAGAAACT
CAAGCAGTTT CCTTCTAAAT ACACATGTCA CATGTCCTGG TTGACATGTC CAGTAAGAAG ACTATCACAG
GTCTTTGGAA CATTCTTTTG AGAGAAACCT ATTTAGGTCC TTGGTCTGTT TTTCAATCAG GTTGTTTGAT
TTTTGCTATT GAGTTGTTGG AATTCCTTAT GTATTCAGAT ATTTGCCCCT TCTGCCATGT AGGTTTTGCA
AATATTTTCT CTCATTTTCT GGGTTATCTT TTCACTCGGT TGATTGTTTC CTTTGCTGTG CAGATGCTTT
AGCGTTAAAT GAAGCCACAC TTGTCTATTT TCCCTTTTAT TGCCTGTGCC TTTGGTGTCA TAGCCAAGAA
ATCATTACCT ACATCAATGT CAAAAGCTTT ATCCTTCTAT ACACTTCTAG TAGTTTATGG TTTCAGTTGT
TACATTTAGG TTTTCAATTC ATTCTGAGTT GATGTTCCTA CATGGTGTGA GATAAAGATT TAAATACATA
CATATATAAA ATCATGAGGT AGTGTACACT ATAAATATAC AATTGTTAAT TGTTACTCAA GTCTAAGTAG
AGGTGGAAAT AATAAACTTT CTTTTTTTTA CTTAAACCAC TCTGTGTCAC TGAGCTGATT TCACCTTTAG
CCTGATAAAA TCATTGTCCT CTCCACCCTG ATTCCTACAG GAGACTACTC ACCCCATAAC CTCAAAAACC
TCTTCATGAG GATGGTAAGT CACCTGAATC CTGAAGTGAA TTACTCGCTA TTCCATTGGA ACTCATATAG
GACACCAGAA TCTAGACCTC CAGAGAACAG CAGGACCCAT CTTCAGAAAA TAAGAAGCAT TTGTTCCCTG
AGCCTGTTGA ATCAAAGTGC AATTTCTATT CTTTTTGGAA TGTTAAAAAG TGAATCATAA TATTTAAGCA
```

```
GGTGAACCCA CGAGTAACAT AGCAGGGTCT TTCTTGTCAT TATTAGCTCC AACCTAGCAC AGACATTAAA

GGTACAGATG TATACTAGCA TGAAACTGGG AGAACAGGAG CATTCGAGCA ACCTTGAGAC CAATGGGCCT

CTCTTATAAA ATGCACACCT CCTCTCACTG AGATTGAGGA AGGTTTCTTG TCTCCGAGCC TTCTCCCAGT

AGAGCTATAA ATCCAGGCTG GCTCCTCCCT CCCCACACAG CTGCTCCTGC TCTCCCTCCT CCAGGTGACC

CCAGCCATGA GGACCCTCGC CATCCTTGCT GCCATTCTCC TGGTGGCCCT GCAGGCCCAG GCTGAGCCAC

TCCAGGCAAG AGCTGATGAG GTTGCTGCAG CCCCGGAGCA GATTGCAGCG GACATCCCAG AAGTGGTTGT

TTCCCTTGCA TGGGACGAAA GCTTGGCTCC AAAGCATCCA GGTGAGAGAG GCAGGCATGC AGAGCTGCTA

AGTCTAGAGG GAAGGACGGG AGAGAGGTTC CAGAGTTGGG TCTCAGCAGT CTATGTCACT GAGGTGGCTT

CACTTAGAAT CTCTGGGCAT TGATTTTCTC ATCTAGAAAT TGAACAGAGA GCCAAATAAA CCTGAGAAAC

TTTATTTCTC CAAAGACTTG ATTCCAAGAA ACATCTGTGA AATTCACTAA GTTTAAGATA TGAAGAGACA

GACTAGTTAT TTCTGGATCT AAACAAGTAG ACTTAGTTGT AAAGAGAACA TTTTACTCTA TCTACAGAAG

AGCTTTTAAA AACTGCAGCC AAGCCTGAGG GTAAGTTCAG GTGTGTGTGT GATGGGGCAG GAATGCAAAA

ATGAGAGCAA AGGAGAATGA GTCTCAAATT CTGTGTGACA AGCACTGCTC TGCGTGTTTA TTCCTATCGA

CTGAGGTTGT TCGTGCTACC GGCTGCAATG CAGCCAGCAT CACCTGTCAG CTAGCATGTG ACTTCCCCGA

GATTCTTTTT CTTACCCACT GCTAACTCCA TACTCAATTT CTCATGCTCT CCCTGTCCCA GGCTCAAGGA

AAAACATGGA CTGCTATTGC AGAATACCAG CGTGCATTGC AGGAGAACGT CGCTATGGAA CCTGCATCTA

CCAGGGAAGA CTCTGGGCAT TCTGCTGCTG AGCTTGCAGA AAAAGAAAAA TGAGCTCAAA ATTTGCTTTG

AGAGCTACAG GGAATTGCTA TTACTCCTGT ACCTTCTGCT CAATTTCCTT TCCTCATCTC AAATAAATGC

CTTGTTACAA GATTTCTGTG TTTCCACCTC TTTAATGTGT GATATGTGTC TGTGTCAAGA CACTTGGGAT

ACACGTACCA AAACGCAAAA TCAAATTTTT GAACAATATA CCTACCTTGC TATAGAAGAC CTGGGACAGA

GGACTGCTGT CTGCCCTCTC TGGTCACCCT GCCTAGCTAG AGGATCTGTG ACCCCAGCCA TGAGGACCCT

CGCCATCCTT GCTGCCATTC TCCTGGTGGC CCTGCAGGCC CAGGCTGAGC CACTCCAGGC AAGAGCTGAT

GAGGTTGCTG CAGCCCCGGA GCAGATTGCA GCGGACATCC AGAAGTGGT TGTTTCCCTT GCATGGGACG

AAAGCTTGGC TCCAAAGCAT CCAGGCTCAA GGAAAAACAT GGACTGCTAT TGCAGAATAC CAGCGTGCAT

TGCAGGAGAA CGTCGCTATG GAACCTGCAT CTACCAGGGA AGACTCTGGG CATTCTGCTG CTGAGCTTGC

AGAAAAAGAA AAATGAGCTC AAAATTTGCT TTGAGAGCTA CAGGGAATTG CTATTACTCC TGTACCTTCT

GCTCAATTTC CTTT GATCAAAATT TTTACCTATT ATGCATTTGA TATATAAATA AGTATATAAA TGCACACACA

GACACAGCAA TGATGGTGAA CAGTCTTCAT ACAATTATAT GGATGAATCT CATAAAATGC TGAGTTAAAG

AAATCAGACC AAAGAACATA TACTGAAAGA TTCTCTCTAT ATACAAAGTT CAAAAATAGG TGGACCAATT

CATGGTGGTG TTAGAAATCA GAAGAGAGGC TACCTTTGTG GGGAGGGGAC AGTTTAATGC CCAGAAGCGG

TAAATAAGGA ATCCTCTGGG GAGTGGTAAT GATCTGGATG CTGGCTACAG GATGTGTTGG TTGTAAAAAT

GCATTTTTT ATATCTAGCT TTTTCCATGT GTATATTATA CTTCAAAGAA GTTCAGTTAA TAATTTCTCA

TGTCACTGTA GAGTAGCTCA GTTAGCCCCA GCAAGCCTCT GGCTTAATCT TGTTTTACCT TAAGCCATCA

GTCATTTACA AGTAGGAAAA TTCACAGGGA AAGTTAGAGT ATAAAATCCA GAATGAAGGT TTACTGGGTA

AGAGTCTCTC CATTTTCCAA AGCCCGTTTA TTTCTTGATT CCAGTTCTTA AGGAGTCTCA GCATTGTGTC

TTTTTCATGT ATCTTACAAG AAGACAGCAT GTGCTTCTAA CACCTGATAC ATTGTATCTA CCAGCACTTG

GTAAACAGAA AAGAACCACA TTTTTCTTGT AGGAGAAATT TGGTGCCTAT TTCCTACCAG GCACCAATAA

GTGGGACCAA TAGGTGGGAT TAAAGATACA GTAGAAAGTA TTTAAAACTT GCCAGGGGGC AATAGTCTGA

AAATAAGTAA ATTGGTGCTA TAGAATGGAA GTTACAGGCT TCTTTCTTTT TTCCCACAAG ATCTGCTCCT
```

-continued

```
TGAGCCCCTA GAGACTTTTC TGTCTGTTAC TGTTTCTTCA TTCCTCATCT GCAGAGCCAG CCCTGAGAAG
TGCAGACCAA AGCCAGGGAA GGCTCTGCAA AGATGTACAA ATGGAAGTCA CCTTAATAAC CTCTGACTGC
TGCGCATAAT ACATTTCACT CAAAAGAGGG GTTAAACAAT GGAACAGAAT ACAGAGGCCA GAAATAATGC
TGAACACTGA CAACCATCTG ATCTTTGACA AAATCCACAA AAACAAGCAA TGGAGAAAGG ACTCCCTATT
CCATAATGGT GCTGGGATAA CTGTCTAGCT ATATACAGAA GATTGAACCT GGGCCCCTTC CTTACATCAT
ATACAAAAAA TAACTCAAGA TGGAGTAAAG ACTTAAATCT AAAACCAAAC ACTATAAAAA CCCTGGAAGA
TAGCCTGGGA ATACCATTC TGGACATAGG ACCTGGCAAA GACTTCATGA CAAGACACCA AAAGCAATAG
CAACAAAAAC CAAATTGACT AATGAAACTA ATGAAACTCT TTAGTTGTAC AACAGATAGT TTATCTGTAC
AACAAAATAA ACTATCAACA GAGTAAACAA CCTACAGAAT GGAAAAATTT TTTGCAAACT ATGCATCTGA
CAAAGGTCTA ATATCCAGAA TCTATAAGGA ATTTAAACAA ATTTACAAGC AAAAAAATGA CCTCATTAAA
AAGTGGGCAA AGGACATGAA CAGATGCTTT TCAAAATAAG ACATTCACAC ATCCAACAAC CATATGAAAA
GATGTTTAAC ATCACTAATC ATTAGAGGAA TACAAATCAA AAGCATAATA AGATACCATC TAATACCAGT
AGGAATGACT ACTATTAAAA AGTCAGACAA TAACAGATGC TGGTGAAGGT TGTGGAGAAA AGGGAATGTT
TATGCACTGC TAGTGGGAAT GTAAACTAGT TCAGCCATTG TGGAAGAGAG TGTGGTGATT CCTCAAAGAA
TGTAAAACCG AACTGCCTTT CAATCCAGCA ATCCCATTAT GGATATACA CCAAAAGGAA TAGAAATTGT
TTTACCGTAA AGGCGCATGC ATGCATATGT TCATTACAGC ACTATTTACG ATAGCAAAGA CATGGAATCG
TCTAAATGCC CATCAGTGGT AGACTAGCTA AAAAAAAAAA AATGTGGTAC ATATACATCA CAGAATAGTA
TGCAGCCATA AAAATGAACA AGATCATCAT GTCCTTTGCA GCAACATGGA TGTAGTTGGA GGCCATTATC
CTAAGCAAAT TAATGCAGGA ACAGAAAGCC AAATACCACA TGTTCTCATT TATAAGTGAC AGCTAAATAT
TGAGTACACA TGGACACAAA GAAGGGAACA ATAGACATGG GACCTACTTG AGAATAGAGG GTGGGAGGAG
GGTGAGGATC AAAAAGTACC CATAGGACAC TGTGCTTATT ACCTGGGTGA TGAAATAATT TGCACACCAA
ACCCCTGTGA CACACAATTT ACCTATATAG AAAACCTGTG CATGTACCCC TGAACCTAAA AGTAATGGT
GGGGGGGTGG GGTTAAGCTA CTTTGTGGTA TAAATCTGAG CATTCATATT AAAATAAAAT ATTTACCTCA
TTAGAGTAAT TAACATTTAT TAAGCAAAGA GCCAAGTACC TTACACACAT GATGTTTAAT CTCACAATGA
TCTTTAATCT CATAACAACC GTCCATTGTA TGTACATATG TGGAAATTGA GCCTTGGAGA GATTAAATGC
ATGGGGCATG CCATTTGACT AGAAACTGGA AGCATCAGGA TTTAAACTCA GTTCTGAATG GTTTTGTAGG
CTTTGTTTTT TCCACATTAT AGCATGGCCT GCCATGAAGA ACAGGTCCTT TCTGGTGTTT GTCTTGTTTG
GTTTAAGTGA AGCAAATATT TATTTAAATA TTCAAGATAT GCTGTTAAAT TTTTACTCAA AAATTTGAGT
ACAGTATGGA TCTTCTGAAG CCAAATAACT CTTATTCAAT GCTTAGTTGA GAAATTTTAT GGAGTAGTTC
TCAATTTTTA TGTAGTTCCA CTGCAAAGGT AAGTCTTATG GAAAGATTCA CTGTAATTTT TTTTCCTCAT
TTGGACATCA GCTTTTTCTT TTCCTCAGAC CCGCTGAAAG ATAATTTTTA AAATAAAAAC CTTGTTTTTA
TATCAAGTGG GGACATTTTT TCCAAATGAA AACCGTGTAT TCATTTTATA TGATAAAATC AATGTTATTA
TTTTTAAAAT TTTGATTTAA AAATCATTAA AAATAAATTT TCAGATATTA CCTGAAATTC TACCATCCAG
AGATAATAGT GCTTAAAGAT TTGATATATA GACACACACA CATATATACA TATATATCAT CCTAAACTTC
TTTGTATAAA TGTATATAAA GTTTTTAATA AAAACTAGGA GATTAATGCC CTTTGAATGA AAATAAATAC
AATGTGTATG CTTTAACATC TTGCCTTTAC TTTATAACAT TTATCACAGC AGTCATGAGA TAATGATTTA
CATGGTCATT GTTAGTAAGC TAATAGCTAA GTGCATGAAC TCTGGAGCTA GCCTCCCTGG ATTTTAATCC
CAGATCTGTC ACTGACCAGC TGAGCAATAC TAGGTAAATT GCTCTTGTTC CTTAGTTTCT TCATCTGTAA
AATAGAGATA AAAATAATAT CCACCTCATA GGATTGGTGT GAGCATTAAA TGAGCATACG TATGTAGGCC
ACTTAACAAC AATGCCTTCA CATACTGAAC ACAAATATAC GAGCTGTTGT CTTATTGGGC TCATGTTTTT
```

```
CCTACCACTA AGCCGCATGC ATGCAAGGAC CATGTTGGTT TTGTTCCACA TTGCATCCCC AACCTGGTAT
ACAGTGTGCA TTCAATAGTT GTTGACTATT ATTACTAGTG GCATTTAACA AATATCTGTT AAATGAGTGA
AGAAATACCC ATTTACTGCA AGTGTGTCTA ATATTGATGG CATAATGGGG GAAACTCAAA CTCTGGAGTC
AAACAGGTTT TAAAACCTTA TTCCCTCATC CTCAGTTATT GACGTTTTTT TTTTGGCAGG TGTGTGTGTG
GGACAACTTA TTGAACTTTT CTGAATTTCC AGCTTCGCAT ATATAAAATA GAGATAGTGA TTCATTCTTG
CAATGTATGG ATTTGAGACA ATTGTGTAAG TTTATCAATA AATAGTAGCT ATTTTTGTAT AAGTATTACA
TATAATATCC AGGCCACTGC TTTGCATAAC CCAAAAGGGG CACCATTCAT GCAGAATACA ACATAAATGG
TGTCCCTGGA GCAGTGCAGT ATAGGAACCC TGAGGGGACC TACAGTATAC TTTATAGTTC ATAGATTACA
AATTATCCCT TTATCAGAGT CTCTCAAGGT TGGATGTATT TGAGGTCCAT AAGAGCAATT TAGGATTAAC
AGTAGCTGCA GAAACCATCT GCAGTGATAT TCTCATTTTA AATCCGCGGG AAAGAAGACA GCTATAAACT
TGGGACCTGG GTTAAGCAT TTTAAATGCC AAGTTCACCA TTTTCTAAAA CACAACAAAT ACCCAGTGAG
AGAGGGAGAA GGGAAGTAAA TGCCTCTGAA TAAGCAAGTT AATGTCAGTA GTTGTACTGT ATGCATATTG
ATGAACAATA GAGGAACCAA TGTCCAATCA GATGAGCAGG ATATTTGGCA ATAACAAGTT GCCTTTGAGG
AAAAATGATT TTCTTGGCAA GTTCTTTATC AGCATTACAA AGCTAAAAGC TACGCTTATC ATCACTTATA
CTAGCATACC CTGTTGTGCA AATGCTGTCT GTGTTTGCAT CTGCTATTGT TGATGCCTGG TGCATGAATC
AGGACTCCAG CCCACAAGTT TTCCCAGAAC TTTCTTATGG CCATCATCTT TAAGTGTCTG GTGAACAGTC
ATAGTTTGGT ACACAAAAGG GTCAACCTGG GGGATGGCTA GGGTTTGACT CAGTCGTTAC ATTTCAATAG
AGCAGGAAGG GGAAATGGTG GCCTGTAACC TCAGGGAATT TGCCAGTTG GTCCACCCCA CTCTCTCTCT
CCTGCTCTGA GGAAGTGGCA CAGCCTAGAA CAGCACCACA GGTGAGAGAA ATGCAAACCC TAACCAGAGA
AGCAGACTCT TTGCCAGTAG TAATAGTTCA GGACCACCAC CAGCTTTTAT TAAAATTTTT AATAACACTC
AAGTATTGGC AGAAAGAAAT AATCTTGGGT TAACTATAAC TAGAATATTG ACTCTTCCTC TGTGGAAGAA
TCAGCCAATC ACATTTGTTT ACATCAGTTC CCCTGAAGAA GAAAAATACA CTGATGTTGC AGCAAGACAA
ATTTAAGCTA GATGTAAATA ACTTCCTTTA GCCTGTAATG CTAGGCTAAT TACATATTGG AACTATTTTT
TCAGGGAAGA ATTGTGTAGG GTTTCAGGGA AGAATTCTGA AGAAAATATA GAGCTGAAAT GATCTTGCAG
CTCACTGAAA CTGCAGGGTT TAGATCCACA CTGATACTCG TTCTATTATC ACTGTAATGA AGGCTGATGG
AATAAGTAAA AATGTTTTGT ATTAGTATGT TTTTACACTT ATTTGCAAGG CATAAATAGG TTAGGTTTTG
ATCTTAATTT AATTCTAACA TGTATTGTGC ACAAGCTGTG AGCAGTTTTC AGGAGTTAGG TATCTGGCCA
TGACTGATTT TTCAGGAGTT AATCATCTGG TAGAAGGGTC ATACACAATA GGAAGATGTG TGTGACAGGT
TGTGATCATT ACTATAATCA CACAGAGAGC TGTAGAATTT TAGGCTGGCA GGGTGGCTCA CGCCTGTAAT
CCCAGCACTT TGGGAGGCCA AGGCAGGCGG ATCAAGAGGT CAGGAGATGG AGACCATCCT GGCTAACACG
GTGAAACCCC GTCTGTACTA AAAATACAAA AAAAAAAAAA AGCCAGGCGT GGTGGTGGGC GCCTGTAGTC
CCAGCTACTT GGGAGGCTGA GGCAGGAGAA TGGCGTGAAC CCGGGAGGTG GAGCTTGCAG TGAGCCGAGA
TCGCATCACT GCAATCCAAC CTGGGCGACA GAGGGAGACT CAGTCTCAAA AAAAAAAAAA AAAAAAGTC
ATGTTAGATC CAGAGGGGTA GCAACTGGGG CTGGGCTGTC AGTCAACTCA GTCAACTCAG TCAACTCTGC
TCCCCCACAG GAGATGCCAG TGATGCATTT TCATGGCCAA CATTGTCAGT CAGCATCATT GAATTACTCC
TGATTATAGA GACACAGCTG CAAACGATTC CCCATTAAAT ATGATGTTTC TTGCAATGTT TGGAAGGTAC
TCCTTTTTAG TAAGGGAAAT CCCCTCTTCT GGCTTGCTGA AGTTTTTTC TTTCCATTTT AAAAATCGTG
AATTCCTTTT TGCAATATTG AGGTGGTTAT ATGGTTTCTC TTCTCTAATC TGTTAATATG GTGATTTAAT
GGTTAGAAAT TTTCTAATGT AAATTCCACT CATATTGCAG AAATAAACCT AAACTGAGCA TGAGGCTATA
```

```
TTTTTTATTT GCTTCTATAT TTGGTTGCTA TACAGTATTA TGTTTAAGAT TTGTTCACAT ATATTTGTGA
ATGGGATTGG ACTATTTTTC CTTCTTGCCG ATTTTTATCT GGTTTTTAAA TTAAGGATAT TTTAGACTTA
TGAAATATTT GGCAAACAAT CCTTGGCAAG TAATTTTTTG GGGAATTTGT TTTGGCTATT TTGAGTATTA
CCCAATATAT TTTAATTAAG TTATTCTTAA TGTTTTCTTA ATTAAAAAAA TTACCTACTC TAGAGATATT
CTTTATGTAC TCCAGATTTT GTCTATTTAT ACCACTTTTC TTTTTTCCTC GATGAGTGTC ATAGATGTTC
ATCTATTTTT TTATCTTCTT TGATCTTCTC TTATTCCTTG TTTCTATTAA CTTCTGAAGT TTATTATTTT
CTTTTTTCCA CTTCCTTATG GTTTATTCTT TCAATTTTTC TCTAACTTCT TAAGTTGGGT GTTTAATTTT
TAGCTTGCTT TGCTTTTTTA GGATAAGCAT TAAAACTACA AATTTTCCTT GTTATTCTTT TGCTGCACCC
CAAATTGTTG ATATTTCTAT TGTCTAATTT CTATTCAATT AGAATACTTT AAAGTTTCTT TTTGGTTTTT
AAAAACTAAC TTTTTAAATT GACAAATAAA AATTGTGTAT ATTTATTGTG CACAGCATAT GGCTTTGAAA
TATATGTACA TTGTGGAATG GCTAAATTTA GCTTATTAAT GTATGCATTA TCTCACATAC TTATCATTTT
TTGTGGTGAG AGCTATGTGA CTTTTGAACT TATGAGTTAT TTAAATATTT TTAAATTATT AAGCATATTG
GGATTTTAAG TAATTTACCT TTTTATTATT AACTTATAAC AAGTAGAACA GTTAACCTGT ATGATTCTAC
ATCATTGAAA TTTATTGACA TTTGCTTCAT AGTCTATTAT ATGGTCTACT TTTGTTCATG TTACATCTGT
AGTAGAATTG GCTAATAGTT GAGTAAAGTA CACATATGTC TATGAAATCA AGTGTAATCC AGAGAAAAAG
AGAAATTTAC TGAATATATT GTTCTAGGTG CTATTATATG TTGTCATGTT AATCCTCAC CACAATTGTA
TGAGGCAGCC ATAATTAATT CCACTTTACA CATGAGGAGC CTGAGGGTTA AAAAAAAAGC TAGCTCTACT
ATTTGTAAAG AATGAAGCAA AGATACAAAT GAAGGCCCAC ATATCCTATA ACTAGATATT TAAGCATTTT
AATTCAAGCT TTAAAACTGC TAAATAAAAT GTGCTCCAAT TTCTATATTG ACAGACATAC CTTCCTAATG
AGCTGGGGTT CGAATTTAGA AATCTTTGAT GCTTCAGAGT CCACACTGAA ATGTGGAGGC ACATAGTGAG
TTGGTCCCCA GCCTTCAGTC CACCCACCTT CTCTTTACTA AATCACCTTT CACATACATG TATGAACACC
CCAGCCTCCA AGTCCAAACC CTAAACAAAA TGGGACACCC TTGTGCATAC ACAGAGACAC AGCCCATCCT
CAGGAAAACC TGGAAAAGTC CATACAAGTT CTGGAAGCAA GCTTGGGACG GTTTCAGTAG TGTGGTCTAT
AAGGGAGGCC TCAGAAGACA GGTTTTCTTA ATTCTGTGAA CTTCTCCCAC AGTAGAAAGG GTGCTGGAGG
AGGGTCAGAG TGAGGACTTC TAAAGCATGG GTCCTGAGTA GGGGCCACTC TTGCCCAAGT CTAAGAAGGG
TACTAGAATA GCACACTACT ACTAGATACT AGAACCCAGA TACAAGCACA GGTCTTCTGA AATTAATAAT
AATAATAACT ATTACCATTA TTATACCAGT AGCTGTCATT TATTTAGTGC TTATTATTTG CCAGTCACTG
TTCTAAATTC TTTACATGTA TTATACAACT GCCATATAAC TGCCATATGA GGGATGTACC CTCATTGTCA
CCATTTTACC GATGAGAAAA CTGGCATAAA ACGTTTAAGT AACTTGTCCA AGTTACAGAG CTTAGTGAAG
CCACAATGTT GCTCAATTTG CTCTCAAACT TCAAAGGGAT GGGAAGGACA CCTAAGTCAT AGAGTCTTTA
AGAATCAGAG CTAGAAGGAA TCTTAGATGT TATCTAGTCA GCCTCCTCCC ATTACAGTCC AAGAGAAGAT
GGCCCTGAGT TACTTGTAGC TATTTTTGCA TGTGAATTGC AAGTGAATAT ACATTCTACT GAAGATAAAA
GATATTTAAA GATATCGCTG GATATAGGAA CAGTGGTTTT AAATCTCTAG GCTTTAACTT TTCTCAGAAC
AAGAAATCCT TTTTGGTTTT AATCTATATG CACATCTGTA TTTTTCTCAA TTATCGGGTA GTAAAATATA
ACTTTTCTTC TGTAATATTT TTTAACTTTA ATGAGTGTTC CTCATAATAG AAAAGTTTGG AAACCATTGC
TATGGGTATA TACTTTCTAA AGGGATAGTA ATTTCTCTAG AATATTCATT TAATGCTCCA GAAGTAATTA
GCACAATTGT GCAAGTCTGT GCATCATCAA CTATACATTC TGCCTGTTTA CTCCAAATCA ACATGAAACT
GATTATACAG TCAAAGGCGA GCCCAGTGGA GAGGCATTTT TGGAGACTTC CTGGTACATT GAGACAGGGT
CGGCCAGTCT GCGTTAGGGT CTTGGTCAAA ACTGCATTTC TGAAACTAAA CTCAGATTGC TTTCTTTTAA
GGGGTCAGAA CTGATTCAAA TCTACATTTT TAAAAGCCTT AGATGTGGGG CTTTTCCTAT TCCCAGTCTC
```

```
CGCTATTGGT CTTTGTGAAT CCACAGGCAA TTTGGCCACA TCCTTGACTC TCTCTTATAT TAAGAATTAA
ACAGCTAAGT TCATGCAGAG GAAATATAAC AAAGGAGGGA CTTTCCTACA AGATCTTTGA AAAATGGAAC
ATTTGCATAA GTCATATTTA GCCAGAACTG TTGTTTTATA TTTTCCTTTC TGAATACTTT GTTACACCTC
CTCCCAGCCA ACCCCCCCCC TCCCTGACCC CAACTAGTCA GAGACCAAAG CCTTCACAAT GGTTTACACT
TGAACCTTCC TGGCCCCACC CTCATCATCA CGCCTGAATA ATTACATTCA CTGACTGGTC TCCCCTGCTT
CCGTTTATCT CCACTCCTAA ACCCTCTGAC ACCTTAATCT TCCCAGAATA CCATTGTGAT CCTGTTCCAC
TCTTGCTCAA GTTTTCCCAG AAACTAGAGT ACAAACTTTA TAAGCTTTAG AGTTGAAAGC CACTCTATCT
CTTTTTCATC CCCAGGTCTC TGCCAAGGCA GTATAACCTG TCCAACATCT CTAACTTCAA TACCTTTGTC
TTAGATACTA GACTCTCCTC CTGGTTTCTA ATTAAACCTG ATCTAGGATC TAATTTTGCC TCTGAATTCT
GTTGCCCTTT GCCAAGTGAT CTCTTCCTCC TCTGAGCCGC AGCATCTCTG AGCTTGCACA CTTAGCATAG
CCATAGCACA CACAGCCTTA GCTTGCAGTT CAGGGTGTTT ACCTTCCCTC CCCTTCCAGA TGCTGGATCC
CCAGGGATAG GAACTCTGCC CTTATGTGTC CATAGCCCCT GGTAGTATGT CTTGCAGTCG TACATTTTCA
GCAAATGTTT AATTGGTTAA TTGAAGACAA CTGTCCCATG CCTTAAGCCT CTCTTTTTGC TAAACATGCC
TGTGTCCTTT GTCATTGAAC AACTATTTTG ATCTATTTTC TTCCTGACAT AGGGGTCAGT TCCGAGGATG
CTGAAATCAA GAGACATAGC TTATTCTCTC AAAATTGCTT TCAAGAGTGA TTTTGTTGTG AATTGAGAAC
TGGCTGCCTA CTTTTGGACT ACCCACTTCA GCAAGAGTGT TTGAAACCAA ATCTATTCTA AGTAATTTTT
TATTCCCTTT TCTCTATGGC ATTAGACACA CAGCTCTTTT AAACTACCTT TCGTTATCTA TTAAACAGAC
ATTCAGTAAC TCTATAGACA CTGTCTAGCT ATATGAACTT AGACAAACTA ATATCTCTGA GCTTCAGTTT
CTTAAAATTT AAAATGAGGA CAATACCATC TATGGCCGGG GATTAAATGC TATGAGGAAT GTAAACCAGA
TGTCAGGTAC CATCTCTCTA AAATCCAGAT AAAATGAATT AAAAATACTG GCCGCAAACC CTCTCTAAGA
GTTCTCAAAA TTCTCAGAGA GCTTAATTTT CATGCTCACC ATAGCACCGA TTTTCTTCTA AATATTTTGT
TTCTACCAAA ATATTTTGTC CCAATTTTGC CTTTTATGGC TATTTCTTCA TATCCACTTT CCCAAACTAA
AGAAGCAGCC CCTTCACCTT AAACTCCTCC TTCAAAGCAA CCTAAATACA GGTCTGGGTT TGTATTCCTA
GTGGGATGTT ACAGAGGTTA GTGTGATGCA GAGGAGGAGT CATGCTGTTT AAATCCATAC TAGTCCCCAG
AGGCCAGGCT GCTTCTGCCA CCCCTACCCC TCCCGCCACA GAGCTCTTCA GCTTCTCACA TTTCTAGTTC
TTCTCTCTCT ACTTTCATTA CCTTCTCTCT TTTTTTTTTT CTTCTCATGT GCTCACGGGA GCAGAGAAAA
TTAACTCCTC TAAGTTTTCT TAACACAGAG TGCCTTAATT ACATATTACT ATTGTTTGAG TTCCTGCCAA
CACTACGTCT GTAGGGTCAC ACCTGCTATA TTAGAGGCTT ATCAAAAAAA GATAGCTTTC TCCTAAAAAG
GGATTTGGAT GCCTACTAAG ATAACTGGAT GCCAAGATAA GTTTAACCTA ACAAACTTTA TTATTATTAT
TATTATTATT ATTAGAGATA GGTACTTATT CTGTCACCCA GACTGCAGTG CAGGGATGCA ATAATAGCTC
ACTGCAGCCT CAAAGTCCTG AGTTCATGCA ATCCTTCTGC TTCAGCTCCC TGAGTAGCTA GGACTACAGG
CATATGCTAC TCTGCCCAGC TACTTTTAAA AAAATAATTA GGGATGGGGT CTTGTTGTAT TGCCCAGGCT
CGTCTCAAAC TTCTGGTTTC AAGCAATCCT CCTGCCTTTT ACCTCCCTAA TTGTTGGAGT TACAGGCATG
AGCCACAGCA CTCAACCAAG ATTTAAAAAC TTTTAAAAGA AATCACATTA CTTACTGTTA TCATCATTAT
GGTTACTACC AGTGTTAAAA CAATTGGTAT TGAAAACACC ACTACCAGAT CAAGCTTCAA ACCAAGATGT
CAAGTAAATA TTATTGTCAG ACCTCTGAGC CCAAGCCTGC AGGTATACAC CCAGATGGCC TGAAGCAAGT
GAAGAATCAC AAAAGAACTG AAAATGGCCG GTTCCTGCCT TAACTGATGA CATTCCACCA TTGTGATTTG
TTCCTGCCCC ACCTTGACTG AGGGATTAAC CTTGTGAAAT TCCTTCCCCT GGCTCAGAAG CTCCCCGACT
GAGTACCTTG TGACCCCCAC CCCTGCCCAC AAGTGAAAAA CCCCCTTTGA CTGTAATTTT CCACTACCCA
```

```
CCCAAATCCT ATAAAACAGC CTCACCCCTA TCTCCCTTCG CTGACTCTCT TTTCAGACTC AACCTGCCTG
CACCTAGGTG ATTCAAAAGC TTTATTGCTC ACACAAAGCC TGTTTGGTGG TCTCTTCACA CAGACCATGT
GACATTTGGT GCCGTAACTC AGATCGGGGA ACCTCCCTTG GGAGATCAGT CCCCTGTCAT CCTGCTCTTT
GCTCCATGAG AAAGATCCAC CTATGACCTC TGGTCCTCAG ACCAACCAGC CCAAGGAACA TCTCACCAAT
TTTAAATTGG GTAAGTGGCC TCTTTTTACT CTCTTCTCCA GCCTCTCTCA CTATCCCTCA ACATCTTTCT
CCTTTCAATC TTGGCACCAC GCTTCAATCT CTCCCTTCCC TTAATTTCAG TTCCTTTCTT TTTCTGGTAG
AGACAGAGGA AACGTGTTCT ATCTGTGAAC CCAAAACTCC AGCACTGGTC ATGGACTTGG AAAGACAGTC
TTCCCTTGAT GTTTAATCAC TGCAGGGATG CCTGCCTGAT TATTCACCCA CATTTCAGAG CTGTCTGATC
ACTGCAGGGA CGCCTGCCTG GATCCTTCAC CTTAGTGGCA AGTACCACTT TGCCTGGGTG GCAAGCACCA
CCTCTCCTGG GGGGCAAGCA CCACCTCTCC TGGGGGGCAA GTACCCCCA ACCCCTTCTC TCCATGTCTC
CACCCTCTCT TCTCTGGGCT TGCCTCCTTC ACTATGGGCC ACCTTCCACC CTCCATTCCT CCCTTTTCTC
CCTTAGCCTG TGTTCTCAAG AACTTAAAAC CTCTTCAACT CACGTCTGAC CTAAAACCTA AATGCCTTAC
TTTCTTCTGC AATACCGCTT GACCCCAATA CAAACTCAAC AATGGTTCCA AATAGCCTGA AAACGGCACT
TTCAATTTCT CCATCCCACA AGATCTAAAT AATTCTTGTC GTAAAATGGA CAAATGGTCT GAGGTGCCTG
ACATCTGGGC ATTCTTTTAC ACGTCGGTCC CTCCCTAGTC TCTGTTCCCA ATGCAACTCA TCCCAAATCC
TCCTTCTTTC CCTCCTGCCT GTCCCCTCAG TCCCAACCCC AAGTGTCGCT GAGTCTTTCC AATCTTCCTT
TTCTACTGAC CCATCTGACC TCTCCCCTCT TCCCCAGACT GCTCCTCCTC AGGTCGCTCC CCGCCAGGCT
GAATCAGGCT CCAATTCTTC CTCAGCGTCC GCTCCTCCAC CCTATAATCC TTCTATCACC TCCCCTCCTC
ACACCTGGTC CAGCTTACAG TTTCATTCTG TGACTAGCCC TCCCCCACCT GCCCAACAAT TTCCTCTTAA
AGAGGTGGCT GGAGCTAAAG GCATAGTCAA GGTTAATGCT CCTTTTTCTT TATCCAACCT CTCCCATCTC
AGTTAGTATT TAGGCTTTTT TTCATCAAAT ATGAATACCT AGCCCACTCC ATGGCTCATT TGGCAGCAAC
TCCTAGACAT TTTACAGCCT TGGACCCAGA GGGGCCAGAA GGTCATCTTA TTCTCAATAT GCATTTTATT
ACCCAATCCA CTCCCAACAT TAGAAAAAGC TCCAAAAGTT AGACTCCGGC CCTCAAACCC CACAACAGGA
CTTAATTAAC CTTGCCTTCA AAGCGTACAA TAATAGAGTA GAGGCAGCCA AGTAGCAACA TATTTCTGAG
TTGCAATTCC TTGCCTCCAC TGTGAGAGAA ACCCCAGCCA CATCTCCAGT ACACAAGAAC TTCAAAATGC
CTAAGCCACA GTGGTCAAGC ATTCCTACAG GACCTCCTCC ATCAGGATCT TGCTTCAAGT GCCAGAAATC
TGGCCACTGG GCCAAGGAAT GCCCTCAGCC TGGGATTCCT CCTAAGCCAT GTTCCATCTG TGTGGGACCC
CACTGGAAAT CGGACTGTCC AACTTGCCCA GCACCCACTC CCAGAGCCCC TGGAACTCTG GCCCAAGGCT
CTCTGACTGA CTCCTTCCCA GATCTTCTTG GCTTAGTGGC TGAAGACTGA TGCTGCCTGA TCGCCTCAGA
AGCCTCCTGG ACCATCACAG ATGCTTTTGG TAACTCTTAC AGTGGAGGGT AAGTCCGTCC CCTTCTTAAT
CAATGCAGAG GCTACCCACT CCACATTACC TTCTCTTCAA GGTCCTGTTT CCCTTGTCTT CATAAATGTT
GTGGGTATTG ATGGCCAGGC TTCTAAACCC CTTAAAACTC CCCAACTCTG GTGCCGATTT AAACAACATT
CTTTTATACA CTTCTTTTTA GTTATCCCCA CCTGCCCAGT TCCCTTATTA GGCTGAGACA TTTTAACCAA
ATTATTTGCT TCCCTGACTA TTCCTGGACT ACAGCCACAT CTCATTGCTG CCCTTCTTCC CAACCCAAAA
GTGGCAACTC CTTTGCCACT TCCTCTCATA TCCCCCTACC TTAACCCACA GGTATGGGAC ACCTCTACTC
CCTCCCTGGC AACAAATCAC ACCCTCATTA CTATCCCATT AAAACCTAAT CACCCTTACC TGGGTCAACG
CCAGTATCCC ATCCCACAAC AGGCTTTAAA GGGATTAAAG CCTGTTATCA CTTGCCTGTT ACAACATGTC
CTTTTAAAGC CTGTAAACTC TCCTTACAAT TCCCCCATTT TACCTGTCCA AAAACTGGAC ATGCCTTACA
GGTTAGTTCA GGATCTGTGC CTTATCAACC AAATTGTCTT GCCTATCCAC GCCATGGTGC CAAACCCATA
TACTCTCCTA TCCTCAATAC CTCCCTCCAA AACCCCTCCA TAACCCTTAT TCTGTTCTGG ATCTCAAAAC
```

```
ATGCTTTCTT TACTATTCAT TTGCACCCTT CATCCCAGCC TCTCTTCACT TTCACTTGGA CTGACCCTGA
CACCCATCAG CCTCAGCAAC TTACCTGGGC TGTACTGCCG CAAGGCTTCA TGGACAGCCC CCATTACCTC
AGTCAACCCA AATTTCTTCT TCATCCATTA CCTATCCAGG CATAGTTCTT CATGAAAACA CACGTGCTCT
CCCTGCTGAT CATGTCCAGC TAATCTCCCC AACCCCAGGA CTGGCAAATT GACTTTACTC ACATGCCCCA
AATCAGGACA CTAAAGTACC TCTTGGTCTG GGTAGACACT TTCACTGGAT AGGTAGATGC CTTTCCCACA
GGGCCTAAGA AGGCCACCGT GGTCATTTCT TCCCTTCTGT CAGACATAAT TCCTTGGTTT GGCCTTCCCA
CCTCTATACA GTCTGATAAT GGACAAGCCT TTACTAGTCA AAGCACGCAA GCAGTTTCTC AGGCTCTTGG
TATTCAGTGA AACCTTCATA CCCCTTACCG TCCTCAATCC TTAGGAAAGG TAGAACTGAT TAATGGTCTT
TTAAAAACAC ACCTCACCAA GCTCAGCCTC CAACTTAAAA AGGACTGGAC AGTACTTTTA CCACTTGCCA
TTCTCAGAAT TCGGGCCTGT CCTCGAAATG CTACAAGGTA CAGCCCATTT AAGATTCTGT ATGGACGCTC
CTTTTTATTA GGCCCCAGTC TCATTCCAGA CACCAGCCCA ACTTGAACTG TGCCCCAAAA ACTTGTCATC
CCTACAATCT TCTGTCTAGT CATACTCCTA TTCACCATTC TCAACTACTT GTAAATGCCC TGCCCTTTTT
TACAGTGCTG ATTTATACTT TTCCTCCAAA CCATCATAAC TGATATCTCC TGGTTTTACC TCAAACCGCC
ACCCTTAAGT CTCTCTTAAA GTGGATAGAA GATCTTCAGT GACAAGGTAC ACTCCAATAC TTTCACCCTA
ATAAAGCCCT ATTCTTTACT TTTATATTCA CTCTTATTCT TGTTCCCATT CTTATGCCAC TCTCTACCTC
TCCCCAGCTA TCTCCACCAC ACTATCAATC TCACTCACTC TCTCCTAGCC ATTTCTAATC CTTCTTTAAC
AAACAATTGC TGGCTTTACA ATTTCTCTTT CCTCCAAAAT CACCGAGTCC TCAATTTACT CACTGCTAAA
AAAGGGGACT CTGCATATTT TTAAATGAAG AGTGTTGTTT TTACCTAAAT CAATCTGGCC TGGTATATGA
CAACATAAAA AAAACTCAAG GATAGAGCCA AAAACCTTGC CAACCAAGCA AGTAATTATG CTGAACCCCC
TTGGGCACTC TAATTAGATG TCCTGGGTTC TCCCGATTCT TAATCCTTTA ATACCTGTTT TTCTCCTTCT
CTTATGCAGA CCTTGTGTCT TCCATTTAGT TTCTCAATTC ATACAAAACC GTATCCAGGC CATCACCAAT
CATTCTATAC GACAAATGTT TTAAGGGAGG AGACCACCCC TCATATTGTC TTATGCCCAA TTTTCTGCCTC
CAAAGAAAGA AGTAAAAATG AAAAGGCAGA AATGAAATCC ACAGGCAGAC AGCCTGATGC CACACCCTGG
GCCTGGTGGT TAAGATCAAC CCCTGACCTA ATCAGTTATG TTATCTATAG ATTACAGACA TTGTATGGAA
AAGCACTGTG AAAATCCCTG TCTTGTTCTG TTCCTCTAAT TACCAGTACA CGCAGCCCCT AGTCATGTAC
CCCCTGCTTG CTCCCCCTGC TTGCTCAATC AGTCATGACC CTCTCACGCA GACCCCCTTA GAGTTGTAAG
CCCTTAAGAG GAAAAGGAAT TGTTCACTCG GAGAGCTCGG TTTTTGAGAC ATGAGTCTTG CCAATGCTCC
CAGCTGAATA AAGCCCTTCC TTCTTTAACT CAGTGTCTGA GGGGTTTTGT CTGTGTCTTG TCCTGCTACA
GTTTCATCTA ACAACCCCAT AATATCACCC CTTACCACAA AATCTTCCTT CAGCTTAATC TCTCCCACTC
TAGGTTCTCA CGCCACCCCT AATCCTGCTC GAAGCAGCCC TGAGAAACAT CGCCCGTTAT CTCTCCACAC
CACCCCCAAA AATTTTCACT GCCCCAACAC TTTACCACTA TTTCGTTTTA TTTTTCTTAT TAATATAAGA
AGATAGAAAT GTCAGGCCTC TGAGCCCAAG CCTGACGTA TACATCCACA TGGCCTGAAG CAAGTGAAGA
ATCACAAAAG AAGTGAAAAT GGCTGGTTCC TGCCTTAACT GATGATATTC CACCATTGTG ATTTGTTCCT
GCGCCACCTT GACTGAGGGA TTAACCTTGT GAAATTCCTT CCCCTGGCTC AGAAGCTCCC CCACTGAGCA
CCTTGTGACC CCCACCCCTA CCCACAAGTG AAAAACCCCC TTTGACTGTA ATTTTCCACT ACCCACCCAA
ATCCTATAAA ACAGCCCCAC CCCATCTCCC TTTGCTGACT CTATTTTTGG ACTCAGCCCA CCTGCACCCA
GGTGATTCAA AAGCTTCATT GCTCACACAA AGCCTGTTTG GTGGTCTCTT CACACCGACA CGCGTGATAA
TTATTATATT ACTTTTAACT AAAACCCTTT CAGAGTCTCG CAGGGAAGGC TGTATATATC TCATAAAATG
TTGGGGCCCA CTGGATCAGA CAAGGCCACA AAGGCCAAAG GGAAGTAAAG ATCTCATTAT TTCTCCTAAT
```

-continued

```
AATTTCCCTG TCCTTTGTCA TAAATGGTGG GTAGGCTGTT ATGGTGATGG CAGATTTTCT TTCCATAAAA
TGTCCATAAT AGGACATTTG AACAGAAGGG AAAAATCAAA TTGCTGAAGT TGAAAGAGGG CAATGCAAAG
AACTTTGGAG AAAGAACTGT ACAGAGAAGT CAACTGGCAG ATGGGAGGAA GTTTAAGGGG AAAAATATAG
ATGTCTAAAG AATACATTTA TTCATTTTCC ACAGTGCAAT TTGGACAAGA AGCCTCTTTC TTGCTTCTTT
CTATTCTCAT TAAATCATTA GAGCTCAAGC AATCCTTCTG CCTCAGCTTC CCGACTAGCT AGGACTACAG
GTATGTGCTA CTATGCCCAG CTAATTTTTT AAAAATTAGA TTTTAATTTG GTGAACTATT TCTGTAGGAA
ACTACAATAA TACAGCCCAG GCACATTGAT CTTGGGTGAA CAAATCAGAA GGAATGAATA ATTCTGTGTT
CCTGGGACTC TGACAATTTC ATGAACTTGG TACTCTGAGT AAAGCATAGG AGGAGTTATT TCATAAAATG
TGGAGCACAA TCATGTGACA AAGATAATGG GATCCCCATT TCATAAATAA ATCTGAAGTT CAGAGAGAGT
AACAACTGGC CAGGGTCACA TCACGGAGAC AGAGGCAGGG TTCCCACTGA TGCCTCTGAC TCCCTGTCCC
AGGCCCTTCC TCCTCCCGCA AGCAGAAGTG CAGGGGCAG AGCTGACCCT GTGCAGTGAA AATCTGAGGG
CTGAGTTCCT ATTGGAACAC AAGTGAAAGA CTTCCTGGCT TCTAATCTCA GGATAAGGAC TCAGAGCTCC
ATCTGTTCCA GCCTTAGGAT AAGAACCAGA ATCTTACACC ATGAAAGCAT GAAAGGTAAG ATTTGAGTGA
GGAAAAAAAA AAAAAAAGTC TGTGTTTCAG ATTCAGTTCA CAAAGCAGTT TCATACTTAA GGTACCATCA
CAATAACCCT GTGGGGTAAG CAAGGCAAAT TTCATTCTTG TTTTATGGGC ATAGGAAGTA AGTCTCAGGG
AGGTAAGAC CAAGGTTTCT GGAGAATTTT ATATTATGAA TCTTGATTTA TGGGATTACT ATTATGTAAT
TCCTAAGATC ATATAGGAAT CCTAGAGCTT GAATATAGAA CTTTATTTTT AAATCTATAT ACATCATAAT
TACAAGGAGT AGTGTCCATT TGGGTTCCTT GGCCCTGATG TGTTAGTGGA ATAAACATTT TTGTCAGGGT
TGCCATGTGT GTCTGTGCAC GTGTGCACTG TACACCTCCA GGGGATGTAC CCTAAACCAC ATGAATGTGA
TTTGCACATC CAAGATTTAC AGTGTACTAT AGGGAGAATC TTTTGCAACA GCTTTTGCTA TAATACAGAA
TCTGAGATGT CTTTGAGAAA GAAAAGTGTA ATCATTACCA AAAAATTATT CTCATAATGT GTGCAAATTT
GTATGAAATC TATATTGGCC ATGGGACAAG GAGGTATTTC CAGCTAGCTT CTGAAAGGGC TCTATTCTCT
CATAAGAATT CAGCTGTTGA CATTAGGTGA TATCTGCCCA GGTCATCAGA TGCCATAGAG AAAGAGGGTT
TGCTGAAACT TATATCAGCA GTGCACTGTA TGCTCTTTCT GATTTATTTG AACATTCATT TATTGAGTGT
CAAGTAATGC ACTAGATACT CCAGGGATCT GACACAAACT CTGCCCTGAA GGAGCATGTA ATCTCACTGG
GGAGAAAACA AAACATATGA TAATTTCAAA ATAACAAACT AGGCAAACTA GTTAACACTT AAAAAGCAGG
CTTTATTCAA ATGCAAAATT GCATGTTACA GGGTAACCTT TCAGTAAGAA GCCAGGAAGA GGAGCTCATC
ATGGGTTGGA TTAGTAAAGG ACTAGTTATA AAAGAAGTGG TGGGGTTGAG GGAGGCCTGA GATGAAATTT
AAAGAATATG TAGAATCTAG GTAAGTGGAT AAAAGGTCTG GGGGCAGGGG AAAGGAGAGC ATTTCATTGT
GAATCAAGGA ATTTCTCCAC CTGTTTTAAC TCTTCCATAT GACATCAAAG AGATGTCACT TGCAGCTAGC
ATTTCAGTGA TGTTTTCTTA CTAATAATAT CGTGATAAAA GAAACATTGA CTATAAGAAA TAGGAATGGG
TCTCATAAAA GGAAACAGCA AAACCCCCAA ACTAAAAAAC AGCGCAGGCT ATTTCTCTCT TCTCTCCTTT
TGCTTGGCAC TCATGAGATG CTAGGTGTGG AAGTCAGCCA ACTGAAAAAG AGAGGTGGCT GAAGAAGGTG
GGGAGGCTGA AGCCAGTTAA ATAGGATGGT CCAATTCACA GACGGCGAGG CTACAGTGCA ATAGGACTC
TTTCAACTTG AGCAGGACCC CATTACTTCA CTGGAGTTAG AAAGAAAGGA GAGCGTAGAC TTTTTGAACT
TTCTATAAGA GTGTACCTCC ACAGTATACA GAAGACGACG TGAAATTTGA TCTGCAAGAA AACTGAGTCC
ATATTCACAT ATGTATCAAA TTTGCACTTC ATTTAGAAGT GTCTGTCATC AAGTACAGCA CTGAATTGAA
ACTGAAAACA AGAGTCAAGA AAGAGCAAAG TCAGCCATCT TTATATTCCA CATGAATCCT TTCCCTTTAT
GGTCTTATTT GTTTCTCCTC AGAAAAGACA AAAAGCTGAG CTGTATAAAC ACCTGTGGGC TGGGGGTTGA
GGGATAAATG AGGGGCGAAA TGGAAGCTGA AGGAACTGTT GGTCAGGTAG AAATCTTCCC AGATGCACTG
```

-continued

```
AAGGAAACAC ACTTCATGTT TGACGTAGGA GGTGCCACCA CACAAAACGT TTCATGGAAG GATTTAAAGG
ATCTCATGAT TTTTAGTATT CCAAGAATTT TCTTTCACCA AGGGCGATTT AATATGGGTC ATTCATACTG
AAAGAAAAAC AAAAGATAAT AAGAGTTTAA AAATTGCAAA ACTTGGAGTG TTAGTAGTAA AGGTAAATAT
TCATTAGAGA TGAGAAGAGG AGCAAGGAAA TGCTTTCAGC TGGAAATCTC AGACAAGAGG CCAGGCTTTA
GGAACCTCTG AAGATGAACA AATGTAAGCA AACCCTAGTA GCAGCACTTC TCAGATTTTC ATGTGCTTAC
CACTCAGAGA TGGTGTTAAA ATGCAGACTC TGATTCAGTA GGTCTGAGTG GAGCCTGAGA TTCTGCACCC
CTAACAAGCT CTTTAGTGAT GCTTATGCCA CTGGCGCACA GACCCACTT GGAGAAATTT TTGTGGTGCA
TACGGTCTTT GTCTCCAGAT CTAATGAGTC TGAAGGACAG TGTAGATTGA TTTTTTAAAT TTATGTTTAT
TTTAATTTAA TTTAATTTAA TTTATTTATT TATTTATTTT TGAGATGGAG TCTCACTCTG TTGCCCAGTC
CGGAGTGCAG TGGCACGGAG GCAGCTCATG CAACCACGGC CTCCTGGGTT CAAGCGATTC TTCCGCCTCA
ACTTCCTGAG TAGCTGGGAA TACAGGCACG TGCCAGCACA CCCAGCTAAT TTTTGTATTT TTAGTAGAGA
TGGGGTTTCA CCACATTGGC CAAGCTAATC TCAAACTCCT GACCTCATGA TCCACCTGCC ACGGCCTCCG
AAAGTGCTGG GATTACAGGC GTGAGCCACC GAGCCCAGCT GTAGATTGAT TTGAGCAGT GGAAAGTCAA
GGAATTAGAA GGCATGCTTA AATGGAAAGT GAAATTGGAG AAAATTTAAA CTCATGAAAT AGTGGTGGTT
ATAAACTCGT GATAAATTAT ATCCTGGGAT ATAATTTAAT GAGATGGTAA CACATTTAGT TTAAAGAAAT
AAGTGACACT TTTTTTGTGT GACACAACTG TCTTATTCTT GGAAAGGACA AGGAGAGAAT GAAATATGGT
ATGTCTTCAC AGCACCTTTC AAAGGGAGAA CCAGATTCTG AGGAGCTGGT CTCATGATGA ACTGTCAGGG
TAAACCACAG TTCAGCAGCT GCAAATGTGC TTGCCAAAAT AGAGACAAAA AAATGTTTCT GAAAACAAAA
TTTCACATAT GCCCTCCTCT GAGGTTGGCA TCATATCTTC CTGTGTATCT TGGGTGTAGC TTCTATCCTG
CCAGAATTTA GACAGTAGAA ACCAAATGAG GTGATAAACA GAGTCATTTT GCAGAAGAGT CAAAATAACC
CAGCAAGAAA TGAAACCACA ATGCCCAAG GAGTCATTCA TTCACCATTC AAAAGCTAAT AGAAATGAAC
ACAAACTACT ATGAAAATTC ACCCAAGAAC TTAAAAAAAA AAAAAAAGGC TCATGGTGTT TAGTGTGATA
GTATTCATTT TACCTTTGAC TTGTTCTAAA AACACACCAT ACTTCTACCC CACCCTTCCT CAGTGCCGTC
ACACAATGGT TTCAGTGTGA AAAAAAAAAC CACGTTACTG GAAAGGAGG GTGCCTGGA CTTGCCACTC
TAAGCTGGTA GTCAAGGGTC TTGAGTTCTA AAAGCATACG CGTTAAGAGC ATGATTCCTG GATCCAAATG
AGTATGGATC TCAGCATTGC CATTTATTGT GACCTCAGGC TATTTTATTT CTCTGTGCCT GTTTCTTTAT
CAGTAATGAA GATGTTCATA GACCCTTCTC CCACAGACTT AAAGGCATAT TTCATGATTT AAGACATGTA
AACCATTCAT AACAGTATAC AACATGGAAT TAATATTTGA TAAAGGTTTA TGATTATTGT AACTAACTCT
GTCACTTGCT CAAGGCCTAT AGAAAACTTA CTTAATTAGT TCAACTACAA AAAGAGTTTG AATGTGATAT
CCACCAAGAT CATATTCAGA CCTAGAATTC TGTGATTCTT ATGAATTAAT ACAGCCTTGG TCAATAAATG
AGAGCTGGGC AAATAATTCT TCTTTGCTAG GCCTTTCTAG ACCATCTGGT GAAGCATTCA AGACTTATGT
TATTGGGCC AGCCTTCCTT TCCAACTTCA ACTCCACAAC TCCTCAATAA GCCATGGGCT CAAGAAAGTT
CTGCTCAGTG GCCCCTGAAA AATGCTTTCA TAGTCTCACT ACCATACCAC TGCTTACACA ATTTCCTTCC
TACAGACTGC CTTCCTTTCC TGCTTTTCTC CATATACCTA AATCCTATCT ATTCTTCATA AGCAACCTTC
TTTATAACAT TTTCTATAAC CACCAAGCCA AATGACCTTT TCCTTCTTAA ATATAGCACC CATTGGCCAT
TACCATGCTC TGCCTTGTAT TTTTCTGATT TTTTTCTTTC TATATTCCTG TCTTAACTCC CCAGCTAGGT
AATAATTTTC CTGAAATCAG GGACCAGGCT GACTCCTCTT GCTGTCTCAA GAAAGCTTAG CAGTTTCCAA
CACAAAAATG TTCAATAAAC AACTATTAAT TGACTGATTA TAAAAAATCA GTGAACCATT AAACTTAATA
TAGCAATTTG CTTAGCATGG TAATTAGCTT TTTGCTAATA TTCTTCCAGC CAGTCTCTCC TCCTGTGCCT
```

```
CAAGGACATC TTAAAAAAAA AAAATCTAGT TGATCTGCTT CCATCTAGTG GCAATTAAAA CAGGTGGTTC

CGGTAGCCAG AAAACAGCTC TGGGTAGATT GTGCCAGAAA ATACTTTCAC TCAGTAGGTG CGAGTTTGAA

AGAAATCTTC ACATCTGTGG GTTTCCTGCC ACAGACATAG GGAGACCAGC CCAGAGAAAG AAGCCTTTCC

TCACTAGACT CCATTTGCAC TAGTAAAGAG AAGACAGAGT AATTAAAAAG AATAAAAAGA ACCTCCACTG

ATCGTACATC CTCATCCAGT TACCCCTGCC CCACTTCTCC TTCACAGCCA AACATTTTAA AAGAGATGAC

TGCTTGTTCT GTCTCTACTT TCTCATCCTC AGTAATGCTC AATGCTTGGC CGTCTGACCT CTGTCTTGAT

GTCTGCACTG CAAATAGTCT CCCCACTGAC ACCCTTGTTG CATCCAGGGG ATACTTACTG GTTCTCTTGG

CAATGTTTGA AACCGTTCCC CTTTCTTTGT TTCCTTGGCA TTCATTACCC CACACTCTTT CTCCTCTTCC

TTCTCCCTGC CTGGCAACAT CTTTTCATTT CTCTTTCCCT TAGGTGACTT ATTAGATAAT GATGTTCCTC

TGGCTCCCAT ACTCTCTCCC AGGTCCTCTT CCATTCTTAA AGCACTCACA CCCTCCCTGG ATGATAGTAC

CCACTCCTGA GATGGCAGTT ACCTCCTGAA ATGTGAGGGA CCCAAATCCA CTTCTCCTGC CATAGCCTCT

GTGCTTTGGA TAGGTCCAAT GAGCCACAGT GAATGATGTG CATACACCCA AGCTCAGTA CAAAACTGAA

CCCATGATCT TTACCTCCAA AACCTCTCAT TCTTTTATGT TCCCTTCTCA GAAGTAAACA GGACTACCAT

CCGCCAGTTT CCAGGTGAGA AAGATGATAA TTTGATTCTT CTCTCTCACT TTTAGCCAAT TAACAGACAC

ATTCAGTTAA TATCACCTCC TCTTATTTCA TGAACCCATT CTTACTACTA GTTCCCTAGA CAGGCGCCAT

CGGTTTTAAT CTAATAACTG CAAATGCCTC CAAAACAAGT CTCTTTGAAT CCAGGCTCAC CTGTCTCCCA

CACTTGCCAT ACTGCTCTGC AGGGTGACCT TATAAGATGC CAGAGGTAAG GCTACTCACT GTTTAAACCC

CTTTAGTGAT ATCCCAAAAG ACCTCAAGAT AAAGCCCATA TCACATGGCT TATACATTAG TTTATGATCT

GGCTTCTGGT GCCTCATTTT TCCCCACTTT TTCCTTTGCA TTCTAAGCAA TGGCCCATAC TAAGTTTGTG

ATTGGTAGGA TGGTTGCCCA AACCAGCATC CAATCCCTTC AGAAATCATC TCACTTCATT TCTAGCATTT

TAAAGGAAGC TCAGTTGTCC AGCTGGGTAC TGAATATGTC ACCAAAGTCC TCCTTTCATA GTTTATTTTA

CTTAAACTCT CCTTCCTAAA ATTCCAGAGC AAGTCACTAA ACCCTAGATA CTGAGAAATA TTTTTCCATC

TTCATTTCTG CCAGGTGGGC CATCAACTTT CACATGTCTG CATCTCCTCC CACTGTGCTA TTTCTCCAGT

AGAAGAAATT TGAGCTTCAA GACCAAACTG AAAAATACTT GCCTCCTTGG GGAAGCTGTA GGTAGAATTC

ATGCTCCCTA TCTTTCCCAC ATTTCTGAAG GACAATGCCT GTTAGAGCAA TTGAATGCAA ATAGTCAATT

GAATAAGCAT TTATTCATTT CTCAATAAGT GCTTGTTCAA TTGAATATTT CTTAAATAAT ATATTTAAGA

ACAAGAAGAA CACACCACAA TGTTTTTAAC CCTCAGAAAA AATTCTGAGG TAATCAGAAA AATCTCCCTT

TACATAAACT GCCCTTTTCT AATAGGGATT ACTTGTTCGT TCATTCATTC ATTCAGCTCC ACTAGCACCA

AAAAGCACAG CTCTGAAAGG AAGCTAGTAG ATTTATCACC TTATCTGGTC ATTTGGATGA GGACCCCAGG

TAAATAAACT ACTATGGGGT TAATGTGTCT AGCTAGAGCA GGAAGTAACT TAAGGAAGTA GAGAATGAAT

CAGCAGATGT GGAAACTCCT CGCCACTAAT AAAACTTACC TTCTCTTGGA TTTCTTGCCT GAAAATAGAA

AATAGAGAAA AGGCATTAGC AAAAATTAGA CAATTTAAAG TTTTTCAAGT AAGGGAGAAG GAAGACTCCC

ACTCTCAAAA CTGTCTTTTG AAGTATATTA GGTATTTGTT AGGTGGACCC TATCTGTGTC AAAGGAGATT

TGAGGAACTG GCTTAATAAA CAGTGGTAGA CACTAATACA GAACAGACAT GTTGATGCAG ATGCCTCCTG

AGGTTCCATT CCATTCTCCG TGCTACTCAA GAAGACAGAA 25441 TTGCTAAATT GCCTGGTGGC AAGACCCAAT

ATGTCCATTC AAGTGTTTAT CCCTTCCCAA TCTGCCATCT CATCCTACCT GCAGATTCTT CCCTTGAGGG

ACAGCTGCTA ATACTGTAAA ACTATGTGCC ATTACAGCTC ACAGCATCAT CTCTATGAGA ATCCACAAGA

GAATTTCACT TTGGTCTTGT TGGTAGGAAT TGTGCAGCCT CATCTGAGTA ACTAATGTGT TTTTATCTTA

CAAACACAAG GAATATCACA TGGTTCTCCT TTGACTGGCT GTAAGGAAAC TCAGAGCTAG ATCTGAGACC

CTCTCCTACC AAGTATATAA AACTTTGTGA CATACATTTT TGTGCCATAA CTTCAACCTT GGTTCCAAAT
```

```
GATTTTTGTA CCCTAAGTTT AAATTTGGCT TTCTTTTTTT TTTTTTTGTA CTCAATAAAA CATCAAGCTC

ATTTATTATT GCGAAGAGCG AAACAACAAA GCTTCCACAG CGTGGAAGGG GACCCGAGTG GGTTGCCCAA

ATTGGCTTCT TTTTCTTACT TTTTAATTAA TTTTAATTTG CTATACTGAA CACATTTTGT ACTGTTCTCA

CATTCTTTTT GAAAAAAGCA GAATATAAAT AAGTAGATAA CTTAAAAAAA ACTCTTTGAG CAGAAAGAAT

CATTTGGGAG GCAATATATT TCAGTGGCTG TAAAGTGGCA TTCTAGAATC ATCCTACCCA GGTGAAAGCC

CTATTTTGCC ACCTGTAGTG TAGTGTGTAT TTGAACAGCT ACTTTCTTTT CTAAACTACA ATTTCTTCAT

CTGTTAAAGA GGCATAATAA TTGTATCATC CTCATTGGGT TGATAAAATA AAATATTTCC AAGTATTTAG

TTCAGGTCCT AGCACGTAGA CAGTGTTGCA TTACTGTTTT AATCCTTTAA AGTATTAAAG ACTACTATTT

GAAATCTTTT CTTCTAAAAT TCAGCCTGCT GATGACCAAG TGCACTTGAG CAGGGGGAAT CAAATCTGAA

TTAATTTCAG ATTCTGGTTA GCTTCACATA AATATTTTTT TTAGGGATGA TGAACCTAAC AGCAATAGAT

GAGTAAGAAT CTGTTCCTAC TGAGAGAGTT TCATTTTGAA GAAAAAGGAA CTAAGGGGGC ATGTGTTCAG

TTTCATGCCC TGGTCTAACC CTGTGTGTTG GTTCTGGTGG GAAATTCTTC CAACCGAGGA AAAAACCAGT

TCACAAATCT GAAGACCAGT GATTTTAGAA GATGTATCTG GACTGGAGTC TAATCTCTGA CTCTGGGTCC

TGCTGATATG GTATTTTTGA GATTTGGCCT AAAACATCAT TGCCCTGGTT TCCTTATTTA CCAAACAGGG

CCAATGGTAG TGACTAATCA GAAAATGATA ATGCCTGGTG CACAAAATGT GTCTAGATGA GCCCATGCAC

AAGGACACAT GTTTCTGGAA CTGTTCCTTA TTCCTTTCCT AAAAGAAAGG AGGGAAAGTC TCCATACTAA

GACTACTAGG GCAGGGGACA AAGTGCTAGA GTCAGAAGAT TCATCTGAGG ACAGAAGAAT AGGGGTGAAG

GCTCTAGTCA CTTCATTGGC TACCATGCTC TAAATAGTTA CCTGTGCCCT TTTTCTAACT ATTAGAACCC

AAAAAGCCTA TAAATTCTCT CTCTCTCTCT CTCTCTCTCT GTGTATATAT ATACATATAC ACACACACAT

AGACACACAC ACACACCTAA ACACACACAT AGAGATTTAT GACTTTTTAC TTTTATCCTT GTAAATGCCA

TTAACTATAT TTTGTCTTAG ATTTAGCCTG GGAATGTAGC CATTATTTCT ACCATTGCCT CCATAGGAAA

AATACTCTTC ATGTTTTAAA GGACCAACCT ACAACTAAAA TCTTTGGAAA GCAGAATCAT TTGTAAGTTG

GTGAAAATGG AAGATGTTGT TTTATAAATG AAGACTTTTT TTTTTTTTT TTTGAGACA GGGCCTCACT

CTGTTGTGGA GTGCAGTGGT GCTGTCATGG CTTACTGCAG CCTTGACCTC CTGGGTTCAA GTGATCCTCC

CACCTCAGTC TCCTGGGTAG CTGGGACTAC ATGTGCATGC TACCATGCCT GACTAATTTT TTGTATTTTT

GTAGAGATGT GGTTTCGCCA TGTTGCCCAG GCTGGTCTTG AACTCGTGGG CTCAAGTAAT CCTCCTGCCT

CAGCCTCCAA AAGTGCTGGG ATTAGAGGTG ACAGCCAAGG TGCCTGGCCC ACAGATGAAG ACTATTTAAT

GTTATCTTAA AGATACCCTA AGCTTCCTAC CAAGCCAGTG ATCTTTTGGG GCTTCTGTTT TCTTTGTTGG

CATAACTGTA ACTAGCCTAA CTGCCCGTTA TCTGTTTCCT GTTTGCCCCA CACTGATTCC CACAGCAGTT

TTCAAGTTAT CGGTTTGAGA TCTTGTACAG AAATGACTCC AAGGTAAAAA ATTTAAAAAC AACCCCTCTA

ATTTTTTTAC CCTTGCTTAT AAAACAGCCT TAGCCAGCTA ACCCCTCACT ACATGCAAAT GAGTTTGATT

CTATTCTTTT GATTCTACAA ACACTTATTA AAAGATTTTA GAATTCGGAA ATAAATAGCT TCCTTATTAA

GGTGACTTAC AGCCCCAAAG TCCTTAAAAT TATTTAGACA ATAGCCACCT TATCCCAGGG GGCAGTGTGT

AATAACCCAC CCTGTTCTCT ATCCGTCAGT TCTGCCATCA TCGCCAAGG TAGGAAGAAA GACAGGACAA

CCGGGGTCAA GATTTGAAGT CTCAATGGAA AGAATAATCA GTGGTTGGAG AAAACTGTCA TTCTTCTTTT

GCCTTAATGC AGTACTTGAT ACTTATACTT AGTACTGTAT AGTACTTAGT ACTGTATAAT ACTATAAGAT

AGTGAGATTC AATCAGCACA GAATTTCTAA TAGCAAGGGC AGAGACATTT TAACTGCTCA GTGCTCTCAG

GTTATACATA GCTAATGAAG TTCTTGCATA TCAACAATCC CCACCCCCCT CACACACTTT GTCTTTCTGG

ATTGGTTAGA AAACTTACCT AGCGCCCACT ATTCTCAAAT TTAAATGAAA GATAAGATCA GAGTGGCACG
```

```
CAATTAGGGA CTGATAAATA ATATTTTTGT AATTGCCAGT GTAAATGGAC AGGGGGCAAC CTTTACATAC
CATATTCAGT GAACAGAATA CGTACTAACT AATTTGATGG AAGGAAAATT AAAATGACAA TCAACTGAGC
CCACAGAAAG GCAACACAGA GCAGTTGCTT AGCAATTGTT TCGAGATCAT CCCTGAACTT GAAACAGGTA
TATCTTTTTT TTTTTTTTTT TTGAGACAGA GTCTCACTCT GTCACCAGGC TGGAGTGCAA TGGTGCGGTC
TCAGCTCACT GCAACCTCCG CCTCCCGGGT TCAAGTGATT CTTCTGTCTC AGCCTCCCGA GTAGCTGGGA
TTACAGGTGC CCGCCACCAC GCCTGGCTAA TTTTTGTATT TTTAGTAGAG ACAGGGTTTC ACCATGTTGG
CCAGGCTGGT CTTGAACTGC TGAGCTCATG ATCCGCCCGC CTCGGCCTCC CAAAGTGCTG GGATTACAGG
CATGAGCCAC CACACCTGGC CAAAACAGGT ATATCTTAAA AGCTGCCCAA TGTCCATGAA TGTTACAGCC
TTGAATGGTT CTTCCAGGTG AGTTTGGCCA AATGTGGCAC CATACACCCA AGGCCTGCTG CAGGCTAGTG
GGTTGCTCAC ACTTTAAAGC TGAGACACAC TCATGCCTTA AGGTAAAGGG AGTGATAATC TGGGCAGCAG
ATGTTAACTT CTCAAGGCAG TCCTCCTTCT CTTTTCCTCT CCAGTGACGG ATGGTTGGAA AGCATATATG
GTGCATTTGG TTAGAGCTGT GGCCTTGGTG AATAGATACT TGGGAGAATA CATGGGAATT TCTCCCAGGG
TTAATGCAAT GCCCATGTGT TGGGAACCAG GTGACTCTTG AAGAGGTCAG GTATTTGGGA GCAGTGCCTT
GAAACCTTAG TGGACATTAG ACCCACTTCC TAGTGGAATT GTAGCATTGA AATCCAAGGC ATGTAGGCTC
TTAGAGGACA GAGATAGTGT GTCATTTTTT CAGAATTAAT TAAGAGCAGG CCAGGCGTGG TGGCTCACAC
CTGTAATCCA AGCCCTTTGG GAGGCCAAGG CAGGCAGATC ACGAGGTCAG GAGATCGAGA CCACTCTGGC
TAACACAGTG AAACCCCGTG TCTACTAAAA ATACAAAAAA TTAGCTGGGC ATGGTGGCAC GCTCCTGTAG
TCCCAGCTAC TTGGGAGGCT GAGGTGGGAG AATAGCTTGA ACCCAGAAGG CGGAGGTTGC AGTGAGCTGA
AATTGCACCA CTGCACTCTA GCCTGGTGAC AGAGTGAGGC TCTGTCTCAA AAAAAAAAAA GTATTAAAGA
ATTACATAAG AGCAAAGAAC CATTAGAATA TCTCACTTAG TTGTTATCAG CCTAGCAAGC TGCCTTGAAG
GTAATAGACA TTTTTAAAAG TTTATCAGAT GAAAAGCGAA AATCAGCCAA CCTGTTTTAA TGAAGGTGTG
TCCTGGGCTG ATTTACATGT CTCCAGGGAC TGATGGCTCT AGAATGTAAA GCTTGGCATC CTGCTTGTGT
TGAATCTATC ACATTTAATT TCCTGTGGGT TTCTTTTTTT TTTCTTTTTC ACTTTAAAGT TGTGTTCTTT
TCATGTGAAG TTAAACTCAC ATACCTTTTT TTAATCTCCT TGCCAGCCAA ATGATAAATG CCAACCCAGA
GAATGCAGTA ACCATGACTG CCACTGGAAT GAAGAGGGGG TTATAATCAC CCTCCTTAAT CATTGAGAAA
CTTTTGTCCA ATTCTGAAAG AGAAATCAGT AAGGCACATA GCATGAGACC ACCAGCATTA TTTCCTTAGT
CTATCTCATG ATATTTGACT TTTTTCCTCC TTACATCTCC CAGTAGTAGC CCATTTGATG CCATTTGACA
GATGAGGAAA CTGGCATGGG AAGGCCCCTG ATGAGTCTAC AGCATAGGCA AAGACTGGAC CAGCCTTGCT
AGTCTAATGC CTACAGAATC TCAATGCCCA GATTTGTGGT TCATAGAGTT CCTGAAAATG CACCTAAAAA
TGTTGGCAAG AATGGTCATC GTTGTATTTA GCTCCATGGA CTTGTTCAAT GACTGGAACT CTGAAACACA
GAGAAGAGCT AAAAGCCTAA TACAACTTCA GGAAAAATAA AAGCCAATGA TCTGAACTGG ATAATTCACC
AGTCAAAGGA AATCATTAAT GCTTTTACTT TAAAGCAGTT GTGCAAAAAT AAGCACTTGA TTTTTACATG
CCAAGGACCT GCACTAATTT CTTTCCAATG CAGTAGTTAC CACTTCCCTC TACTTCCTTC ACGAATAAGT
AAAAGGGCAT GTTTAGAGAT ACTCTTGTAA GTGTAAACTA AGTTCATTTG GGAGCCTCTA TTTGAAAATA
CTGGTATAAA AAAAAATCTG TCTCCTGATA CTAACATTTG AAGGAATCTA CTTTTTTACA TATTGGCAGA
GGGTCTGATT CTATCCTTAG TTCTTCCCAT TACTTTGATG AACCTTTTCA AGGTGATTTG ATCCCCACAC
CCAAATATAT GATTGAGAGA AGGCTCAAGT TCCCAGGAGC TCCAGACAGA AGGTACCTGT TGGCTTGATG
AAGATGAGGA GGAAATGAAC ACTAGCTAGG CCTTAAAGGG AAATGTCTCT GATAGGCCTA ATACACAGTC
CTCTGCTAAA GGCCTCCCTG CCTCTCTCTG CTCATCCACT CTACTCCCTG GCCCTGGGCA CGCAGCACAC
AGAGATCAGC ATTTCTGACA GCTTCTGTAG ATCCTACCAT TTAAAGACTT TTGTCATCCA TGCAGATAGT
```

-continued

```
CTCAGGAGCA GACACAGGTA GCTATTCTTT CACATGCTAG CTTAACATGC ATTTGCTTTA GCACCTATTG

CCAGGCACTG TGTCAGGTGG AGGGTATACA AAGATGAACA AGACATGATT CTTCTCATAT ACAGATAGAT

TTTGGAGGCA TTAGCTTAGT GATGATTCAG GAGTATCCAT TATTTGGGGA AGTAGGTGGT CATTAGTGAC

CTTTTACAGG CATTTCAATG GGCTAACAGA GATGTTAGAT TGTAGTGGAA TAGAAGAATG GGTAAAAAGT

AAATCAGTGA GTTCAGATTT TAGGAGTTAA GATGGCAAGA GGTGAGAACA AAAAAAGGAA ATGATTGTCA

TTAAAGGAGG AGGAAAGACC AGCCAAAGAT TTTACAGTGA GTTAAGCATA CAAATTTATT TCTAGGCCAC

ATATTCTTAG CAAAACAACA TGTAAATGTT TATGTATGTC TTTCCTCATA TCTGCTCATC CATCAGCTCC

ATCGTTAAGA TTTCAGTTTT CCAGGACAAA CTTACTCACT TTGACATATT GGACTAGGAT TTGACCAGAT

TCCAGATGAT TCACAAATGG TTTTCTTCTT CCCAATTAAC TCAGTTCCTT CTGAGCAGAT GAAGGTACAT

GCAGAGGTAA AGCTGAAGCT GGCCAGGGGA TGGCTACAGT TCATGATCCC AAATCTGGT GCTGATAGAG

GCTCACACTG AATCACTTCA ATGAAAAGA AAAAAAAAAA AAAGACAAAA CAGTATTTCT GAGTAGAGAC

CCTCCCTTGA GCAAAGGATT TTTAGCCAAA GCTGCCTGAC TACATTACTT GTGATATTGC TTCCAGGCTT

TATTTTCTTG AGAATGATGG TGGGTGGTGA ATGAGAGATG AAGGCAAGGA AGCATTGAAA GCTGTGGGGA

GAGGAGTAGC TACTCCAGGC TGCTGCCCTA GCTAAGGTGA CCCTCCCCTT CTGCTGGAAG TACCATGCCA

TATGGCCTCT GCATCAAGGG CTCTTATGGG ATATTCTCAG AGAATCTCTG CCGTTTCATC TGTTCTGATA

TCTACCCAAG CATTTTGAAA AACATCCCAA TTCACTGAAG CAAGTCCAAC TTCCGTAAAT TCCAGTAGGT

GGGTTGACAG TTTTATAATT TCAATAAGGG ATTTTGATAG CACTTCTAAG AATTAAACTA CTTAAACTAA

TGCATCAGGA GCATACTTGT AGAAAAGTTA ACCAAAACTT CGTAAGTTCA GATGACATTG GTTTTCTCCC

ATATGGAGAT AAGGTTGGCA GTTAAAAATG AAAAAAAAAA AAAACCTAC CTTATTTCAA ACTTGAAAAG

ATCAAGAGAT TGTGTTTTTG TTTTTCAGTT GTTATTCTCC TAAAAGTTTA TGCATGAGGA AAAGTAAAAG

TGATTTTAAG AATAAGCCAA ATAAAACAAC CAAGAAAGAC CTCCACTACC CTGGGAAGGA AACTGGTTGG

TATTAAGTAG GACACCACAT AAAACAGGTG TTATTGAGAG GAGAAGAACC AAAATGTAAC TGAGGTTCAA

CAAGACATTA TTTATGCAAT GGCAATGAGA AAAATAAAAA ACACAGTATA ACCATGCTGT ATTGCTATAA

GTCATGTTAC ACACTGGGAG ATGGCTTCAG GGGTATTTGG TTTTTACTTT TTGTTTGGGA GGTTTTTCAA

AAAAATTTAG TTAGAATAAG TCCTTTGAGA AACATCACAG TAGGTTAAAC AAAGTTAGGT TAAATTAGGC

TCCTAAGTTT GACTTCTCAG CAAACTTCTA CTGAATGTTC TGACTGTAAG CCCAGGATTG CATGACAAAA

CCTCTAGTCT GAAGTTACTC ACCTTGACAG GTTGGTTCTG GAGATGACCA GTTTCCAAAT GGTCCACAGG

TGGTTTCTTC AATCCCAGTT AAGTTTGTTC CTTCAGAGCA GCTGAAGGCA CACTGTGAGC TGAAGCTGAA

GTTTCCCAAA GGGTGAGTAC AGTCCATGGT ACCCAGCTCT GGGGCCTCCA AAGGCTCACA CTGAATCACT

TCAATAGGGA AAGAAACAGT ATGGGGAAGA GTTAAGAGGA ACTGACGCCT GGATTTGAAT CCTAGCCCTG

CCACTTGATA ACCATGTGCC TTTAAACAAG GTTACTTGAA CCCTCCAACT TCAGTTTCTT CATCTATATA

AGAGGAATAA TGAAATTGTG TTATCTTTAT CAAATTGATA TGGAAACTAA ATGTAATTCA ATTAGCATAA

GTCAAGGACC TTAGAACAAA GCCTGACTCA TCAGAAATTC TAAGTAAACA TTAGCTAGTC TTCATATTAT

TATCTTCAGC ATTATCTGTA GTGAGAATCC TTAAAGCCAA ATAGGTGTAA CTGGGAATGA CCAGCTTAGT

CGGGAAATAA CTATCACATC AGAGCCCCTG AGTCTACTAG AGTATTGGGA GCAAGATGTT CAGAGAAAGA

GTGGGTCTCC ATAATAAGCC TTCTTTGCAA GGAGAGAATA TAAAAGTCTA GGAAGCATTT TGACCTCAAT

TCTGTCTTCT ATTCTAGCTC AGTTCCAGAA TTTTAACTCT TTTGATTTTG ACAACCCTCT CCAGAAACTG

TATCTATTTC CCTGTTCTGA TTGGTGGTAC AATAGGTAAA TTTAAGACTT GGAAATCAAA GTTTTCACAT

TTTAGACCCT GCCATGCCAT TTAGTAAACA GTACAACTTT CATGTCTTAT TCCTCATCTG TCAAATTTAA
```

```
GCCATTATTG CTACCTTGCT CTAGAGACTT CAAGGAAGAA TGGACTCAAG GAATCAGAAG AATTTTTGTA

TTTGGAAACT ATATGAGATG AGATTAGGGA GAAACATGGG AACTAAGAGA AAATGTTATC TTTTTTCATT

GATTTAAAGA GTATCTATTA TATATCAAGC ATTACTCTGG GGCTTGAAGA GCTTAGATTT CACCCTGTAG

GACAAAATGG TAGGTAGAAA TTAATGGGTG GATTGTCATG TATGTGTGAT GTGTTTTAAT TGCTTTTAAT

TGATCAGTCT CCCTGTAGTA TGAATAATGT ATTTGAGGGG AGCTAATTTA AAATTGTGGA ACTCATCTAA

TAAACTATTG CAAGAATCTA GAAGAAAGAT AATGACGGCA ATGGTAGTAG AGTTGACAAG TGGAAGACAA

ATTAGAAAAA CACTAAGTTG TAAAAATTGG TAGAATGTTA CCCTGCATAA ATGTTGGGGG AGTTAAGAGA

GTCTCATACC AGGGTGCCCA TGTAAATGGT GATTCCACAT ACTGAGATAA GAAATACGAA GAGAAAAGCT

GACTGGGAAC AATTGGTTTT ATAGTCTTTT AAACATCCCA AAGGACATCC TTAGCATATT TGAGTTCAGA

GCTGGAGATA GGCTTATCAG TCCAAAGATC ACATAGATTT GTGAGTCCGC AAAAGTCAGT AAGTTTGACC

AAAGGATACA TGTAGATTAG AGTCAGAAGA GCAATATACA AAAGACAAAA GCTGAGAAAT TATAGTAGTT

TATGGTCCTG GATAAGTGCT CATGAAGGAT CTCAGGAGAA ATGATCACAG GTAGAAAGAA TGAGAAAAGA

GTGATATGAG AGAAACCAAG ACAAAGAAAA GTAAAATGTT AAAAATGAGT GAAATAGGCA TACCAATAAT

TAAAAATGAG TAAAATAGGC ATACCAATAA CATAAGGGTT AAAAAATAGA GTTCAAAAAT GGGGTGAGGG

TAAAGTATTA GGAAGGAGTC ATGGCCCAGG GATCAAGTGA AATGAGTTAG ATCTATAGAT CTATTTCAGT

TGGTTGACAT TTAAATGTAT TTTGGTTTTA ATTCTTTATT GTTTACAAAC ATTGCTTTTT TAAAAAATTA

AATTGTCCAA TTCAATTCAG GCTCACAAGC AAGTGCCTCA TATATACAGG CATTTTGTGG ATCCCAAAGA

TGCAATGATA AATAGGACAC TTACTGATCT CAAGAAGTTT TCAGTACCAG AGGAGACGGA CAAGTGAACA

GATGACTTCA ACATAAGTGG GAGAAATGAG GAAGAAATAT GTGGAGCTAT CAGAACTAAG AAAGCTTCCT

AGAAGAAACT GTCTTTGAAC AATGTCTTAA AGATGACATG TTTTTTTGCC ATGTGCAAAA TGAGAGAGAA

GGCCACCAGC AAAGTCAGTG TGCTACAGAG CACATGTGTT AAGTGTGGAG AACTGCAAGA AGGAAAGGAA

CTACTAGAAG GAAAAAGCAA GATACTTTCT GGGTAACTCA GCCTCCTAAT GATAAATGGC ATAGTTTCTT

CCAGACCTTA GAGTTCTAAT TAATCTAACA AGCTCATTAG ATCGTGAGCT TCTTGAGAGC GGGAATCTAC

CATGCTAATT CCTTATGGTA ACCCTGACAG CTTTTATCCC AACACTGTGC TTCTTGTGGT ACTCAAAAAG

ACTTGTTGAG AAGTGAGTCG AAACTTCATG CTGACTTATG AAATCTTTAC GGAAAGGTAA CAATATTGTG

AAAGCAGAGC TTTCTGATCA AAACTTCCCA TTTCTCAGAG TGGCTAGTAT CATTTTGTTC CAACCAGCTT

CATGATAAGC TATAATGATT CCTGTGACTT TACCTAAGAA GAAGCAAAGA AAGGAAAGAG ACTTACCAAA

CTGACACTGG GGCCCATAGT ACCCCACATC ACAGTTGCAG GTGTAATTAT TGATGATTTC TACACATTCT

CCATGGCCAC TGCATGACCA GGGCTGGCAA GAAGCTTTAA GGAGGTCAGA AAAAAAATAT TTTAATGTGA

TTACATTTTA GTACTCAAAG TCATTTCTTT AGACATAGAT AACCTTTTGT CTGAGATGAT TTAAATAATC

AGGAAAGGTT TATTTGTAAA TTCATAGCAT AAAAATCATA TGCTAAAATT TTTACGTATA AAATACACTA

AGCATATAGT CATAGGCATT TATTTGCTTT TGGAATGAAA TTACCAATAC TAATATTCTG TAACACTTAT

AGGAAACTTA GTGGCATACC TTGAAACTCT TGAAATTACT TGTTTTTAAT GAGTGAGAAG GTTAAATGAT

GACCTGACCT CAATCATTTC TGCATGCAAT TATTTCTTGG CAATCCCTTT CTTTATAGAA ATCAAAGATT

AAAAAGTCCA AATTTGCTAA AACGGTAGAG TCCAATTTAT AAGAGACCAA ATTAACTATG GTTCATTATT

AAAACATCAC TTGGAAAATG CTGGCTGTTT TGGAATTGTA GAAGATTTTA CAGAAATATT CATACACCAA

AGATAGTGCA ATTTTTATAT AAAATTATAT AAGGTTAGAC CAAGAAGGAA GCACGCAGCA CCACACTCTC

TACTTCACAA TGTGAAAACT GAGGTGATGT GAGCCTAAGT TTCCAACTGG CCCCAGCTGT CAGCTTCTCC

TCCCCTGCCT TATTATCAAA GGCACTGATT GTCTAGCTCT TCCTCTGTAC TTCCTACGTA GATCTATCAT

TTTGATGTAA CTTGATTTAG GGGTATAGCT TTTGTGCACA GGGACAAATC TTACACACCA AAAATTCTTA
```

-continued

```
GGAGTGACAC GATGCAAGAT TATATAGAGG GCTAGATGTA TTTTAGAATG AACCAGAAGC TGTTCTCATC
CCCCCACCTT TCCATGGGGT AAATCTGAGT ATTCTCTTAA CCGTGGCCCT TCCTGAGTCT GAGGCAGCAT
AGCCGTCTTG TCACTCCCTA CCTGTGTAAC AGAGGGCTGC CTTTAGTTTG TGGCAGGCGT CATCGTTCCA
TTTGCCTGCA TCTTTGTTTC TCTTGATATA GATCTCCACG CAGTCCTCCT TGTTCTTCTT GTTGTTGGGC
TCACCATCTC CCCAGTTCTC TGCTTCTTCA GTAAGAGATT TGTTGGTTCC CACCCACGTC CATATTCCTC
CTATCTTCCG GATTCCTATC CAGTAGTAAG AACGACTGAA AGGCAGAGTC TTCTCCAGAT ACTCAATTTC
CGCCTTGTTT TGTATGGCAA CTAAATCTGT GTAATTGTCT CGGCAGAATC TTCTAGCCCT TTGCCAGTTC
ATGGGTTTTT CAGAATAATG GTAAGTCCAG CAGTCGGTTC CATGATGTGC CAGGAAATCT GCAAGACATC
AGTGTGACCT ATGCAGACTT ACATAATGTT ACAGCTAAAA AGAACCTAGC ACTACTCCAG GCTGAGCTAG
ACACTTAGAG ATGAGGAAAC AGAGCCTAAG AGTGTATGTG ACCATCTCAG GATCACAGAA TAGTTGTTTG
CAGATTTGAA GTAGAACCTA GACCTTCTGG CTTGAATATA AGATGCTTTT ATCTAAGTTT CTATTTGAAA
CAAATTTAGT GGTTTTCTAG GTTTATTTTC TTATTAATTT TTTTCTCAAA ATTATTTCAG GTGAAATTTA
ACCAACATAT TTTAGACATT CATATTTCTT TTTCTTTGTA GCTGTTAATG ATTTACAACT AATTACCGTG
TAATATCATA TAACTATACA ATTTACGTAT ACTTTTTAAT CCTGGAATCA TTTCTTGAAG GCCAACACAT
ATGTACCTAT GGGAGAAGCA TAATAAGGAC AGGAAGAACA GTGACATACT TTTAAGTAAC CTCTTTTACA
TAAAAAACAT TTTATTTTAC CATAGGAAGA ACTGCTTCTG GAAAAGCCCA ATATACCACT CAACTCTTAT
ATATCTAACT GTATAATTTT TAAAAGAAC AATTTACAAA GCCAAATGGT ATAGGATTAT GAAATTCATT
AGATCATGTT CTATACACAA AGAGACTCAA CTGATGATGT TTAATAAACA TATGGACCCA TCAAATATGA
GGGCTTTGAA GATATCTAAT TAAACACATA ATTACACAAT GACTTCATAA TAATATATGG CATTCTAAGC
ATGGTATGAT CTACATGAAT CACTATTTAA TACAGTAAAG AAACAGATAT AATTGATGGT AAAGAGCATC
ATAAAATAAA CATTTTGAAC AGAGTTTTGA ATGAGCATTC CACTAGAATG CAAGTTCTAA GAGGGAAAAA
ACTGTTGTGT CCACTGCTTT ATCCTTAGTG CCTAGCATAA ATTTCACACA TTGTAGGGAC TCAGAAAATA
CCTGTTGTAT GAAAAGAGCA CTAAGTTTCT ATGTGACACA GTGCAGACAT GGCATAAGGA ATGTGTGAAC
GGGAGAGTTA GCATGTTTGC TTGGCTAGAG CTGAAAATCC AGGCTAGGGA GAAAGAAGAC ATTAGTTTAC
TTAGGAAATG AAAAACCAAG TTCAAAGCTA TTGCTGGAGA GTCTTCAAGA ATCAGATATA AAATTTGTCA
CAACAATGGG AGAAGGACCA AAAAATGATA AACCCCCGTC CCTTAATAAG CTCGTATTGT AATTGTAGAA
ATGACATTAA TGTACACTGA ACTATGAATA AAAAATAGAA AATGAGGTGC TAAATATTTG GTACAGATTG
TAAGTACCTT AACAGAGATT TCTTAATTAA CATTATTCCT TTATAATTGA GGGATTTTGT GGGGTTATTG
GGATTTGAAC TCTACAGCAT GGGCTATTAT AGGGTAAAAA TAGTGTTCAG GAGTTTCTGG GGAAGAACTA
AAGGTAAGAA GAAAAGAGAT GTTTACAGAA GGGATAGAAT TAACAGCTCT GTGAAATAAT TTTCCCTTAG
ACTATGTATA ACTAGTGGAT ATTTAAGAAA AATGAATATA AGTAAAATAG ACTTAGCGAT ATATAAATAT
CATAACATAC CACAACAGAG CATTGTCCAC CCCCACAACT TGAAGATGTT CCATAAGTCC CTCTGGGTGC
TCTGACATTT CCATGGAAAT ATCTGCAAAT GAAATACAAA ATTATATTTA GATGTATACT CTTAAACCAC
ACATTTATAG CCTTTGAGGT GGTGCTTACA ACTTTCTTAA TAATCAGAAT AAAACACATA TGTCTACTAA
CCCTGTCTGA GGTAACAGGT TTCTCAGACA TAGATGAAAA ATTACTTCAA ATTTACATCA GAACTGATGC
ACAGTTTTGT TTTGTTCTAT TTTATTTTTA CGCTTTAGTC TCAAGTTGCT AATCGGTACT GCCCTGAATT
TTTTCTATGG TTTGGTAATT TTTATACCTG CTTTTCTGCT GAGCTATTAG ATAAAACTAT TTAATATTTA
CTATGTATAT TTTTTAAAGT ATTGTTGCTG CTTAATTAAC TATTGATGCT TATATTTAAT GTTATAGCCT
CACTCTTGAT CATAATGGGT CAATGCCTCA AATACCTAAA AAAAAAAAAA ATTAGATAGC CAGACACCAG
```

```
GAAAGAAAAG TATTTCTTTT TTTAATAAAA AGAAATACCT TTTTGAGCAA CTGAAATGAC AAAGTCACAA
ATTTCCTGCA CACCTTAAAA TATACTTAAT GTAAATGACG AGTTAATGGG TGCAGCACAC CAACATGGCA
CATGTATACA TGTGTGACAA ACCTGTATGT TGTGCACATG TACCCTAGAA CTTAAAGTAT AATTTTAAAA
AAATTCTATC TTCCAAAGCA TATCACTTCT CAGGTAGACA CAGTGTTTAT TGCAAAAGAT CTGATTTCAA
TAGTATTTCT TCAAGAGTCT CCCCAGAGAC AAAGTCAAGA AGAGGAAATC AGCATATCTG AGAAGAAAGA
TTTCAGGATC ACTTTTTTTG AGGGTCTGAG AAAATGTTTA GTTTCTATAT TATTTAAAAC CAGAATTGAA
ATGGGGTGAT TCCTATCCTT GCCACCTGCC TCTACAACCC CAAGAGTTTC TATCTGAGCA TCTAAACGTC
TTTTAGGCTG AAAGGCTCAC CATGGCTTTG CTTGGTCCTT CTCTAGTTCT TCTGCAGCCC ATTGAGCCTC
TTGACTTAGC ACAAGGGTCT CAGGTCCTTG CCCAAAGGGA GTGTGCTGTG CTGCAGGTAG ACTGCACTGA
ATGTCAACAG AAAGCCTTGC TTTCTTTCAT TTCTCTAACC CAGTCTCACA TCCTCCTCCT CCTCCCCTTT
TCCCTCCCCT TCCTCCTGCA CTTCTCTTTC CTCTTTCCCC ACCCCTTTCC TAGACTGGCC TCTATTGCCT
CCCACTGAGA CAAAAATGAA CTGCTGATCA GAAAGTAATG TGACTAGATT CTCTCTTCCT TCCCTCCTTT
CTATCCTTCC TTCCATTCTC CTATGCATCT TTCCTTACCC TCCTCCTCCT TCACTCATTG TTGTTGCTGT
TCTTCTTCCT CTTTTTTTTC CTCCTGCTCC TCTTCTTCTA CTTGTTCTTG TTCTTGTTTT TGTTTGGTTC
TTGTTCTCCT CTTCCTCCTT CTCTCTCTCC TCCTCCTCCT TCTTTTCCAC CACCCTCCCC TATCTTTTTC
ATAAATGCTA AACTAACTCT TGGCTACCTG TGGTAAATGG CCCTTGGAAA TTGCAAATAC TACAAATCAA
AACTGCATTT CAGACATATT TATGATTTTT GCAAAACTTC AGTAGAGCTA AGCAGTGGAC TTGACTCGTT
TCGGTTCCTT CACCTCCGTC TTTCCCTGCT CACCACCTAG TGGACGTCCT TGTTAGTGGC ACTTCCTGAA
GTTAACCCCT GAAGAGAGCC CATGCTCTCT AGCTTTTCAC CGTGTAGGTT TGGGAGCCTA CAAGTACCCT
TAATATTCTT GGACTATAAA ATGAGATGGT TTTATAAGAC TGCATGTGAA ATTAGGACCC ATATGATGAA
GGACAATAAA AAGGAAGACC CACTGATGTG AGTCAATGAG TCAAATGCAA ATCAGATTTG CATTTTTAGG
AAAATAATAA TAACAACAAC AAAAACTCTG AAGCTCAGCG CCCCATATTT ATTATATTGT TTAATCTTTA
TAACAGCTCT CTGCTATAGA TATGATTATT ATCCCCATTC TAAAGAGTCT CAAAGAGGTT AAGAAACAAA
TTCAAAAACT AGCGAAAGAC AAGAAATAAC TAAGATCAGA GCAGAACCAT AGGAGGTAGA GACACGAAAA
AGCCTTCAAA AAATCAATAA ATCCAGGAGC TGCATTTTGA AAAGATTAAC AAAATAGATG GACCACTAGC
TAGACTAATA AGAAAGAAGA ATCAATAGAC ACAATAAAAA ATGGTAAAGG GGATATTACC ACTGATCCCG
TAGAAATACA AACTACCATC AGAGATTACT ATAAACATCT TTACACAAAT AAACTAGAAA ATCTAGAAGA
AATGGATAAA TTCCTGGACA CATACACCCT CCCAAGACTA AACCAGGAAG AAGTCAAATC CCTGAATAGA
CTAATAACAA GTTCTGAAAT TAAGGCAGCA ATTAATAGCC TACCAACTAA AAAAAGCCCA GGACCAGATG
GATTCACAGC CAAATTCTAC CAGAGGTACA AAGAGGTGCT GGTACCATTC CTTCTGAAAC TATTCCAGAG
AATAGAAAAA GAGGAACTCC TCCCTCACTC ATTTTATGAG GCCAGCATCA TCCTGATACT AAAACCTGGC
AGAGACACAA CAAAAAAAGA AAATTTCAGG CCAATATCCC TGATGAACAT CATTGCGAAA ATACTCAATA
AAATACGGCA AACTGAATCC AGCAGCACAT CAAAAAGCTT ATCAACCACA ATCAAGTTGG CTTCATCCCT
GGAATGCAAG GCTGGTTCAA CATACACAAA TCAATAAACA GAATCCATTA CGTAAACAGA ACCAATCACA
AAAACCACGT GATTATCTCA ATAGATGCAG AAAAGGCCTT GGATAAAATT CAACACCCCT TCATGCTAAA
AACTCTCAAT AAACTAGGTA TTGATGGAAC GTATCTCAAA ATAATAAGAG CTATTTATGA CAAACCCACA
GCCAATAGCA TACTGAATGG GCAAAAACTG AAAGCGTTCC CTTTAAAAAC TGGCACAAGA CAAGTATGCC
TCTCTCACCA CTCCTGTTCA ACATAGTATT GGAAGTTCTG GCCAGGGCAA TCAGGCAAGA GAAAGAAATA
AAGTGTATTC AAATAGAAGA GAGGAAGTCA AATTGTGTCT GTTTGCAGAT GACATGATTG TATATTTAGA
AAATCCCATT GTCTCAGCCC AAAATCTCCT TAAACTGATC AGCAACTTCA GCAAAGTCTC AGGTTACAAA
```

```
ATCAATGTGA AAAAATCACA AGAATTCCTA TACAGCAATA ATAGACAAAC AGAGAGCCAA ATCATGAGTG
AACTCCCATT CACGATTGCT ACAAAGAGAA TAAAATACCT AGGAATCCAA CTTACAAGGA ATGTGAAGGA
CCTATTCAAG GAGAACTACA AACCACTGCT CAAGGAAATA AGAGAGGACA CAAATGAATG GAAAAACATT
CCATGCTCAT GGGTAGGAAG AATCAATATC ATGAAAATGA CCATACTGCC CAAGGTAATT TATAGATTCA
GTGCTATCCC CATCAAGCTA CTACTGACTT TTTTCACAGA ATTAGAAAAA AACTACTTTA AATTTCATAT
GGAACCAAAA AAGAGCTTGT ATAGCCAAGA CAATCCTAAG CAAAAGAAC AAAGCTGGAG GCATCATGCT
ACCTGACTTC AAACTATACT ACAAGGCTAT AGTAACCAAA ACAGCATGGT GCTGGTACAA AACAGATAT
ATGGACCAAC GGAACAGAAC AGAGGCATCA GAAATAACAC CACACATCTA CAACCATCTG ATCTTTGACA
AAGCTGACAA AAAGAAGCAA TTGGGAAAGG ATTCCCCATT TAATAAATGA TGTTGGGAAA ACTGGCTAGC
CATATGCAGA AAACTGAAAC TGGATCCCTT CCTTACACCT TATATAAAAA TTAACTCAAG ATGGATTAAA
GACTTAAATG GAAGACCTAA AACCATAAAA ATTCTAGGAG AAAACCTAGG CAATACCATT CAGGACGTAG
GTATGGGCAA AGACTTCATG ACTAAAACAC CAAAAGCAAC AGCAACAAAA GCCAAAATTG ACAAATGGGA
TCTAATTAAA CTAAAGAGCT TCTGCACAGT AGAAAAAAAA AAACTATCAT CAAAGTGAAC AGGAAACCTA
CAGAATGGGA GAAAATTTTT GCAATCTATT CACCTGACAA AGGGCTAATA TCCAAAATCT ACAAGAAACT
TAAACAAATT TACAAGAAAA AACAAACAAC ACCATCAAAA AGTGAGTGAA GGATATGAAC AGATGCTTCT
CAAAAGAAGA AGTTTATGCA GTCAACAAAC ATATGAAAAA AGCTCATCA TCACTGGTCA TTAGAGAAAT
GCAAATCAAA ACCACAATGA GATGCCATCT CATGCCAGTT AGAATGGCGA TTATTAAAA GTCAGGAAAC
AACAGATGCT GGAGAGGATG TGGAGAAATA AGAATGCTTT TTACAGTGTT GGTGGAAGTG TAAATTAGTT
CAATCATTGT GGAAGACAAT GTGGCGATTT CTCAAGGATC TATAACTAGA AAAACCATTT GACCCAGCAA
TCCCATTACT GGGTATATAC CCAAAGGATT ATAAATCATT CTACGATAAA GACACATGCA CACTTATGTT
TATTGAGGCA CTATTCACAA CAGCAAAGAG TTGGAACCAA CCCAAATGCC CACCAATGAT AAACTGGATA
AAGATGATGT GGCACATATA CATCATGGAA TACTATACAG CCATAAAAAA GGATGAGTTC ATGTCCTTTG
CAGGGACATG GATGAAGCTG GAAACCGTCA TTCTCAGCAA ACTAACACTG AACAGAAAA CCAAACATTA
CCCATTCTCA CTCATAAGTG GGAGTTGAAC AATGAGAACA CATGGACACA GGGAGGGGAA CATCACACAC
TGGGGCATGT CAGGGGATGT GGGGCTAGGG GAGGAACAGC ATTAGGAGAA ATACCTAATG TAGATGACAG
GTTGATGAAT GCAGCAAACC ACCATGGCAC ATGTATACCT ATGTAACAAA CCTGCACGTT CTGCTCATGT
ATCCCAGAAA TTAAAGTATA ATTTAAAAAA AGTTTAAAAA AAGAAAGTTG CCTTAGTCAC ATAACTAGTA
AGAGACATGG TTGGGAATTT GAACAGAGGC CAATCAGTTC CAAATCCATG CTCTTGATCA TTAAGCTGAA
CTTATGGCAG GAACTTGGAA GACATGGTAA AATGGGGAAA AACGTGGAGC CAGGGAGACT TGTGAAAGTG
CCAGTGCTCC CACTATACCC TGAAAGAAGT ATCTAGACTT ACTTTTTTCT AAGTCCTCTC CTCTAATTCT
CTCAATCTCT CTCTCTCTTT CTCTAAGAGA TGGGAATGCT GCTCTGTCAC TCAGGCTAGA GTGCAGTGGT
GCGATCATAG CTCATTGCAC TCAAGGAATC CTAGGGTCTA GTGCCCCTTC TCCCTCAGCC TCCCATGTAG
CTAAGACTAC AGGCACATGC CCCAACCCTC GACTAATTTT TTTATTTTTT ATTTTTGTAG AGACAGGATC
TCACTATGTT GCTCAGGCTG TAATTCTGTC TTGAAGCTTG TCCAATCAGG CTTTCAGCCA CACCAATTCC
CTGAGACTGC TCTCACCAAG GTCCTACACT TCACTAACAC AAACAGCCTA TTCTCCATCC TCATCTTACT
TCACCAGGGA GCTCCTGGTT TTCCTCCTAC TTCACTGGCT ATTTCTTCTG TATCATGTGT TGATTCTCCC
TCATCTCCCC AACCTCCAAA CCCTTGGAGT ACTCCAGAGA TCACCGCTTT GCTCTTCTGT GTCTAACCTC
ACTAACTTGG TGGTCCAATT CACACTCTTG ACTTTGAATA CCATTTAAAT GCGAACGAAT TCTAAATTCT
GTACAACCAG AACCATTCTC CTGTAGCCAA ATGCCTACTC AACATCTCCA TCCCCAAACA AATTTAGTTG
```

```
TTCAATAAGC CTCTCATATT TTACATATCC CAAACTGAAC TTCTGAATTT CTCCTCCAAT CTGTAGGGCT
CTTCCCACAG CCTTTCCATC TCAGTGGATT ATAACTCCAT CCTTCCAGTT ACTCAGACCA AAACTTTTGG
AGTTAACTGA GACACCTCTC TTTTTTTTCA CAAGTCATAT CCAATGTGTC AACAAATTTT GGTAGTGGAA
ATATTGCGGG ATTTTTTAAG AAATCAGAGA GACCGATGGG GTTCAGGAGG ATATTTATTA TTTAGGTGCA
CTGGCCAAGT CAGATTAACA TCCAAAGGAC TGAGCCCTGA ACAAAGAGTT AAGTTACCTT TTAAGCATTT
TGTGGGGTGG GAGAGAGGGG TATCTGTGCA GGGGGAAGCA TACTACAGAA GTGAGAAATA AAGACAGTTA
TTCAATTAAT TGAGACATGC ATTACATCAT TTCTTACTTT TCAAGAAGAA ACATGTTTTG CGACTTGAGT
TTATCTGTCT AGTGACCTTG CAGCTGCACA GCTAGAGAAA CAGGGTCTTC ACAATGCCTG GGAAAGGAGG
AGAGGTAAGT CTCACTAGCC ACAGAAAAAC AGGCAGTTAA TTTTTAAAGG CTCCAGCTC TTTCTCTTTC
TCAGGGGGAG TTGGGTTTTG TTACATACAA CTGAGTTTCC GCTTACACAT TATTTAATTT CTTTTAATTC
CTGTTCCAAA AGAAGCCAGA TACAAAAGGT TACATGTTGT CTGATTCCAT TTATATGAAA CATATAGAAG
AGGTAAATCC ATAGAGACAG AAAGTAGATT AGAGGTTCCC AGGGGCTGAG GAAGAAATGG GGACTAACTG
CTTATAGGGT ACAGAGTTTT CTTCTGATAA AAATATTTTG GAACTAGATA GACATTTTGT TAGGCCATTC
TTGCATTGTT ATAAAGAATT ACCTGAGACT TGGTAATTTA TAAAGAAAAG ATGTTTAATT GGCTTACACT
TCTGCAAGCT TTACAGGAAG CATGGTGCCG ATATCTGCTC AGCTTCTGGT AAGGCCTCAG GAAGCTTACA
ATCATGGCAG AAGGTGAAAG GGGAGCAGGC ATATCACATA GCAAAAGCAG GAGCAAGAGA GGGATGTGGG
GAGGTGACAG TCACTTTTAA ACAGCCAGAT CTTGTGAGAA CTCATTCACT ATCATGAAGA CAGTACCAAG
AGGATGGTAC TAAATCATTC ATGAGAAACC CCACCCTCAT GATCAAATCA CCTCCCACCA GGCCCCACCT
CCAACACTGG GGATTACAAT TTGACATGAG ATTTGAGTGA GAACACGGAT CCAAACCATA TCAGAGATGG
TGGTTATACA ATGCGATAAA CGTCACTGGA TTGTACACTT TAAGATGGTT GTTTTATGTT GTGTGAACTT
CACCTCAATA AAAAAAAATA TTTAATGTAC ATTCAGCCAA AAGAAGATTT GGAATAGGAA AGGTCATGGA
GATATATTAA CAGCCATTTG ATGGGTGGTA AGGAAAAGAG TGGTTATTAG ACTGTTTTGT GGCCCTCAAA
AGGTAGAACT AGATCGAGTT GGTGAGCATT ATAAAACCAT CACAAAACCC TGGAGAGAGG ACCCAGTGCT
GAAGAACCGT TTGCCTGCCA TGAGACATGA GGGAAGTACC AGTGAATGCC ATTGAAAGCA GCATCCCTGG
GTCCAAGGGA TGGTCAAAGG ACCACTACCC AACCCTTCCC TAGCCTACGC CTCCATTACA GATGACCGCA
AGATTTATTT GCTCATTGCT GCCAACCAAG GCTGCACTCA CTGCAGTTGC TATCAGTTTA TCATGGGTAA
AAGGAATGTG CAGTAGAGAA CTAACTAACT GCCCACCTAC CTCCACAATC CTATCAGGAC AAATCACCAT
GGCTCACATT TCCTTACATT TGGCATGTAA GCCCCTCTTA CTGTCTGTCA TCTATCTCCT ACACAGTTCA
CCTAAACTGT TCTCTCCTGA CCCAACCTTG ATTTTCATCC CAAATGCTTC CTTGCCATCT CTGGGATTCC
TGTCTTCACC ATCACCAAAC TCCCCTCAAT CTTCCAGTTT CCTGTTCAAA CTTTTCTCCT ACCTCCTTGC
TTTGTCATTA GCCCGACTGC CTCCCTAGGA CATCACTTCC CCTGCAGATC TCTCAAGATG ACAATATTTA
TTCTCCACAC AGCACATACT TCAGGGTTGG AAGGCAGGGG CAATCTTCTC CTTTATAATG AGTGCCTCTT
ATATATGTTT ATTCATCTGC CCTCTTGTAA AACACACACA CACACACACA CAAAGAAGAA ATAAAATAAC
TCTGCTTCTT TGAAGCTTGT GACACTGAGA TAAACCATCT CACTGTCCTC ATTGTAGTGA CCTCTCAACT
CCTCATGCAA GATTGGCTTT GGCACCTAGT TCCTGATCTT CCTTTCCCTG TAAGCACTTC TCATAGTCTT
ACGGGACTTC ACCATCCATG GCACAACCAA TACCACAGCC CAGATCCTCA GCTCTCCAAT GACATTTTCC
TCCACTAGAC TTGAGCTACC TCCTTCCCTA GGCACAGCCT CAACCTCGAC AACACCTAAG ACTGTACCGT
CTCTAAAGTC ACATGTTCAA ACACTTCACT CTTTAACCAC TGTCTCCTAT TCTTGCAAGT GTATTGCTCA
AGTATCTCAT TGCAATGCTT TTTACTTCTA CCTCATTGAA CCTCCAGGCC ATTAAACATT TCCTTATTTC
TAACCATCAG GTTTCTCCTT ACTTGTTTGT TTGTTTATTT GTTTCTTTTT TTTTTTTTT TTTGAGACAG
```

```
GGTCTCACTC TGTTGCCCAG GCTGGAGTGC AGTGGTATGA TCTCGGCTCA CTGCAGCCTC CATCTCCCTG

GTTCAAGTGA TTCTCATGTC TCAGCCTCCC GAGTAGCTGG GACTACAGGT GCATGCCACT ACGCCTGGCT

AAGATTTTGT ATTTTTATTA GAGAAGGGGT TTTGCCATGT TGGCCAAGCT GGTCTCGAAC TCCTAACCTC

AGGTGATCCA CCTGCCTCAG CCTCCCAAAG TGCTGAGATT ATAGGCATGA GCCACTATGC CCCACCTGGT

TTCTCCTTAT TTATTTCAAG TCTATGCTGC ACTATTAAAA CTGCCTTGAC AAAAATTATA ATAGTGAGAA

AATTATGACA GTGAAAGAGA TCTGAAATAA TCAACCCCCA TCTTGCCTTT ACCTTCCAGA CTGCCCTTAA

TAATTCCTGA GCTTGGGCCA AGCTATCTTT GGCAGAAATT TAGTTTATAG TTTAAATGAT AATAGCCCTT

CTCCAAAACT AAACTGCCTT TGTAAAACTA ATAAAGACC ACCAATGAAA GGTTAGGAGG ATGAGAGGAG

CCTGAATTCT GCTAAGGTGT AGATGTAAAC AATTACCAAC TGTTATTCCG GAGGTCACAA GATTTGCAAC

ATCGCCAATT ACTCCTGCAG ATAACAGCAC TATCATAGAA TCTGATTGGC CTTTTGAGAT GTCTTTTCAG

ATTCTTACAT TTCAACTGGT GGCTCTACCT GGACCCATCA ACAAGTCCTG TGGCTCCACC CAGAAGCAGA

CTTAACATGC ACAAGGACCA TTTTCCACAC CGCTATGATT GCATCCCAAC CAATCAGCAG CAACCATTCC

TCTGCCTGCC AAATTATCCT TGAAAAATCT TAGCCTTAGA ATTTTGGGGG AGGCTGATTT CAGTAATAAC

AAAACCCCGG TTCCCATTTT GGCTGGCTCT GCATGAATTA AATTCTTTCT CTATTGCAGT TCCCATCTTG

ATAAATCACC TTTATCTGGG CAGCAAACAA AAGGAACCCA TTGGACAGTT ACACTGTTGG CAGATATATC

TTGCTTCCAA AATTGGATTT TTGTTTAATG AATTTATTCT GTTTTCTTGA TATTTACAAC TGTGAATGTT

GTGTCTGAAT TCTCTTTATT TCTTGTTGAA AAGAACTATA TTGCTACAGC CAGTACATAC AGATGGATAG

CTAATTACTC AACACGGGGG GATGTGACCA TCACCGCACT GTGCAAATGA ATGTTACCCA TTGTCCACTT

TTCCCAAACT ACATAGTGTT ATATGGTATA TGACCCAATC AACGGTGGCA AGCTCCAGA ATACCACAT

AGACATCAGG GACACTTTAA ACTAATCAGC CTATAGTCCT TTTTCAGTAA TTTCCAAACC TGGTTGTGCA

TCCAAATCAC TTGGTAACAT TAAAAAAACA AAAAAATATA CACGCAACAT TCGCTCCCAA TCCTACTGAA

TCAGAATATT TTGGGTTGGT TCAGGAACAT TCAGGAGTTT TTCAGGGTCC AAGGTTTATA TAATTTGAGG

TCTCTCTTTG AGAAAAGGAA CGTAAAAGCG TCTTGCTTTT ATAGATCTTA CAAAGATGTA TTACCATGTA

AACACATTCC TAGGACCCAG GCCCTTGTAA TTTAAAGGTT TATCTAAGTA ATGGGCCCTG AAGCTTAATT

TTCATTATCT TCAGGGCAAA TTACCTGTGG GTTAGGGTTT AGGAATATAT CTCTCTGTGT ATGTGTGTGC

ACATTAGCAT GTACGCTTGT GTGGATTTTT TTTTTTTTTT TTTTTTTTC TGAGACAGAG TCTCGCTCTG

TCGCCAGGCT GGAGTGCAGT GGCGTGATCT CTGCTCACTG CAAACTCCGC CTCCCAGGCT CAAGCGATTC

TTCTGCCTCA GCCTCTTGAG TAGCTGGGAC TATAGGCACG CACCACTATG CCCAGCTAAT TTTTGTATTT

TTAGTAGAGT TGGGGTTTCG CCATGTTGGC CAGGATGGTC TTGATCTCTT GACCTCGTGA TCCACCCGCC

TCCACCTCCC AAAGTGCTGG GATTACAGGC GTGAGTCACC ATGCCCAGCA CTTGTGTGGA TGTTTTAAGC

TCCCAGGTGA GTGAATACAA AACTAGATCT TTCCCTTCTG TAGCATCTGT ACTGTTTACT CTATGCATCT

CAATATTTTT TCTTTTAGTA TCTTTCCTTT TTCTCTCTTA TTACTTCCTC TTGTGCTATT TTTACACCTC

CTTTTTTAAA AAATTTTTTC CCTTTTATTT CTATTGACCT TTAGCCCTCA CAATGATTCC TACAAGCCCC

ATTTCTGTAA ATGGGATTG AAATAATTGC TGGACTTTTG AGAGATAGAT ATATTAAATT GCAAACTGGC

AGTAGTGGGG GCAGTTGATA CATAACTAGG TTTTAAAGTC TAGCCTTCTG AGACCACTCA TTCCATTTGT

GAAAAGTGAT TCTACTTCTT ATTATGAGCC AAAAATATGCA TTCATTCACC CATGCATTGA TTTATTCATT

CAATAAATAT TTGTTGGATG TCCACTCTGT ATCAGGAATG TGCTAGGTTC TGGGAATACA GCAATGAACA

AGGTAATTTT TCCCTACCCC TAAGGAACTT AGAGTTTAGT GGGGAAGACA GACATTAAAC AAACAATTGT

GCAAGTAATA ATCTATAATT ATTTATTACA ATTAAAGGAA GGAAGAGACA TATGGATTAT GAGGGCATTA
```

```
AAGAGGAGAC CTAGTGTAAG TAGCCAGTTC TCGTGAAGGG ACATGTATTA GTTGGAGTTC TCCAGAGAAA
CAGAACCAAT GGTGTGTGTG TGTGTGTGTG CGTGTGTGCG TGTGTGTGTT GGGGTGTGGG GGTGTGGTAT
TTTTTATAGA AATTGTCTCA CACAATTATG GAAGCTGAGA AGTCCCATGG CCTGCTGTCT ACGAGCTGAG
AACCAGGAAA GCCAGTGGAA TACTTCAAAG TCCAAAGGCC CTGGAACCAA GAGTGCCAGT GTTGGAAGGC
AGGAGAAGAT GGGTGTCCCA GCTTAAAAAG ACAGTGAATT CACTCTTTTT GCTCTACATA GGGCCTCAAT
GGGTTGGATC ATGGCCACCC ACATTGGTGA AGGCAATCCT CTTAGTCTAC CAATTAAATA CTAATCTCTT
TGGAAATACT CTCACAGACA CACTGAGAAA TAATGTTTTA TCAGGGTGAT AGAAATCTTC TGGAGTTAAA
CAATGGTGAT AGCTGTACAA TCACATACAT TTTTAAAGGG TGCGTTTTAT GGAAAGTGAG TTTTATCTAA
ATAAAATTTC TAAGAAAGAG ACTTAACACA GAGATAAACA TAAGCACATT TATTGTCAAC CTTTATAGTG
TTATGTCAAA TAGGTCTGAC ATAAGCTTAA ATAAATATAT ACTTTAAAAA TTATAAAATA TTTTAAGTTA
TAATTTAAAA TTCTCAATAA AACTCAAACA CAAACCACAC TGGTATTTCA CACAGCTAAT TTCTAATGCA
GTTTACATAA ATATTTACAA CACTTAAACA ATTTCAAAGA AAATAACACT GTATTCCATA CATAGCCTGA
TCACAGTAGT TGTTCTCTCT TATTTCCCAG AGTTTTTCTG CCCCTTTAAA AGAACCTCTG CTGTTCTGAT
CCTTATCACA TCTCTGTTTT GACTGTTGGC TTTGTTGTTG CCAGTGTTCA GCCAGAACTT CTCTGAAACT
TTTTTTTCAA CACATGCTAA GTTAATGGAA GTGTAGGAGA GTTTTGATTC TCACACTCCT CAAGGCTAGA
GCAGCTTTGG CAATTACTGA CTGAGAATTT TTCATTGCCA GTGATCAACT GAAAACTGGA GATTCCTTTG
GAATTGTTAA ATCTGCTTAT AAATAAACAT AAATGCTTGC TCACACAGGC ATTCCTCTCT TCCAGAGCAC
CCTAACATAC AGAAGAAAAC AAATAGGGAA TAACTATTAG ACATCTTCAT TCGTTAAAAA TCTACCAGAT
GACTCTTTTA CATGGTGAGT TTCTATTGTG AATTTAAAAT CTTCCATAAT ATACAAGAAT TATGTTTACA
TATCATATCT GACAAACATC TTTGTAGGAA TGCAAAGCAC ATCCATCTTT CTGTATTCTT TTCCAACAAA
GACATTCATA AAATTATACC TTTGTGTGTT TGCATTTATG CTTTTATTAG TTCAAAACGT TTGGCCTCAT
GGAAGTTTTT CATCGTGGAA ACCACATATT TCTGAAAAAA TATCTGACAA TATACAAACC TTCCATTCAG
TTTTTACTCT CCAATTCTAC CATGTTTTCA AAAAACAACT GTAGTAAAAA CACTCAGAAC TTTATTCTGG
TTAACATCAT GCCTTGCTAG GGGACAATAG TTTCCCTTTT TGAAATAAAT TTAAAACAGA TGTAACATAA
TTTGTTAATA AACAATGAGG GGGTAATCTA GAATAAGTAA CTTTTACCAT ATCATAGTTG ACAGCATTTA
CAAGTTTTTT AAGTCCCTAC CACACTTGTA TTGAATGAAG AAGTATGGAA GATTATAATA TATTCAATGC
AAGTAAAAAT ATCACAATCC TTAAGAACTC TTTAAGAAGC ACTGAATCCC ATAGGGATGA AAGTGATTAA
ATTGTGCATA GTAACCCTCG CACAGAGCAT TCAGTAGGAT TTGCACCATT AACAACCCTC CATGCATTTG
CCTGTGGGCA TTCAACATCT GTCATTTTTT TAAGTTATAA TATTTTTAGT CATTTTTTTC CTCTAAACTC
TGGATAATTA TTATTCATTC TTATGACAGC AACTGTGTAA TCAGCTGTCG AAACACTGTG AAGGGCAAAA
GAAAGAAAGC CACAAAATAT TGTGTTTCTG TGCCAAGATT TTACAGCGAG CAAGGGAGAG TTAGAAAAGG
AATTCTGAGA TTTCAGAGTC TTGGTCTCTT CACCTTTGCT TGGAAGAAAA TATCCTTTCC CTTCATTAGC
CAACACTTTC TTGATCCTGA GAGTAGGAAA GGGAACACTG AGTCTTTTCA GTTGAAGGCC GTCCTTGCCT
GCTGGACTTT GATCTATTGA AGTGGTGATG GGTGTTGCGG TTTCAGCCAT AAAGGCATCT GGCATAGTAG
GCAAGAAGGG CCAGAGACCC GAGGAGAGTT ATCTGTCTCT GTTAACTTCA GTGTATCCCT CTAGTTCCCC
AGATGCACCT GTTTCTGTAA ATATAAACAT GCATGTCATC AGAACACTTA ATATTCTGCA TACTGATCAT
GACAACAAAA TGTACCTTCT AACACAGACA CTCTCACTAG GATAGACCAT GTAGGAACAT CGAATTCTAT
TCAGTTAGGA CAGTGATGAT GTCTACATAT TATACCTCTG TCAAAACCTA CAGAATATAC AACACAGCAC
AGAGTGAATT CTAATGTAGC CTGTGGACAT TAATGAATAA TAATGTATCA ATATTGGCCC ATCAGTTGTA
ACACTAATAT AAGATGTTAA TAACAGGGGG AATTGAAGGG GTGGTGGGGA GATATGTTGG AACTCTTTGT
```

```
GCTTTCTGCT CAATTTTTCT GTAAACTTAA AACCGCACAC ACAAAAAAAG TTATTTTAAT TTTTTAAAAA

GTATTCAGAG GGACTTGACC TTTCCAAATT CTCTCAAAGC AGGTCGGAGT AGTTAAGAAC ACAAATTTTA

GAACCAGACT GCCAGAGTTT GAATCCTGGC TACACCACTT ACTAGCTTTG AGATTTCAGA CAATTTACTT

AACTTCTCTG TCTCATTTTC TTCATCTGTG TGATAAGAAA TAAAGTAACA GGCCAGGCCC AGTGGCTCAC

GCCTGTAATC CCAGCACTTT GAGAGGCCAA GGCGGGTGGA TCAGGAGTTC AAGATCAGCC TGGCCAACAT

GACGAAAAAA TACAAAATCT CTACTAAAAA TACAAAAATT AGCTGGGTGT GGTGGCAGGC ACCTGTAATC

CCAGCTACTC AGGAGGCTGA GGCAGGAGAA TTGCTTGAAC GCAGGAGGTG GAGGTTGCAG TGAGCCAAGA

TCATGCCACT GCACTCCAGT CTAGGCAACA GAATGAGACT CCATCTCAAA TTAAAAAAA AAAAAAGTAA

AAAGAAAAGA TAAGAAATAT AGTACCAGCC CCTATCTCAG AGTTCCTAGC TTAGAAAAAT TCCCAGAATA

TAATAAGTGC AATGTAAGGG TCAGCTATCT TCATTATTAT TATCTATCAT AAATGAAATT ACACAATAAA

GCTAGATCCG TTTCTTTCCT CTCCTTCTAC AAAAAATAAA GCAACTTTCC AGAACAATAC CCAGGTGATG

ATTTCTCCCC TGCTCCCTCC CTAAGATATT GGCAAGTTTG GAGGGTTCAA GGAGAAACAG AGCATGTAGA

GAAGATACCT CTCTCATAAC CATTTGTGAT TTACAAGTCT TACCTGATTC TTTTGAACTT AAAGGATGTA

AGAAGGCTTT TGGTAGCTTC CATCTGATTC AAGGCTTTGG CAGCTGCTGT GGAATACATG AGAACACTAG

GTAAAGCACT GTCTTCCAAC ATGAAGAGAG AAAAATATGT GGAATGTTCA ATGGCATGCT TTGTATAAGA

ATGCAACTTA CCTGGCAGGA ACAAATTTCT TTGCTGCAAA AGAAAGACA AACAACCATT AATTCAGACT

AAATGACTTT TAAGGATATA TTAAATCCAG ATACAATATG ACTTAATTCA TCAAGTGTTG CAAACTCGAT

GCTTCAGGGC CTCTGTAATA ATCAGAGCAC AAGCATGGCT CTGTGGCATC TAGGGTAAAA TGCAAAGTGC

ACAGCCATCC AAAGGGCATA GCAGCTTCCT AATGCCAGCA AATAGCTACG GGTCATCTT GCCCAATTCA

GCTCCCAATT TTTCATGAGA AGTCCAAAGT CTTAATTTAA ATGTGAGATT TCCTATTTTG TAAACGTCAG

AACTTAACTC AAAAATGTTT TAAGTACTCT TAAACATGTA AGCCAAACAA ACCATGAGTG TAGTCAGATG

TGCTTCCATA TTCCTTATGA GAGACTCTCA AATTTAAGCC TGTACTCCAA ATAAATCTCC TTAGGAAGAA

TTTTATCCAT TTTCCTTAGA GTGCTCATCA TGGCAGTTCC ATTGCACAAT TCCGGGAGGC ATCATATAAT

TCAACATGAA TAGCACCCCC TGGAGTTGTA CAATATTAGG CACGACTAAC ATTTTTATTT CCTGAAACAC

TTCCCACACT GAGTTGTACT ACTAACTCTT TTCTTAATAC TTCTGCTTAA TTATACTGCA TTTTATCCAG

ATTCTAATTA TTGTTAAAT CAGTAAGCAA GACCATGACT TATCAATGAG AAAGAAATGT ATTTTCAAAA

ACATTTTTGA AGTACATTCA TAAACTTCCT CACCTTTCCG TAAGCATTTC CGAAGCCAGA GGAGAAATGG

TGCTAATGTC AGGAGGGAGA GTCCAGCAGC AGAAAGTCCA GCTACCAAGG GAATGTTGGA CTCAGTGGGA

GCTAAGGAAG TAAGAGACGA AGAAAGGTCA TGAGGAAGAA TTGATGTTAA AGTCTCTCCG TCCTGTCCCT

TTGGCCTTTT TTCTGTACAT TCATTACTAG GAGCAGAAGA GCTATCTAGT TTAATACAAG AAGCAGAGAT

GTGGCATTAC AGGCCTTTGA GATCTGCTCC AAGCCACCTT TGAAGCTATT CCACCATTG GCAGGCAGAA

CTCTAACTTG CCAAGCTCGT TCACAATACC ACACCACACC TTGGTTAATA AACACTGCAC TTGCTTGCTC

TCTTGCTCTC ACTCCCTCTT GTTTTCCATT TCCCCTTTCT CCTCTCCTCT CTCTGTCTCC TTTTTCCAGT

TGTCAGAATT CTACCCTTTC CATCAACATG CAACTTCTGT TTTTTCTCTA TCCCCATACA ACTTAATATT

CACAACTTGT CAACCTGGGC GAACTTTCTG GTTTGGATAT AATGAATAGT TGATTACTGT AACAAGATAG

CTCCCCCTTT TTCTTTTTAA TCACCAGACA ACCACCATCA ATCAATGCAT CACCTTCACA GGTAGGTAGC

AGGCCAGACC AGTGTCCTGT GGCTCCACAT GTCCGAGCTG CAGAGCCATT GAGCGTCCAT CCTTCAGGAC

AGGCGAACTT GCACACAGTG CCAAACACGG GCTCCCCACT GCAGCTCATG TTGATCTTTC CCGGAACTGC

CAGGCTTGAA CATTTTACCA CTGCAAATGT TAGGTACACA GGCAGAGTTT CAGAAAAATC TACTGGAAAA
```

```
CTTCCAAAAC TTGCTTAAAA GTCAACAATG AATGTAAAGT GTAAGCGCTA CTTAGTTTTC AGCATGTAGG
AAATTAGGAC CAAACCCCTT TGGGGCAATC TAGGTTCAGA AACTTTATGA AGTATTTGAC CTGTACCCTA
AAAAAGTCTG CACTCAATTC TACCTTGGCA GGAAGGAACC TCTTCTGTCC ATTGTCCCTG AGATGTGCAC
TCAAGTTGAG TTGATCCATG TAATTCAAAT CCCTCCTCAC AGCTGAAGGC ACAAGAGGAC TTGTAGGTGA
ATTCTCCAAT AGGGGAATGA GCACACCTCA CCAAACCCTT CGGGGGCTGG TGGACAGCAT CGCATCTCAC
AGCTGGAACA CACGAGAGAG CACTTTAGAA GTTTGTTTGC ATCTCCAGCA ATACGTTTCC CAAGGTAACC
AAGTTCCCAA GCTCTTCAAT AGTTCTTTTT ATCTTAAAAT AAAATAAAAA CAAAGACTGT ACCTTCACAT
GTGGGCTTCT CGTTGTCCCA CTCCCCTGTG GGGCCACATT GGAGCCTTTT GGATCCCTTC AACACAAAAC
CCTGCTCACA GGAGAACTCA CAGCTGGACC CATAACGGAA ACTGCCAGAA GCACTAGGAA GACAATTCAT
GTAGCCTCGC TCGGGGTTGG ACAAGGCTGT GCACTGGAAA GCTGAGACAT CAAAATGATG GTCAGAAAAT
ATTGCAGTGG AACTAGAGAG TACTTGGCGT TGTTGAGTG AACCCAGTTC ATTCAAGCAA CACTTGGAGA
ACTGAAGATT CTTTATAATT CCCTGGACAA ATGGGAAGAT GGCTGTGTTT TCTTTGAATT CAGCCCCCT
CACTGATCAT GGCACTAATT AAAAGACTAA TTAATCAGAA CATTAGTTCC TGAGCACTGT TCTTCTAACA
CACAAAATAA ATTATGGTCC AAGGAAAGAT TTCACGCAGT CTGAGGACAA CATATGGGTC ATGGATGTTT
ATAGATGGTG CCAAAAAGAA AGAAAAGAAA GCACCCCTAT AAAATTTGTC TGTTTTGCAG TTTGGTTTTT
GTGTTATGTT TTGCTACTGG AAATCATTCT GTGCTGGCTT TGGCTAGGAC AAGGCCAGTG CCTGATAGTA
AAAACTGCTT GTTTTCAATA TCCTTGCTCT CACTTTAAAG TGAATTAAAA TTTACTGCTT ATATATGCAT
CAATACTATC TCTGTAGCTG ACACCATGCT TGAAACAGTC TCATCACTGC TAATTATGAG CCATTTCAGA
AGACAGGTGT GATGAGAGTT TTACATTCAA ATCATGTTCT CATTATTCTG CTTTCCGAAT TTTCTAATAT
GATTCCTTTA GATTAAGAAT TCTGTCTATT CCATGCTAAT GTCTACAAAG TTTTATCAGC ACATCACAGT
TAAAAAAAAA CAGCAAAGAA TTCATTCTTA ACACATATGA TCCTTTCCCT GGCCAAACAT TAGTTCTTTT
AAATGAATCT CAAAGATACG AGGGTTGCTC ATCAAATCTG ATTTCTATAG TTAAAGTGGG TATTGGTTTT
TTTTTTCACT GTCCAAGTTT GAAGATGGTT GTTCTTTAAG AAAGTATAAA TCGAAGGATC TCAAGCTTAC
CTTCACAAAC TGGGATTTGC TGTGTCCACT GCCCTTGAGT GGTGCATTCA ACCTGGGCTG GTCCCTGCAA
CATGAAGCCT TCCTCACAGG TGAAGTTGCA GGATGATTTG AAGGTGAACT CTCCAGCAGG GGAATGGCTG
CACCTCACAG AGCCATTCTG AGGCTGGCGG ACGCCCTGC ATGTCACAGC TGTAACAAAT ATACGCATTG
ATATTAGCAC GGCCTAGAAT TAGCTTGCCC ATTTCCAGTA TGGGTTGAGA GAAAGAATGT TCACAGTAAG
TCTCCATGTG GAACAACTCT ACCTTTACAC GTTGGCTTCT CGTTGTCCCA ATTCCCAGAT GAGGTACACT
GAAGGCTCTG GGCTCCCATT AGTTCAAATC CTTCTTCACA GTCAAATGTA CAGGTTGTGT TCCATGGGAA
GCTTCCAGGG TTTTGAAAAC ATTCCACGAA CCCATTGGCT GGATTGTCA CAGCATCACA CTCAACCACT
GAGGATTTTA AAGAGCACCA TGAATTTTAC AGAAGAATGA TCTTTTCACT TCCTATTGAG CTGGGTGCCT
AACAGAGTGA GGAAGCTGCC TTCAAAGGGT AGATCCCAAA GTCCTATGTC AATTCTTAGG GACATGCACA
GCCAGAATAA AAGCTTTTAT TCTTTTTCAT GGATATTCTA TCTTTTCTGA TTTCCACTTT GCCTATGCTG
AGTGGTCTCT AATCTATGTT ATCATTTACG TGAGGTAAAA ATTTAAAAAA AATAGATTCC AGATTAGGAG
TTATGACTAG TACTGACATA CGTAGGCTAT TCATTTATTT TAGCCCATCA GAGCCTGAAG AACTGATTTT
TCTTTTTTTG GCCTCTGGTT CAGAAAGATA AAATTAAGAG AGAAAAGAG ATACTAAGAC TGCTTGACTA
TCATGGTCTT AAGTTAGTCC CATGGCTTGG AAAAGTAAA CAGGGAAACA AGATGAGAAA TCCATTGAGA
TTTCTAGAGC TTTATTGTTT TATGGTCTCC CTTACAAATC ACCAGAGCCT CAGAAACACC CATTTCAAGC
ATAGAATAAA AAACCTCTC TCAACCCAAG CAGGTACTGG GTTGGCAATA TACATTGGCT GAGAGAACAA
ATTGTATTAA AAACAAAAAC AAAAAAAAAA CTTTCCCTGA AGTTTTGAAA ATGTAAGTTG AATCAAAAAA
```

-continued

```
CAGAAGCAAT GAGGGATGAG TTACAGAACG TTCTGTGCAT TCTCAGAGGG ATTTACCATT GCAGGCTGGA
ATAGGAGCAC TCCATTCTCC AGAGGACATA CACTGCATGG TCTCCATGCT GCTTGGCAGG TAACCCCTAT
CACAGCTGAT AGAGCAGGAA GAATTGTAGC TGAAGTTTCC CAGTGGGTGA CTGCAAACCA GGCTTCCATG
CTCAGGGGAT TCCAGGGCTG TACAGTTCAC AACTGAAAAA GAAACCCAAA TCAGTTCTGC TCATCTCTCA
CCTTTAACAG ATAAGAACAC TGGAAACTAG AACTACAGTT TGGTTTTTTT TTTTTTTAGT TTAAAAATTT
ATAAAATTTC TAATGGAATT TGTAAAATTG ACTGTAATTC TACCCCTTTT CTTTTATTCA AGAAAATGCT
GATCCATAAC AACAACAACA AAAAAGCAGT GATGACAACC ATAAAAAAGA AATATTGAGT GATATGGGGA
GAGTAGTGTA ATTGTGTTTA CCTCAAAACT GTTCAAATTA TATGAACAAA CACAGCAAAC TTAGGTACCA
CAACAAATTT CTTGTTACTT TTCTCACAAC TGCTAAAAAT ACTACAGTAA GCTTCCAACC AGGATGAGAA
CCATTCACAA AGCTATATTT CAAATTTAAG TACTAGAATA CATTACAAAT TTTAAAACCC TAATGCTGCA
CTGTCTACTA TAGTAGCCAC TATCTGTGTG GCTACTCAAA TTTAAACTTG AATTCGTTGA AATCAAATAA
CATTTAAAAT TCAGTTCCTC AGTGTCACCA GCCACATTTC AAGTACTCAA TAACCACATG TGGCTCATAG
GTACACACTG GAAAACACAG CTATGGAACA TTTCCATTAT CACAAAAGCT CTACTGCACA ACGCTGTGCT
AAGGAATCTT GGAGAGAAGC TCATCTAACT CTCTTAATGT ACAAATTTAG GAACTGAGAC CTCATTTCAT
TCAAGTGACT TGCTCCATGC TACACGGCTA GTCATTACAG AGCCAGAGGC CAGAGCATGA ACCAAGATAC
CCTGGACTCT GTAACTCACT CATTTCTACT GCAACGTCTT GTTACCACCT AGATGAGGTG AGTACATGTT
CCTCGCAGGG ACACAGAATT ACAGTTTATT GAATGTGTCC TGTGTGCCAG GCACCATGTA ACCATGAGCC
TATGAAGTTC ACACTATTAT TATCCTCATT TTACAATGAG AAAACTGACA TAGAGAGTTA AACTATCTTG
TCAAGGTGCC AAAATAAATA ACGGGTGAAT CTAGGACTCA AACCCAGCAG GGTCTGACTT CATAGTCTCA
GCTCACGATC ACCATATGAC ACCATCTGCA CCAGGGAAGG GAAGGCATGC AGACCTGACT CTAATGCCAG
CTAGGACGTG AGATGGTGCT ACCATCTCAA GTGAAGAAAG AGGCAAGAAC CAGACTTACT TTGCTCACAC
TTGAGTCCAC TGAAGCCAGG GTCACACTTG CAAGTGTAAT TATTGATGGT CTCTACACAT TCACCGTGGC
CACTGCAGGA TGTATTGGTA CAGGCAGCTA CGGAAAATAC AAAGCATGAT GAGGAGGACT ATTACTGTGC
TTATACTGAG TGCCTTTGAT TTTAGAATCA ACAGTGTGCA ACAGAGACAT CAGCAGTCCT ACAGAGTGCC
ATAGACTTTA ACTGAAGTGT TTTACAAAGT TCCAAATCTG AGTTTCAGGC CCACCTATCC TAAACCTTGA
TGCTAATGTA TAGCTGTGGC TGGCACCTAC CGTAGAAAAT TTACTTCTTC ACAAACTCTG AAGACAGTTC
CCCTACCACA AATAAACAAG TAATTAAAAT ATGTATTGTG TGTGTGCATT TTTATATGTA AAGAACTACA
TATTTGCCTA CAGTATTTAT ATATATTTTA TATATATACA TACACACATA TATGTGTGTA TATGTGTGTA
TGTATATATA TAAAATGTAT ATAAATGCTG TAGGCTATAT ATATATACAC ACACACATAT ATGTGTGTGT
GTATATATGT GTGTGTGTGT ATATATATAC ATATCCACAT ATTCTTGCCC ACATTCACAC AAAACAGCAA
AAGAGAGAAA CTTTAGCAGT TAAACAGAAT CTTTTGGAAC ATAAAATGAC CACAATAGAG AGCAGTTTTT
GCATGCTGTA AATTTGCCAA GATGCCCACA CACTGAAACT ACCTCCCACT GCTGCCGCAA ACTCCCTACC
TGTGTAGCAT AGGGCAAGCT TCTTCTTGCT GCACCTCTCA TCATTCCACA TGCCCACATC TTTTTCTCTC
TTGATGTAGA TCTCCACGCA GTCCTCATCT TTTTGCCTAT TGTTGGGTTC ACCTGGAGCC CAGTTCTTGG
CTTCTTCTGT CAGAGGTTTC TGGGTTCCTA CCCAGACCCA CACATTGTTG ACTTTCTGA TTCCAATCCA
GTAATAACTT GGTGAATAGC TCAATATGGA GTTAGGTAC TCAATCTCTT CTTTGTTTTG AATTGCAACC
AGGTGTGTGT ACCTTTGCTG ACAATAAGCA CTGGCCTCAT CATAAGTCAT AGCTTCCGTG GAGGTGTTGT
AAGACCAGGC TCCACTCTCT TTAATGAGAA GCACTAGTGG GAGAAAAAGA AAAGAAATGG TAGAGTTTGG
TACTGTTGTG GTTTAACTCT GACAACTGTG CTTTTTATTG TCTTATTTTT GGCAATGTTT GTGACATGGC
```

```
CCAGACTTTT CTCATCTTTT CAAAAGTAAG AAGTACGTAT GAAGAAACAG CGACTTATTG TTTATCTCTT

TTGTGACTGC CACCCACTAG GTACCTTATC CACACTCACT CACAACATTA TAGTATACCC ATTTTGTAGT

AGAATAATAA TCAGAATAAC TAAGCTTTAT TGAGCACTTA GTATGCACCA AGAAGCACTG TATGAGGTAC

TTTCCATGAA CCATGCTATT GAATCCTCAC AATGCATCTG GGAAATAGGT CATTATGATC CACACTTTAC

ACTTAAGGAA AGGGAGACAC CAAGAGGTAA AGTAAATGAC CCCAAGCCCA GGGAAGAACA CATTGCAGGT

AGAGGTCAAG GATGCTGCCA GATATCCTGT GCAGGACAGC CCCAGACAAG CAAGGATATT TCAGTCTGAA

ATATCTATAG TGCGAGAATG AGAAATCTTG GTCTAATGGC ACTGACTTAC CCAAAGTGAG AGCTGAGAGA

AACTGTGAAG CAATCATGAC TTCAAGAGTT CTTTTCACCC AAAGGTTTAG GCTTGAAATA CTTTCCTGGG

GAGATAAAAC ACAAAATGAA TTAAAGAAGG AAATCGTGGG TAGCTAGTTA CATTATTCTA CCATGATGTT

TAAGGCAGCA TCCTAAGATT TTGGGCAAAG GACACTAGTG CAATAATCTT TATTTCAGAG TTTAATCAAA

TAAATAAACA AATTTTAAGA CTTTCATTAT TTAGGTCAAA GAGAAAGAC AGGTTTTAGC TACAATACAA

TAAGAGCTTG TACAGATGTG GTTTTTATTA GAAGGCCTTT TGCATATCTG TGTTTCATGG CCCGAGGCTG

CCCTTATAAA GCGTTCTGCA CTTACCGTTT TGGGAAGCAG TTGTTCAAAC ACAGGATCTC TCAGGTGGGT

ATCACTGCTG CCTCTGTCTC AGGTCAGTAT AGGAGTTTTG ATGTGAAGTC AGCCAAGAAC AGCTGAACAC

TACTTCGGCT GAGGCCCTTT TATAGGAGGG ATTGCTTCCT GTGAATAATA GGAGGATATT GTCCACATCC

AGTAAAGAGG AAATCCCCAA TGGCATCCAA AAACTTTCCC GGGAATATCC ACGATGCTTA AAATTACAAT

GATGTCAGAA ACTCTGTCTC TTGAAGCTAC TTCACCTTTG TCCATGCCTT TATATCGTAT ATGCAATTTT

ATTAATATGA CAAAAATGCA TGATTTTTAA TTATAATAAC ATAAAGTCTA TGTCTTTAAA AAGTTGTAAA

ACTTTGCTTG TTAGTAGTGT CTCTCATGTA GTTGTGGTAG TAATTAGAAT TTCAGAAACA GAAGGAAACC

AAGAATAGGT TTGTCATCCA TAGTCTACTA CCTTCAATTT CTCATTCATA GCTGTGGATA ACCAATCACT

ACTCATTTTT TCTTCCTTTT TCACCTGCCA ATTCAACATA TTTAACATGC ACTGTCTCAC AGAGGAATGA

CTCACAAGGT AGATATTAAT CTTCAGATTT TGCACGGCAG TTATGCCTAA ATTAAAATAT TATCTAAAAA

TAATATCTAA CACTCAAATG GTTAAAATAA TGCCTTATTT TAAAAAAAGA AAAATGGGAA ATAGATATTT

ACATCTGGGA AAGTTTCATG GTTTGTTCAG TGAAAAAAAT AAAAAGGAGG CCAGGCACAG TGGCTCACGC

CTGTAATCCC ACCACTTTGG GAGGCCGAGG CAGGCGGATC ACCTGAGGCC GGGAGTTCAA GACCAGCCTG

ACCAACATGG AGAAACGCCA TCTCTACTAA AAATACAAAA TTAGCTGGGC ATGGTGGCGC ATGCCTGTAA

TCCCAGCTAC TCGGGAGGCT GAGGCAGGAG AATCGCTTGA ACCCGGGAAG TGGAGGTTGC AGTGAGCCAA

GATCACGCCA GTGCACTCCA GCCTGGGAAA CGAGTGAAAC TCTGTCTTAA AAAAAAAAA AAAAAAGAA

AGAAAAGAA AAAAAATAAA ACGGAAAACT ATATATATAT ATTTAATTGG TCAAAATTTT GTTTAAAATT

TTTGAAATGT TAATGTGCAA AGAATAAAAA TTCTTCCACA ATGTTAACAG TGACTAACTC TGGATGGCAG

GATTTGGGAT AAAAATTATA TCCTTCATTA TTATTTTCAG GATTTTAAAG TTTTTTTCAA TTTCCCTTTT

TTTCACCTTT ATAGTAACAA GAATACAGTT TAAAGAAACT TGTCTCTAGG CCAGGCATGA TGGCTCATGC

CTGTAATCCC AGCACTTTGG GAGGCTGAGG TGGGTGGATC ACCTGAGGTC AGGAGTTCCA GACCAGCGTG

GCCAATATGG TGAAACCCTG TCTCTACTAA AAATACAAAA ATTAGCCGGG GTGTAGTGGC GCATGCCTGT

AATCCCAGCT ACTGGGGAGC CTGATGCAAG AGAATCGCTT GAACCCAGGA GGCAGAGGTT GCAGTGAGCT

GAAATCACAC CATTGCACTC CAGCCTGGGC GACAGAGCAA GACTCCATCT CAAAAAAAAA GAAAAAAGA

AAAGAAAAG AAAAGAAATT TGTTTCCAAA TGCAACAGAA GGAGATGTAT GTGGTATCCT ATATTCCTGC

TCTTCATTTT GACATTTCTT CTGGGTGATT GTATACATTC CCCATCTCTG CATCTTACCC TATCTAAATG

ATGGTAACAG TAAATGGGGA TCATTTTAAT TTCCATATTC TGTAGGTTTT CAGAGCTCAA GTCAAGCTAA

TATTCTATAT CTACAGCCTT TCAAAATAGG AGGTCTATCT AAAAATGTAC TGTCAGCAGA CCTGAACGAG
```

```
TAGTGGTAAA AGCCTCGTTT TTCTCTTTAC TTGTTAGCAC TGGTCTTTCT GTGTTCATAA AGATGTCAAG

ACCCAAAAAA AAAACAAGAA AAGAGAAGAA AAATTCCAAA AAAGACAACT GATTAGAAAA AAATAACTTA

ATTAACGAAT TTAATTCAAC CCCTATCAAA AAGCATAGAA TTTATTCCCT CCACCTTACC ACTCTCTTAC

ATGATCCAGA TACTGACATT ATTCCAATTC TTTATCCCAC TTTACTTAGC TCAATGTGGT TGTTGCTTCA

ATAAATTCAG AAGAGTAATC ACTCATATAG TGTTTATTTA GATTTTAGGG CAGAATGTCA AGTTGGGTTA

ATACATTATC TGTATGTATT TTATTTTTAA TAAAGTATGA ATACATAATC TGCTATTTTT AAAAAGCATG

GTCAAATGTA TAGAGTAGCC AAATCTTAAA AAACAATTTA TCTTCGATAT CAATAAAGTA CCTAATAATT

ATATTGCTAA TAGAAATTAG TCGTTAACAT CCCTAGATAA CTAACTTTAT TATTGCGAAT TTTTCATAAC

TAAGTTTATA GTTTATCTCT TCCCCTTTTT AAAATTAGTT CAAAGATATC TAAAAATAGC CCCAGTGGTG

ATGAAGTTTC TATTTTACTT ACATATATAT GTCCTGGACC CCCAATTATA ATCTCTAACA TTTATTGAGT

GCTTACTATG TGCCAGGCCA TATTCTGAGC ATTTTGTATG TTCACCTATT GATTATTCAA TCCGTACAAC

AGCCTATGAA ATAGGTACTC CTATTATCCC CATTTTACAG ATGAGGAAAT TGAGAATCTG GGGATTTTAT

CTCATTCAAA AGCACAGAGC TAAGGGTTGA ACCAGGCAG TTGATATCCA GAGCCCACTC CCTTACCTGC

TACTCCAAAC CATGATTTCT TTTGTTGTTA TGCCCCGAGA TTCCTTGTTC TACCCAAGTT TCCTGTACTC

TTCTTGCCCT CTTCTTCCTG AGACATCCTT GACCATCACA GCTCTCCACT GAGATAACTG TGTCCTGGGT

TCTGAGACAT GGGGGCTGGA AGGGACCCCA GGGACAGTGA GCAGTAGGGA GAGGATGCAG TGAGAACAGA

CCCTGGATCC CCGGTGCATA GGCAGGGAGA AAGTGGACAA AGGAAAAAAC AAGCAAGGCA GGTGGAGCCA

TGCCTAGGTA AAGTTGATCC CTAAGCCACA GTTCCCAGAA GTTCCTGATT CAAAAGCAAA TTTTCTCTAA

GGTCAAAGGG CAAACTGATT ATTCTAAATT CTAAACTGAT TATTTCTAAA TTGAGAAAGC TTCAGGGAGA

GATCCCAATA TTCGAAGGAT AAGAGAAATG AGGAGTGGAA GAGATAGGTG AGTAACAGTA ACTTAAATGT

AGACTATATA TAATATATAA TATATGTAGA GTATATATAT ATAATTACAA TATATTATAT ATGTGGAATA

TATATATTAT TTATATATAT TTATATATTT TATATATATA GATATTTTTA TATTTTATAT ATAAATATAG

ATATTTTTAT ATTTTATATA TAAATATAGA TATTTTTATA TATATTATAT ATAAATATAT GTAAAATACT

GTGAAAGAAG AATAGAATCT TGAGACCTCA AATTCACTAT GCCAAAGGGA AAGTTAAGCT TGGGAAATGA

GTCATGCAAA AACTGCCTTC CTTTTGTTCC CAAATACCTG TAATTTCACA TGCTTACTTT ATCTTATATA

AAATGTAGAT GTACTGAGCA TGAGATCCAT GCATAATTTC CCTCTAGTCC CTTCTTTTTA CATGTAAAGT

GTAGACTCAC TGAGTGTTAC AGAGCCTTGC CACAATGTAA ACACTTGTCT CATTGCCAAC CCATCTTTCG

TTTATTTTCT TCCCCTCCTG CTTGCTCTTT CCCCTCTAAA GATGGAAGTT CCCAAAACTC TCTTTGGAAA

AAGCGCAGGT CACAGATCCT ACAGTGATTT GTGTTTCTTT TACCTGGGAC AAAATAAACC TCTAATCTGT

TGAGATATGC TTCAGTTACT TTTTGGTTTA CAATATGTAC ATGTATGTAT ATAATTTATA TGTATATAAT

ATATGTACTT GTTTTAACCA GAGGTATGTT ATTCAAAATC CATTCATCCT ACAATTACC TGCATTCTCC

CACAGTATTT TCTGTGTCCC TGCCCCCGAG GTTGTCACTG CAAATCAGGT ACATGGATAC TGGGAGCTGA

TGGGCTCCCC TCTGGCTACC TGGGCTGCTG AAGGGGCCAT AGACAGACCC AGCTTTCCTC TCGTGGAGAG

GCCCTGGGCC AGCGCTGCGT GGGAGTGGGA TTACAACCAG ACTATAGCTT CTTCACCTGC TTTTTCCTAT

CAGGATTTCA TAAGAGGCAA TTGCTTGTTT TTTGAGGGTG GGGCAAATC AGGGGAGTT GAAGAGGAAA

TTGGGTAAGA TTTGAATAGT TGGGCATGTT GAATATTATG AATATCATCT CCCTCTTCAA ATAATCCAAA

ATATACCCCC AAGAAACAGG CTGATTAGAG GTGCTTCAAG GCTCCACTGA ATCTCCCAAG CTCTGAAGAT

GTAGCTAGCT GTTACCGGAT TGCCGGTTTT CAAGCCTCGC CTCACATGGA CCCTCTTGGC AGTTTTTCGC

ATGGGGAAG CATCCGCTAC ATAGATGGGA ATGAAAAGAG GAAAGAAGAC GGTGCAAACT CAGGCACACC
```

-continued

```
CCGGTGTCTG CCACCAGTGC TATTTAATCT CTGAGGTGTC ACCCTTCCTG GCTTTATTGT CTCTTCCTGG

AAGTCTCTTG TCCTCTCCTC CACACCCTTT AATCAGGCAT CAAAGACTTT AACCAGTTTT GCTGTGTGCC

CAGGCCCACT CATTCTCACT TTTATGGCAA AGGGAGTGGG AGACAGAGAG ATAGCCAGAA AGAAGAGATT

GGGGACCCCA AGACAAATGT TAGAATTTTA ACCAAGGCCA CCCTGTGGAC AGGAGATTAT TGGGTTTAGT

GGAAAGCAGC ACTGGCCACA ACCACACGTG GCAAAAGCAT CTATCGAGGA GTGAAGTTAT ATTTGGTGAA

TGTGACCGGG AAGCAGGGGC AGTGGTGTCC TCCTGCCTTC CTGAGGCACT CTGTTCCCTT ACCTCTGCGA

AGGCTTATTT TACCCCTGAG TGCTTAGTTT TGAAAGCCTT AGTTCCCTCT CTCCCATAAA AAAGCTCTAC

TCTGCTAACA TCTAAGTTAC CTTTGCAGAG TCTTAGGTAG AGGGAGGAAA TCCCAATAAA GATTCCACCC

TATCTGCAAA ATACAAACAT GGTATTTCTT GCATTCCCAA AATTGTGAAA GAAAATGTGT ATCACCACAG

TAGAGAATGG CATTTTTTGT TTGATCAAAA CCTAAATATA TTTGATGAAA ATGTGTCTGG TTCTAAGTTT

ATTTCCCAGA AAGCCATGTT TACTCACTTG GAATTTATAG ACATCTTATA ATATCTGAGT CGAGTAGGAG

CTCCGGGCTC TACCTCACTC TTTTCTCCCA CACCCAGGGG GAAGTGTAGG GTTCTCGAC TTTAGAATAA

AGAGGAATCA CCTGGACAAC TCACCTAAAA TGCACATCTT CAGGTCTCAT ACTCAGAGGC TCTGACTCAA

CAGGTCTGGG TGGCGCCCAA GAATTTGGGC TTTAAATGAG TATCTCAGAT GATTCTAATA CAGAATGTGT

AAGATGACCA GATCCTATCA CACTTAGATG TATTGGCCTA GGGCCACCTA ACTTGGAGAA AATGTTAGTA

AGACCCCGTG GTTGGTGCTC AGCTATAGGT ACCAGAATTT TGATCAAAAT TTACTATCAT TGTGACACTT

CTCTTCGGAA CTGGAAGGCC AGAACCCCAC TTGTAAAGTG CTGGGAAAAT ACAAGGAAAA TTTAGGGTGA

GTAGCATTTT GAATTCTTAC ACATGGAAAG TAAATGTATA AGAATTCTTA CCAATAAAAA AAAAGCAAGA

GAGAATAGCT GCTAAAGAAT TAACACAAAT ATGTATATAT TAGTTATTCT CTTTTCTCCT CTGATTCCAG

AGGACTTTGT AATTCCACTA ATTCTTCTTG AGCTTCCAGG ATGATCTGAG ACTTGAATTT TTCATGTGCT

TTTTGCTTCC TATTTGGCAG CATCTTATCT TGAAGTTTCC GCTTTCTGCT TGGGGACCTA AAAACTAACT

AATGGGAATT TCTTCAAAAT GAGCAAACTC TGGTGAATTC CCAAAGCGGA AGAAACAAGT GAGGATCGGG

CTGGTTAATT AAGAGAACTT TTCCTGAATG TAGCCAGACT GTTTGCCGAC TGTTGTTAAC ATGAGGGAAG

AAATACCCCT GGATTTTAGA AGAGCCCCTT GTTTGTTTTC CTTGGCCATT TGTGCTGCTT GTTTTGTAAG

TCAGAAATTT CCTGAAGGAC TATTATTAGC TTTGTTCTCA CGTCAGAAAA CTTCTGCTCT GGCCACTTTT

AAACATATAA CTTGGATTTT ACTGTATTAG AAAATGTAAC AATTACAGAC AGCACTAAAA GGACACCAAA

GGGCAAAGAA AATGGGTAAC TTTTTTTTCT TCCCCAAATC TAAAATAGGT GATTTTGGAG AAGTAGGAGA

AAAACCTGGA TTTTCTAGAT CTCTTTAGAG CTCAACAACT GATATAGTTA ATTATGTAAG TCTTTGATAT

TTGGAAATGA TTGGATTAAC CGGATAACAA TGAATATTTA AATACAGTGA TTTGGCCAGG AGCAGTGGCT

CATGCCTGTA ATCCCAGCAT TTGGGGAGGC TGAGGCGGGT GGATCACCTA AGGCCGGAG TTCCAGACCA

GCCTGGCCAA CATGGTGAAA CCCCATCTCT ACTAAAAATA CAAAATTAGC CAGGCGTGGT GGTGCAAGAC

TGTAATCCCA GCAACTCGGG AGGCTGAGGC AGGAGAATTG CTTGAACCCG GGAGGCAGAG GTTGCAGTGA

GCCAAGATCA CGCCATTGCA CTCCAGCCTG GGCAACAAGA GCGAAATTCC ATCTCAATAA ATAAATAAAT

AAATACAGTG ATTTAACACA AGAGATTTCT ATTTCACACT AATGAGCTCT GTCACTGGGG CAAGCTTCTT

TGCCTCATTA AGTCTCAGAT TTCCCGAGAG CTTATTTATT TATACCAAGA GTGCTTTACT ACCGTCTCTG

CTAGCTGTGA CATAATATGA CAAAAGGTAT AAATATGGGA AAAGGCACTA ATTTATATCA AAGCGTTCTT

CGTTTTTCCT TGCTGTGAAG TTTTTAGCTA ATAATTCATA AGAATATACC ATATTTGAG TGTTTACTAT

GCATGGGCCT GGCACTTCAC ATACATTGCT TCTTACAAAT TTTACAAAGT GAAAGGTAGA TATTAATCTC

ATTTTATGGA GGACAAGATA GAGATCTGGA GAGGTTACAT AACTTGCCAG TGTTTTTTCA GTTAATAAAT

GGTAGGGTGG AGATTCAATC TGTGTTACTC TAAAGTCCGT GTCCTTTTTA TTGGCTCCAT GCCTACTCAG
```

```
ATTTAAATCT CAGCAGGGAA GTAAACCTTA GTTTTTACAT GAGAAAATGT TACAGCAGCC TTCTCGGCTT

CCTTTACCCC CATCCCAGTT TCACGAGCTT AGTGCCTTAG ATCGGGTTCC TTTAGAAGCA GACCTCGAAA

TAAGGATGTG GGTGCCAGTC ATTTATTGAA AAGATGATCC CAAGAAAGCC TAGTAGGAGA GTGAGGAAGT

GAGATGGGGA AAGGAAGAAA CTCCACAAGA AGTGTGTTAA TAAGCAGGTT ACCGCTGTGG GCAGCCATGG

GGCTCAGCTG CACTAACAAA CTCTGTCTAG TACAGAAAAC CTCAGGGTCT CCCCAAGGAG GGGCAAGAAG

TCTGCCTAGG GTATATATCC GCCAACTCAG TCACTGGCTG AGAGCTGATC CTGGGAGGGC ATGGTTAATT

CCTCTGCACT TTCAAGTGGA TTCCTGTGGT CAGAAAAAGC CCTCTACAAT GAATTCCAGA TGCTTGTATT

TAAATCTGAC ATGATCTGAA TGCTGTGTTG GGACAGGGTG GGCGTTATTA GTTTTCTGTC ATTACTGTAA

CAGATTACTA CAAACCTGAT GGCTGCAAAC AACACATATT TATTATGTCA TAGTTTGTGT GGGTCAGAAG

TACAGGTTAG CTCAACTAGT TTCTCTGCTC TAGGTTTCAC ATTGCCAATA TCAAGGTGTC ATCCAGTTGG

GCTCTTCTTG GGAGGCTTGG GGATGAATCC ACTTTCAAGC TCATTCAGAT TGTTGGCAGA ATCCAGTTCC

TTGTGGTTGC AGGACCAAGG TCCCTGTTGC CTTGCTGGCT GTTGGCCAGG AGTCATTCTT AGCTTCTAGA

GACTACCTGT ACTCTCTGAC TCGTGTCTCC ACTTCACCTT TCAAACCAGC AGCGGCTAGT CGAGTCCCTC

TCTTCAAATG TCTCCAACTG TGCCTTCACC TCATTTCTCC TCTGTGTACC ATGTCTGCCT CTACTGCTTG

TAAGGGCTCA TGGGATTACA TTGGATTTAT TCAATCCAGG ATAATCTCCA TATTTTAAGG CTAGCTGACT

AGTGATCTTA ATTCCATCTA CAAAGTCCCT TCCAATAGTA CTGTATTAGT CCATTTTCAT GCTACTGATA

AAGACATACC CAAGACTGGG CAATTCACAA AAGAAAGAGG TTTAATTAGA TTTACAGTTC CACATGGCTG

GGGAAGCCTC ACAATCATGG CAGAAGTCAA GGAAGAGCAA GTCATGTCTT ACATAGATGG CAGCAGGCAA

AGAGAGAGAG CTTGTGCAGG GAACTCCTCT TTTTAAAACC ATCAGATCTC ATAATACTTA TTCACTATCA

CAAGAACAGC ATGGGAAAGT CTTGCCCCCA TGATTCAATT ACTCCCACCA GGTCCCTCCC ACAACATGCA

GGAATTCAAG ATGAGATTTG TGTGGGGACA CAGCCAAACC ATATCAAGTA CCTAGATTCA TGTTTGATTA

AACAACCAGG GAGCAGAAAT CTTCAGGAGT GGGGGGCATC TTTAGAATTC TGCCCACCAA GGCTGGGCGC

GGTGGCTCAC ACCTGTAATC CCAGCACTTT GGGAGGCCAA GGTGGGTGGA TCATGAGGTC AAGAGATCGA

GACCACCCTG GCCATGGTGA AACCCCATTT CTACTAAAAA TACAAAAATT AGCCAGGTAT GGTGGTGGGC

ACCTGTAGTC CCAGCTACTC AGGAGGCTGA GGTAGGAGAA TCACTTGAAC CCAGGAAGCG GAGGTTGCAG

TGAGCCAAGA TTGCGCCGCT GCACTCCAGC CTGGGAGACA GAGCAAGACT GTCTCAAAAA AAAAGAATTC

TGCCCATCAT AGTAGGCTGT CCTACAGAGA CATAACCCAG GAATTAGGTG AATGGCTAAC CTAAATTAGC

ACTGTGATGT GTTTTCTGAC TTGGTCCTTA TAGCTCCTCT GCTTAGATGT GGAACTAATC CATGAATGCA

AGGGTTTGTC TAGAGTTTTA AGTGGGAGTT AAATATCCAA AGTACAGGAG ATATTATGGG TGCCTCATCC

ATGTCCCCTT GGCATTTATC TTTCTTGGAT AACCCAACTC TATTAGTTTT TATATCTCAC TTGTTCCTAT

ACTCTGTGAA CTGATGTCCC ATAAATAGAC ATTTCATTTT GCCAGTCTTC TTGAACAATA ATTACGATTA

TTAATCTAGC AGTTATCATT AATTGGCCAC TTCACATTAG ACACAGCACT TAGGACTTAA GAATACCATG

TCATTTGATC ATCATAATAT GGTCAGGAAT TAAGTATTGC TATCCAAATT TTACAAAGAA GGCACTGAGG

GTTAGAGTTT AAATAACTTG CTTAAGATGT CATAGCCTGT AAGTGACAAA ACTAGGACTC AAATACAGGT

CCATCTGACT CCAAAGTCTA TGTTCTTGGC TACCACACTG CCTCTCCTAC AAGTGACCTG TGGTTTTACT

ACTATATTCA CACTCTACTA ACTTTACCAT CTCCCATGAG TCTGTCTAGA GGAGGGCACA CACAGCACAG

AAAACACATG AATGCAAAAT AAGGAAGGGC CTACTTACTA CACAGAGCCA TTCTAATACC TGATGTTTGC

TCTAATCCAG TTTTACTATT AATTAGTTGC TGGTGCCCAA GTTTTTACTG AGAAATGGGG ATAATTTTGG

AAGTCATAAT GATGCCTTCT TCTCATAGGG TATTTTATTT GTTGTTGTAT CTCCAGGCCC CAACACAGCC
```

```
TGGCTTTTAG TAAATGATCA AAAATACCTG TTGAATGAAT AAATGGAGTC ACCTGAAACA TGTTAAACAT
TTGTTCATGT GTCCTAATCG TGGATTTCAG GATAGTAAGC ATCCTAAAAG GAAAGCATGC ACACTGTTCT
TGCTACATTA ATTTCTCACA ATATAAAAAA AGAAAAGCAT CTGAAAAAAG CTGCCAGCCG CTGTGTCTCC
TAATATCAAA CTGAGCACAG ATATGGAGAA GCTAAGGGAG AGGGATGATG GGCCATGCCT CTAACCTCAT
CATGGCAAAA GTCCTGGGGG TCAGACCCGA GGAGAGCAGG AAGTGTCTTT TGAGGGATAC ATTTCCACAG
TGGAAATAAT GAGACTTAAA TAAATATTAT ATACACAGTT CAACTGTTTT TATGTGTAAA GGTAGTAGGT
TTTCACAGTA AGGAAGCACT TCTTTTTTTT TTTGTTTGAG ACAGAGTCTC GCTCTGTCTC CCAGCCTGGA
GTACAGTGGT GCTATCTCGG CTCACTGCAA TCTCTGCCTC CTGGATTCAA GTGATTCTCC TGCCTCAGCC
TCCCGAGTAG CTGGGACAAC AGGTGTGTGC CATTACACCT GGCTAATTTT TGTATTTTTA GCAGAGATGC
GGTTTCACCA TGTGGGCCAG GCTGATCTCG AACTCCTGAC CTCAGGTGTT CTGCCCGCCT CTGCCTCCCA
ATGTGCTGGG ATTACAGGCA TGAGCCACTG CACTCACCAA GCACTTCTAC TGATAGCATT TACAAACCCT
TCTTAGAATA TTTAAAAATT CTAAGAGAAG AGTAAATTGA GCCTTCCCAA CTAATACTAG GAGGTTATAA
CCTTCATACC AAAACTGGAC AATGCTTGCA CAAAGAAGG AAGCCAATGA GGCCACCTAG AAGGAAGACT
GGGCATTGGG CCCAGTGAGT CCTGGAAACC TCATCTGTGC CAGCCACCCC GGCATGGCCT GTATGAGTGG
ATGAGGGTGA CTTGTCCACA GACAATAGCC ATCTAGCTGT GATAAAGGAG TCAAGGTAGT CAGCTGCATC
TCTTTCACCT GTTTGCCAAT GTTACACAGG TTGAAAAGCT AAGGTTTATG TAAAGCAAGC ATCAAAGATG
ATGAAATGAT CAACCTGACA ATGAGTACTA TGCTGCATTG TCCAGAAAGG AACTGTGGAA GATTTTGGGC
TGAATTTCAA AACAGAATTT CCTCACTCTC TGGATGTTGG CTTACTTGGC CTTTGATGTT CAGAGGTGGT
GCCTTTGTGT TGTTGAACAA TGTTGATTTT GGAGAGAAAA CAGAGTTGAA AAACCCACAA GTCATTCCCT
GGGGAGTATT ACCGGAATAC AGAGGATAAT TTCAGCAAGC CAGCAAGGCC TCATCTCTGC TTCTAATAGA
TAGGAAGAAA GGAAGAGAGG AACAATACTT TTTTAAGAAG CTCAGCTTTA TCGCCTTATC TCATAGAAAG
ATGCCTCCAG TCTGTCTGGC TAAAGGTAAT TGGCATGGGA AAGTCTTTAT CTGTGATTCT AACAAGTGGA
ATGTTTCCCT TCATTAAGAG AGCCTTGTCT GGCTTGGGGA AATGAAACAC TTTCTCCGAT ATGAGTGGGC
TGTAACCCCT GCTACTAAAT ACTCAGAAGA AATAAGGCGG TTGTGGAGCA GTCAGGAATG AGTCACTTGC
CTCCCTGGAA TATTCAGAAA ACTGAATCAA AAGTACATTC TTCTGGGTTT TCTTAGTCTA ATAGACTAAG
GGTCTCTACT TTGTTAAATT TCTGGGAAAC AGCATAGAAT GGGAGAAAAA ACTGGTCACT GTAGTCATGC
AAATCTGCAA AACAAACAAA AAAGTCTGGG TATTGCTGCT AACTAGCTAT GTGACCTTAA GCAAGGTATT
AACTCTCTCT GAATTTCAGG TTCTTCATCT GTTAAATAGC ATATCTGTAA AATGGGAATT ATTTTCATAT
CATAATGCTG TAGCTTTAAA AAATAAAATA AAATGGATGA GATAATCAGA ATTAAAGAGC CTGGGATATA
TAGTTAATAT ATAGCAGCAT GTAAAGATCC TGTTAGAAAT GCTAATTTTA CAGTTAACCA TTTGGAGATG
ATCCGCCAAA GCTGCTAGTG TAGAGGCAAC TGAGAATTTG CCTGTCCTTC AGAATATGAA TAAATAACTG
TCAATGATGT CTCAAGCCTA GAAAAACCTA TCCATCTGGA TGGGTGGGAA ATTTCTAGGC TAGTATTGAG
AAGCCCATTT CTTGGGAAAT AGGTCCTGGA CTGAGTGAAG GAAAAGAAAC AGTAAAACCC ATGGTAAAGC
AGCAAGGCTC TCTAGAGGCT CTGGAGAGGA TGAATTGAAT TCTAGAAGAT GAAGTAGGGA AGACGCTTTA
CCTTCTTGTG AAATGGATTC AAAGATTCAA AGACCTTCGG GAATCTCCAA TTGTATAAAT GGCACCATAG
CTGTATGTTC CATGGAACAC TACTTCCCAG AGATGCCCAG TGAAAAAAGA ATGCCACAGT CAAATAAGTT
TGGAAACACT CCATTATGTG GCCACCTCCT TGAAGACTCT AATGCACATT AGCATGTTAA ACAGTCTTGA
GAAGTCCTGC AGAGCAGAAA TTGCTTCACA TCTGCTAAGC CGGCAGTTTC CCAATATACT TGATTATGGA
TAGTTTTTTC CTTACAACAC CATTCTCTGA TATGCTTCCA ATGACATGAA ATAAATATAT ATGCATGAGG
TTCTTCATTA GGGCATACTT TTTAATAGAA AATATTGAGA ATAATCTAAA TATAAATGCA CAGCATTTAC
```

-continued

```
CTTTTCTGCA TAAACTATAT ACAGGCATAC CTTGGAGATA CTATGGGTTT GGTTCCCACA ATATCTCCAA
AACCACATTC GGTTTTATGA CCACTGCCAT AAAACCAGCC ACATGAATTT TTTGGTTTCC CAATGTATAT
CAAAGTTACA TTTTTACTAT ACCATAGTCT ATTATATATA CAATAGCATT ATATCTAAAA AACAACGTAA
ACACCTTAAT TTAAGGCTGT GGCTGGTTTG ATTTTCTACC CAGACCACTA AAACTTTCTT CATATCAGCA
ATAAGGCTGT TTCACTTTCT TACTATTTTT TGTGATAGCA CTTTTCCTTT CCTTCAAGAA TTTTTCCTTT
CTATTCACAA TTTGTTTGAT ACAAGAGGAC TAGATTTTAG CTTATCTCAG TTTAAGGTGT TTACATTGTT
AGCTAAAAAT GCTAATGATC ATCTGAGACT TCAGCAAGTC ATAATCTTTT GCTGGTGGAA GGTCTTGCCT
CAGTGTTGAT GTCTGCTGAC TGGGTGGCTT TGGCAATTTC TTAAAGTAAG ACAACAATCA AGTTTGACAT
ATCAATTGAC CCTTCCTGTC ATAAATGATT TTTTTTTTCT CTGTAGCCTG CAATGCTCTT TGATAGCATT
TTACCCACAG TAGAATTTTC AAAATTGGAG TCAATCCTTT CAAACTCTGG TGCTGTTTTA TCAACTAAGT
TTATGGAGTA TTAGAAATCC CTTGTTGTCA TTTCAACAAT GTTCACACCA TCTTCCCCAG GAGTATATTC
TACCTCAAGA AACCACTTTC TTTGCTCATC TATAAGAAGC AGCTCCTCAT CCACTAAAGT TTTATCCTGA
GATTGCAACA ATTCAGTTAC ATCTTCAGGC TCTACTTCTA ATTCTAGTTC TCTTGCTGTT TCTATCTCAT
TTGTGCTTAC TTTCTCCGCT GAAGTCTTGA ACCCCTTAAA GTCACTCATG AGGGTTGGAA TCAACTTCTT
ACAAACTCCT GTTGATGTTG ATATTTTGAC CTGCTCCCAT GATTCATGGG TATTCTTAAT GGCATCTAGA
ATGGTGAACG TTTTCAGAAG GTTTTCAGTT GGCTTTGCCC GGATCCATCA GACGAATCCC TATCTATGGA
AGCTATAGAT TTATAAAATG TATTTCTTTT TTTGTGGGGG CATAGCGTCT CACCCTGTCA CCCAACCTGG
AATCCAGTGG CACAGTCATA ACTCACTGAA GACTCAAACT CCTGGGCTCA AGTGATTCTT CCACCTGGGC
CTCCCAAAAC ACGGGATTAC AAGCTTGAGC CACTGTGTCT AGCCCAAAAT GTATATCATA ACTAATGAGG
CTTGAAAGTC AAAGTGACTC CTTGATCCAT GGGCTACAGA ATGGACGCTG GGTTACCAGA CATGAAAACA
ATACTCATCT CCTCATACAT CTCCTTCAGA GCTCCTGGGT GAGCAGGCCC ATTGTCAAAT GAGCAGTAGT
ATCTTGAAAG AAATTTTTTT TCTGAGCAGT AGATCTCCAC AGTGGACTTA AAATAGTCAG TAAACTATGC
TGTAAACAGA AGTGCTGTCA TCCAAGCTCT GTTTTTCCAC TGATAGGGCA AAAGCAGAGT AGATTTGGCA
TAATTCTCTA GGGCCTTAGG ATTTTTGGAA TGGCAAATTG AGCATTGGCT TCAATTTTTT TTTTTTTTTT
TTTTTTTGAG ACAGAGTCTT GGTCTGTCAC CCAGGCTGGA GTGCAGTGGT GCAATCTCGG CCCACTGCAA
GCTCTGCCTC CTAGGTTCAC ACCATTCTCC TGCCTCTGCC TCCTGAGTAG CTGGGACTAC AGGCACCCGC
CACCATGCCC GGCTAATTTT TTGTATTTTA GTACAGACGG GGTTTCGCCA TGTTAGCCAG GATGGTCTCG
ATCTCCTGAC CTCGTGATCC ACCCGCCTCG GCCTCCCAAA GTGCTGGGAT TACAGGCGTG AGCCACAGCG
CCCAGCCTGT CTTCAACTTA AAGTCGCCAG CTGTGTTAGC CTCTAATAAG AGAGTCTGCC TGTCCTTTCA
AGCTTTGAAG CCAGGCATCA TTCTCTTCTC TAGCTATGAA AATCTTAGAT AGCATCTTCT CCCAATAGGA
AGCCATTTTT TATGCCCTAA AAATCTGTCG TTTGGTGTAG CCACCTTCAT CATTGATCTT ACCTAGATCC
GCTGGATAAC TTACCACAGT GTCTACATCA TTACTTCTGC TTCACCTTGC ACTTTTATGT TATGGGGATG
GCTCCTTTCC TCTAACCTCA TAAACTAACC TCCACTAGCC TCACATTCTT CTTTTACAGC TTCCTCGCCT
CTCTCAGAGT TCACAGAATT GAAGAATGTT GGGCCTTGGA TTACACTTTG GTTAAGGGA ATGCTGTGGC
TGGTTTGATT TTCTATCCAG AACACTAAAA CTTTCTTCAT ATCAGCAATA AGACTGTTTC ACTTTCTTAC
TATTTTTGT GATAGCACTT TTCCTTTCCT TCAAGAATTT TTCCTTTCTA TTCAATTT GACCGTTTGA
TATGAGAGGC CTAGATTTTA GCCAATCTCA GTTTACACCA TGCCTTTTTC ACTAAGCTTC ATCATTTTAG
CTTTTTATTT AAAGTAAGAT GTGTGACCCT TCCTTTCATT TGAACACTTA CATGATGATG CCTGGCTTCA
AAGCTTGAAA GGACAGGCAG ACTCTCTTAT TAGGGGCTAA CACAGCTGGC GACTTTTAAG TTGAAGCCAA
```

```
TGCTCAATTT GCCATTAGAA GCCATTGTAG GGTTAATTAA TTTGCCTAAT TTTAATATTA TGGTGTCTCA

GGGAATAAGG AGGCCTGAGT AGAGGGAGGG AGATGGGGAA ACAGCCAGTC ATCAGAGCAC ACACAACATT

TATCAATTAA GTTTATCACC TTGAGGGCAC AGGTCATGAT ACTTCAAAAC AATTACAATA ATAAAATAAA

AAATCATTGA TCGCAGATCA CCATAACAGA TATAATGATA ATGAAAAATT TGAAGTATTG TGAGAATTAC

CAAAACGTGA CACACAGACA CAAAGTGAGC ACATGTCATT GGAAAAGTGG TGCTGATAGA CTTACTTCAT

GCAGGGTTGC CACAAATACT CAATCTGTAA AAAATTCAAT TATCTACATA GTACCATAAA AACAAGGTAT

ACCTGTTTAT ATAATCAAGA CCAACAGAAC CCTAGAGAAA ATAGCTCACT CCCTAGCTCG GAGACATTCT

AACCAACATA CACTTACCTT TCTTTTTGCT GTGTACAGAA TTCAAATCCC TGTCTCAGCA AAATTGCAAA

GTATCAAATG TCATGTCCAT CTAATACTCA AAACTGCAAA TGTTAAGTCT TGTAAGCCCA GAGACCACTG

TATATACAAG TGTTGCTATA AGCATTAGTT CTTCTCCAAA GAAATAGTC CACTGGGTAG AAACAAACAA

AAAGAAAAAA AAAGAAAGAA AAAACATTTT TTACAAGAAG ATTCAGTCTC TTACCTACAT AAGCAAAAAT

ATGAGATGTT CTCTTATCAT TTTTCCATCT ATCTTATAT CTTTGGGGCT GACTTAGACA CTCATTTTCC

TTTTTGTACG TGACCATGTA AAAGTTCAAG TCAAGAAAAA CTTGTTTTGA CATTTGTTTT GCTGAGTGAT

GGGTCCCTAA AAGAAATTTG GCTTTGCTTT TGAAAAGTTC AGCATGATAT TGTGTGAATT TTTCATGGCT

AATGATTTTT AGAACAGTTG TGATGTGTTT AGGTGTTTTA AGAATATGAA GCATTCAGTG GTTTAAGTTG

GTTGTTATAA AATGAAAGAA TATGAAGGAA AGCCTTCTTG TCTTAGAACA CACTGATTCA CAAATAAGCA

GCTTCTCTCA AAATGTTGTA ATTACAAAAA TTCCAAGGCA AATATAATAA ACTCCTTGTC GGTGCTATGT

CTAGAAACTT AACAGCCCCA AAGAAAGTCC TGACAAGGCA AAAATATAT ATATATATAC AAATTGTGGA

AGCAGGGTGT TGAAAGAAGA ATAAAGACTA TATAAGGACA AACTGTTTAA AAGGGAGGGT ATCCTTGAAA

GCTTGACACT TGACTCTTTT GACGAGGCTG AGGGAAAACA CTCAGTTTCA TAGATTGCTG GTACGGATGT

AAAATAGTGA CATCCCTATA GAGAGGAATT TGGCAATATC TAGCAAAAGT GCTTATGCAT TTATTCTTTG

ACCTAGTAAT CCCGCTTCTA GGATTAGTGG TGAAGATACA CCTCAACAAT AAAAATATAT ATACATTAGG

TTATTAGTTA TGGTTTAATT TTTAATAGCA AAATATTTAA AACAACCTAC ATGAACAAAT AGGAGACTTA

CTGAATAAAC TATGGTATAT CTGTACAATA AAGTGCAATT CACTTATGTT GTTAATTTGT TCCAAAAATC

CAGAGCCAAA GAGTATTTGT TATGCTCTCT TTAGTATAAG AAAGGGGAAA TAAGATATGT GTGCATCTGT

TTATTTTTGT GAAAATAAGT ACAGAAAGGA TAAGTAAGAA ACTAGTAAAA CTAGTTATCT CCTAGTGTTA

GTAGAAATAG AATGAAAGTG AATTAGGCTT CTTTGAGTAT ATGTTTATAT ATAGTTTTGA CTTTTGAATT

ATGTTTATGT TTACATAGTC AAAAATATAA ATTAATCAAC AGAAATAACA AAAAAGAAG AAATCACAAG

CTTTAAAATT TAATACAAAC AGAAATAATT GAATCTAACA GTATATCAAA GTGATAACGT AAACTCAGAA

GAAAAAAACA TAATCCAACA TACCAGTGGA ACACAATATT CTAACTGTAT ACATTCAGTG GTTATAGTCT

AAGGACAAGA AAAATTGCAA AAATATCTTG AACTTTAGCT TGTAGGATTT TTATTGGTAG CAATACTAAT

GTACTAATTC TGAAATTAAT GTTCGTGTAT TATAGAATTG AGTAAATGAA TAAATATGTT GATGTTATTG

GGAACTAAAA TTATCATTCT GGGAGTAGAG AAATATAAAT ATGGACTTGG CAAATGAAAC AAAGACCTGC

AGAGAGATAA CCATATAAAC TCATTATTTT AAAAATTATA AGTGTCCTAG CTCTGTTACT GAAAAGGCCT

AGATTCAATC TTATCTTGAT AGACAGGAGG GCACCCCTTT CTCAGAACAT GGTTTCCAAA TGCCATTCTC

CATTAAAAGG AACAAGGTCT TCTTGGAGAA AAGACTGATT CTAGGTCTGG ATTAGGTAAA GTACAACGTT

AGTCTGGAAT TTCTTGCTGA ATCAGAAGTA AGAAAGTGCT CAAAAACATG GAACATGTC ACAAACACAC

GTGAGGCAAC TTGAATCCTC ACTGGCCATA TTTAGGACAA TCGAGCATCA AAAAAAAAA AAATGTTGAG

AATAATGGAT TCTAACACTT AAAACAAAAA ATAATCCATA GCCCACAGAA GGGGAAGAGA GGGGGAGCTC

TTATTTACAG ATGAATATCA AATAGCAAAG ACAGAAGAAA TGACAGAATT AGAGAAACAT CATTTTGCAA
```

```
AACACCACTG TAATAATCAA TTCAGGCAAG TATTATTAAT GGATGTATTA CTATTGCGTA AAACCAGTTG
GGGAACAGGA TATTCATACA GTCTGAAGGT GTCACCCTAA ACATAACTTA TTACAAGTGG AAAATGGTGC
CTTTACAATG AAGAAATCTA GCAGAAACCA TCTTAATCTA GTGATCAAAC TTAGTATCAC AATAATGGA
TCATACTGAG TCATGTGTCT CCTAATATGA TGCACCAGGA AGGATGCAAC GTCATGAACG TTGTATTCTT
TTGTATTCAA CAGACCACCC AGGGTAAAGG CAGCTTTCTC ACTTACTAAT CAGAATTGTT GGTTTTAATT
CATTTTGGAT TTTAAGATTT CTTACTTTCT TGTCAGCTCA GAAATTTATT TAAGATGATT TTTATCTTTT
ATTCAATACT TTAGCTTGGA GAACCATTCA GAGTTTCTAA CTCATTGTAT TGCCAAAAAT AGAAAACAGC
ATGGTTTCTT TTGAAAATGT CTAACTTTAA AGTTACTTGT GTGTGTCACT CAGATTCACA TAGCTTTTTT
GCCTAGTAAT GTAGTATCAT GTGGCAAGGC TATAAAAATG TTTACAATCT TTTATTTAAT ATGACTCTTG
AGAGTTTATT CTAAGGAAAT AATTGAATAG TAACAAAACA CTATTAACAC AAAGCATAGC AATTTGATTT
GGGCAACCAA ACACTGGAAA CAACCTAAAT GTCCATTACA GGAATCATTT ATGAAGCAAA CACTAAAATA
TTTATTGTGA AGATTATGAG AACATAGAAG ACAGTTATGA GAGTAAATTT GAAAACCTGA ACACAAAACT
TACATATACT CCAATTGTAA CTTATAAAAA ATACGTGCAT ATAAGGATAA AACAGTACAA ACAAAAAAAT
AGTTGCGTTA GATTGGTAGA ATTATGGCTC CTTTTGCTGT CTTAATTTTT TCCTTTTACA TTTTGATACA
TTATTTTAAT TTTAATTTTA AAATTCAAAA GAATTTGCCA CTCATCTTTG CCACTTCAAG GAAAAAAGAA
ATGTGTTCGA TTATTCPTTT CTTAGTATAG TTTTGGCAAT TTCCTCACGT GTAAAAAGAG AATACTATTA
ATAATTTCAG TATCTATAAG ACAATATAAA ATTAAAGAAT CTAGCCCAGT AACTGGTACA TGGAACGTAA
TTAATAAATC ATTATGGACT TTTTTTCTCA CACCCAAGTA GGGAGGAATC AGTGGTCCCC TAGAGGCCCA
GTGTAGAGGT GGCAGCACCA ATCCCTAGGG GAGAAGATCT TGGTGATGAT AATTCCTGAG CAGACAGTTA
GCTGAGAATT CAAGAGCAGA AAAGTAAGAA AGAAACAACT TCTTGCTAAC ACCTTTCCAC CCACGTTTCC
CTGTTCTGTT GTACTCTGCT TACCCTTTCA TGGATGGAGG CAGAGGAAAG AGAACCAAGT TTGCTCTTAG
TCATTCACTA TGTTGTTTAA TCTGCCTTCC ATCTTTCTTA TCAGTTCAAA TTAGAATGTA GACCTGAATT
TAAATCCCCG TTCTGTCAGT TATAATGTGA CCCTAGACAA AACACATTCT CTGAACCTCA GAGAACATTC
TTCATTTGTA GAATGGGAAG ATTAATCTAT ATTCCACTTG GATGGCAAGT CTTTATAAA CTTTATAACC
TAAACATGTG TGAGTTGCTA GTATCATTAT GTTGGTAAAG TTATTCTGAG ATATGATAAC AGAACTGTTT
TGTCTAACTC CACTAGCATG GTTCAGGTTT AGAGAGTGTG GAATTAAAAG GCTTTATCCT CAAATATGAC
TTAAATCCGA TTTTTCTCAT CCACTTTCCT CCACAAACAA ATCCTCAGGA ATGACAAAC TTTACATGGT
TAAACATCAG TTTTGTTTAG TCTTTGACAT CCACATGGTT AAATCATACA TTTGAAAACT GCTTATATTT
GTGTTGTCTA TGTCTAAATT GAAAAGACTT ATTGAGGAAT AGAAGACTAC ACATTTTTCA GCAAACACTG
CACGTTTTGC AGAATTTCCC CAGGCACCAG TCTCCAGGAA TTTATTGGCT ACTAACAATA CTAAGATATG
GATGAATGAG GAAATCAAAA TGGAGATCTT GCAAGTTTTG TGAGAATGGG TGAATGGTCC AAATGAAGAG
ATAAGTGTTG AAATATTAGT ACAAGTAAAA ATTATTTACA ATGAAAGACA TTTTGTCAAT AGCTATGAGA
ATTTTACCAT TGACCCAGAA ATTCCATTTC TTTCTTCAGA ATACCCACG TAGGTATACA TATAAAAGT
TATTCATTAC AGTATCGTTT TTCATAGGAA AAAGTTTTAA AAATCAGAAG CTATCTAAAC TATGGTATAT
CTAGGTCATA GAAATCAAAT GACTAAAAAT GTTAATATAA GCATATGTTT TTAAATTAAC TTGGCTTGGG
TCTTCAGCAA AATTGGCTTC TTAACATTGC ACTCCAGAGT TAGACTTACC CACTCAGTCA CTTATCATGC
AGGAGCAGAC TCCTAATACC ACATATCATA GAGCAGAGTA GGACACAGGT TCTCTGCAGG CAGGCAAATC
CCAAAGAGAA GGGAGGAAAG GGCTGAGACA CTGCATGGTC AATTTCTTCT GAACTCTGCA ATGTACGGAG
GTGGACAGTG TCCACAAAGA TTGCTCCCCT GGACCCACCA TCATAATAAC ACAACGGCTT TGTTTTGTTT
```

```
TTGTTTTTGT TTTTTGACAC GGAGTTTTGC TCTTGTTGTC CAGGCTGGAG TGCAATGGTG TGATCTCGAC
TCACCACAAC CTCCACTTCC TGGGTTCAAG TGATTCTCCT GCCTCAGCCT CCTGAGTGGA TGGGATTACA
GGCATGCACC ACCATGCCCA GCTAATTTTG TATTTTTAGT AGAGACGAGG TTTCTCCACG TTGGCCAGGC
TGGTCTCAAA CTCTTAACCT CAGGTGATCC ACCCGTCTTG GCCTCCCAAA GTGCTGCGAT TACAGGTGTG
AGCCACCGCG CCCAGCCCAC AATGGCCTTT TGTTTACATC TCTAGTGCAG CACTCATTTG ATGTTCTTTC
AAGAAGAATA CATATTTCAT CTTTTATTTT TATACAGCAA TTAGCACAGT GCCTGGCATA AGGAAAATGA
TCATTAAAAG CTGGGTGAAA AACCTAATAA AGCTACTGAG GATAGGAACT GCAGACCAGC ATGGAAAGAA
AACTATGAGC CAGATATTGA CATCATCCTG AAAGGCAGAA GATTTAGTAT AGGCAAGAAG TATGCTTTTG
GAATATAGAA AATCTGGATT ATGATAAGAA AAGAATCATA TTTGTCTTAT CTTACCTACT CACTTCTCAG
TTCCACATGT TTCTGAGGCT GTTTGTCCTT ACTTTCTTTT CTGTTTTATC CACTCTTTCT GTTCTTTAGA
TTGGATCATT CCTATTGAGC TGACATCAAG TTAACTGACC TTTTATTTTG TCCAAACTGC TGTTAAATGC
ATCCAGTGAA TTTTTAACTT TATATAGTAT ATCTTTTAGT CCTAGAATTT CCACATGAGT TTTTTAAGTT
TCCATTTCTC TGCTGAGATC TCCTATTTGT TCATTCATTA TGACCATATT TTTCTCTACA TTATTGAGCA
TAATTATAAC AGCTCTTCTA AAATTCTTGT CTGCACATTC TAACACCTGA ATTATTCTGG GGTCAGTCTC
TGTTACATTG CCTTATTACA AAAACAGTAT AAGTCACATT GCCTTGTTTC TTAATATGCA AAATGATTTT
TGATTGCAGA CTAGACATTT TGAATTAAAC ATTATAGAGA TTCTGGATTC TCGAGAGAGT ATTGACTTGT
TTTTTCCATC AGGCAGGTAA CTTGACTGGA CTCAAACTCC AAACTCTAGG TCCTCTGTAA TGGGCAACTG
CAGTAATCTT TGTTTAGTTC TTTAAGACTT ATTGGCCAGG CACGGGGCT CATGCCTGCA ATCCCAGCAC
TGTGGGAGGC CAAGGTGGGA GGATCACCTG AGGTCAGGAG TTCGAGACCA GCCTGGCCCA CATGGTGAAA
CCCTGCCTCT ACTAAAAATA CAAAAATTAG CCGGGTGTGG TGGTGGGCGC CTGTAGTCCC AGCTACTCAG
AAGGCTAAGG CAGAAGAATC ACTTGAACCT GGAAGGCAGA GGTTGCAGTG AGCCGAGATT GTGCCACTAT
ACTCCAGCCT GGGTGACAAA AGCGAGACTC CCTCTCAAAA AAAAATTTAT TGGCACTGCT TGGCATCTGC
TATGAATACA TGAAGTTCAT GGGTCAGCTA TAGATCTGGG CACGTTATAC ACAGAATTTG GGTCTCCCTT
TCTCTGGATT TCTCCTTTTC TGGATTTCTT TTCTCATTTT CCAGCAGCTG TGGTTGCCCT AAACTCGGTC
CTCTGTTTCT TTACGGCAGT AAGATTTGGG AACTTTTAGG TTTTACCTGC CTCTCAGACA AAATAAAAAA
TAATTTTCAT CTTGATGCTA CTCCTTTCTT CCAGATGTAG ACACCTCTCT AATTTCCAGT TGCTTTTTAT
TGCTCTCCAG AGTCTAAAGA TTATCATTGT TTTCTGTGGG AGAGTTGGTC TGATAAAAAC TACTCCCCCA
AAACTGGAAG CTGGAAGCTT GTAATTATGA ATAGACTTTG AGTAGTATTC TTCTTTGGAA AAGGATTTTA
ACTACTCCCT ATGTACTTCT TTATTTCCTG TTTTTCTCAT CCGTAATCTT TTTATTTTCA TACTTCCTAA
GTCAGACAAT TTTCCTACTT GAAGATTCAG TGACTGCTAT CAAATGACCC CCATATTACT AAATACAATA
TCCCCAACTG CATTTATAAA AAGAAAATTT ACTGTTTATT AGTAAACAAT GTTGTAGAAT AGTAAAATAT
TGCTGGGCTT TGGAGCCAGA TAATCAAGGT TAGAATCCCA GATTCTAACT TACTAGCTGG TGTATTAGTC
CTTTCTCATG CTGCTAATAA AGACATACCC CAGACTGGGA GACTGGGTAA TTTATGAAGA AAAGAGGTTT
AATTGACTCA CAGTTCAGCA TGGCTGGGGA GGCCTTAGGA AACTTACAGT CATGGTGGCA GCAAGGAGAA
GTTCCAAGCA AAGAGGGAAA AGCCCCTTAT AAAACCATCT GATCTTATGA GAACTCACTC ACTATCACGA
GAACAGCATG AGGGTAACTG CCCTCACGTT TAATTACCTT CCACCAGTTC CCCCCATGA CACATGGGGA
TTATGAAAGC TATAATTCAA GATGAGATTT GGGTGGAGAA ATAGCCAAAC CATATAATTC CACCCCTGGC
CCCTCTCAAA TCTCATGTCC TCACATTTCA AAACTCAATC ATGCCCTCCC AACTGTCCCC CAAGGTCTTA
ACTCATTCCA GCATTAAGTC AAAAATCCAA GTTCAAAGTC TCATCTGAGA CAAGGCAAGT CCCTTCTGCC
TATGAGCCTA TAAAATCAAA AGCATGTTAG TTACTTCCTA GATACAGTGG GGGTACAGGC GTTGGGTAAA
```

```
TACACTGATT CCAAATGGGA GAAATTGCCA AAACAAAAGA GTTACAGACC CCATGCAAGT CCAAAACCCA
ATAGGGCAGT CATTAACATT AAAGTTCCAA AATGATCTCC TTTGACTTCA TGTCTCACAT CCAGGTCACA
CTGATGCAAG AGGTGGGCTT CCAATGGCCT TGGGCAGCTC TGCCCCTGTG GCTTTGCAGG GTATAGCCTG
CTTCCTGTTT GCTTTTTCAC AGGCTGACAT TGAGTGTCTG TGGCTTTTCC ATGAGTATGG TGCAAGCTGT
TGGTGGATTT ACCATTCTGG GGTCTGGGCC AGGTGCAGTG GCTCATGCCT GTAATCCCAG CACTTTGGGA
GGCTGAGGTG GGGGATCACA AGGTCAGGAG ATCGAGACCA TCCTGGCTAA CACGGTAAAA CCCAGTCTCT
GCTTAAAAAA TACAAAAAAT TAGCCAGGCG TGGTGGTGGG TGCCTGTAGT CCCAGATACT TGGGAGGCTG
AGGCAGGAGA ATGGCGTGAA CCCAGGAGGT GGAGCTTGCA GCGAGCTGAG ATTGTGCCAC TGCACTCCAG
CCTGGGCGAC AGAGCAAGAC TCCATCAAAA AAAAAAACAA AAAACCATT CTGGGGTCTG GAGAATGGTA
GCCCTTACAG CACCACCAGG CAGTGCCCCA GTGGGACTC TGTGTGGGGG CTCTGACCCC ACATTTCCCT
TCTGCACGGC CCTAGTAGAG GTTCTCCATG AGGGTTCTAC CCCTGCAGCA AACTTCTGCC TGGACATCCA
GGCATTTCCA TACATCCTCG GAAATCTAAG CCGCGGAGGT TCCCAAACTT CAATTCTTGA CTCCTGTGCA
CCCACAGGCT CAATACCACA TGTAAGCCAC CAATGCTTGG TCAGGGCTTG AACCCTCTGA AGCAATGGCC
TGAGCTGTAC GTTGACACCT TTTAGCCTAG ACATCTAGGA CACAGGGCAC CATGACCCGA AGCTTCATAA
AGTGGGAGGG CCTTGGGACT AGCTGAGGAA ACCATTTTTC CATCCTAGGC CTCCAGGCCT GTGATGGGAA
GGGCAGCCAT GAAGGTGCCT GACATGCCCT GGAGACGTTT TCCCCATTGT CTTGGTAACT AACATTCAGC
TCCGTGTGCA GCACCAACTT ACTTATGCAA ATTTCTGTCA CTGGTTTGAA TTTCTCCCCA GAAACAGGA
TTTTTCTTTT CTATTGCATC ATCATGCTGC AAATTTTCAA ACTTTTATGC TATGCTTCCT GTTGAAGACT
TTGCGGCTTA GAAATTTCTT CCCCCAGATA CCCAAAATTA TCTCTCTCAA GTTCAAAGTT CCACAGATAT
CTAGGGGACA AAATGTTGCC AGTCTCTTTG CATAGCAAGA GTGACCTTTA CTCCAGTTCC CAACAAGTTT
CTCATCTCCA TATGAGACCA TCTCAGCTTG GACTTAGTTG TCCATGTTAC TATCAACATT TTGGTCAAAG
CCATTCAACA AGTCTCTATG AAGTTTCAAA CTTCCCCATG TTTTCCTGTC TTCTAATAGC CCTCCAAATT
TTTCCAACCT CTGTCTGTTA CCCAGTTCTA AAGTCACTTC TACATTTTTG GGTATCTTTA CAGCAGTGGC
ACTCCCCATG GTACTAATTT ACTGTATTAG TCTGTTCTCA TGCTGCTAAT AAAGACTTAC TCGAGACTGG
GTAATTTATA AGAACAGAG GTTCAACTGG CTCACAGTTC AGCATGGCTG GGAGGCCTCA GGAAACTTAC
AAACATGGTG GCAGCAAAGA GAAGTTCCAA GCAAAGAGGG AAAAGCCCCT TATAAAACCA TCAGATCTTG
TGAGAATTCA CTATCATGAA AATAGCATGA GGGTAACTGC CCCCATGATT AATTTACCTC CCACAGGGTC
CCTCCCATGA CAGGTGGGGA TTATGGGAAC TACAATTCAA GATGAGATTT GGGTGGGGAC ACAGCCATAC
CATGCCAGCT AGAGAGCCTT AAGAAAGTCA CCTAATCTCC ACAAATAAAA GGTTTCCTAT TTGTTCAACA
AAAATAATGA CACCCCTTTT ATGGGATTTC TGTGAGGACA AATGATAACT AACATAGCCT TGCATAGTGT
CTGGCACAAA ATAGCTACTC AAAAAATAAT AGAAACAACA TTTAAAAAAT GTAGACTTTA TTTTTTAGAG
TTTTATGTAC AAAGCAAAAT TGAGCAGAAT GTACAGAGAG TTTCCGTATA GCACTCCCTA CCCCCAAGCA
CAGATAGCCT CCCCCAGTAT CAGCATCCCG CACCAGAGTG GTACATTTAT TATAACTGAT GAATCTATAT
TGACGTGTCA TTTTCATCCA AAATCCATAG TTTATATTAG GGATGCCTCT TGGTGTTGTA CCTTCTATGG
GTTTTGACAA ATGTATAATG ACATGTATTC ACCATTACAG TATCATAAAG AATAGTTTCA CTGTCCTAAA
AATCTTTGAT CTTCTTCCTA TTCATCACTC CCTCCCCATT AATCCCTGAC AACTACTGCT AATTTTCCTG
TCTCCATTGT TTTGTCTTTT CCTGAATGTC ATATAGTTTA AATATACAGT ATGTAGGATT TTCAAACTGG
TTTATTTCAC TTAGTAATAT GCATTTGATG TTCTTCCATA TCTTTTCAAA GCTTCATAGT TCAATATTTA
TAGAATTGAA TAATATTCCA TTGTCTGGAT GTACTACAGT TTATGTATTC ATTCACCTAT CAAAGAACAC
```

-continued

```
CTTGGTTGCT TCCAAGTTTC AACAATCATG AGTAAAGCTG CTATAAACAT CTATGTACAT GTTTTTTTGT
GAATTGAACA TTTTCAGCTT TTTTAGCTCC ATTCCTAGGA GTGCAATTGC TGGATTGTAT GATAAGGGTA
TGTTTAGTGT TGTAAGAAAC TGCCACGCTC TTCCTAACTG GATGTACTGT TTTGCATTCT CACCAGCAAT
GAAAGAGTTC CTGTTGCTCC ACATACTCAC CAGCATTTGG TGTCGTCAAT GTTTTGAGCA ATAGCATTTT
GATCTAACTT TTCCTAGGTA TTCTTTPTGA AGGAAATAAT ATGACAGATA ATAGAGAAAG GATATACGAG
GACAGTTCTG TCCTTTATTT ATAGTCCATC ATTTAATGAA GGACTCTGTC CACACTTGGT ATTTTTAACT
CTGATCCTCC TCTCCCATGA ACTCTGACAA TCTCCTAAAT CCCTGTTGCT GGCACACATG GTTGTGTATC
AGGCCCCCTG TGGTCTGTCT GAAGCATGGC TTTTTTTTTT TTTTTTTTTT TTTTTTTGAG ACGGAGTCTC
GCTCTGTCGC CCAGGCTGGA GTGCAGTGGC GCGATCTCGG CTCACTGCAA GCTCCGCCTC CCGGGTTCAC
GCCATTCTCC TGCCTCAGCC TCCCGAGTAG CTGGGACTAC AGGCGCCCGC CACCACGCCT GGCTAATTTT
TTGTATTTTT AGTAGAGGCG GGGTTTCACT GTGTTAGCCA GGATGGTCTC GATCTCCTGA CCTTGTGATC
CGCCCGCCTC TGCCTCCCAA AGTGCTGGGA TTACAGGCGT GAGCCACCGC GCCCGGCCTT TTTTTTTTTT
TTTTTTTTTT TTTGAGATGG AGTCTGTCAC TCTGTCACCC AGGCTGGTGC AGTGATGCAA TCTTGGCTCA
CTACAACCTC CATCTTTCAG GTTCAAGTGA TTCTGCCACC TCAGCCTCCC AAGTACCTGG GATTACAGGT
GCCCGCCACC ACACCCAGCT ATTTTTTTGT ATTTTTAGTA GAGACGTAGT TTCACCATGT TGGCCAGGCT
GGTCTCATTC CTGACCTTGA GTGATCCACC TGCCTTGGCC TCCCAAAGTG CTGGGATTAC AGGCATGGGT
CATCACATGT GGCCTGAAGC ATGACTGTTG CTTTAATCAT ATGAAATACT GCTCTGTATT GTTATCTATT
TGAAATGCCA CACCTCCTGA GCTAAATTGC AAGCTTTTAT GGAGCACAAA CCATATTTAT ATATATTAGC
ATGATACCAT GACACATATC AAAAGCTGTT ATATATTGTT ACGTGAATTG ATTCTTTCTC AGTTAAGAGG
ACCTCTGTAG TAGCACTTTC ATACCGTTAA TTTTTCATTT TGTGCCCAGC CCCTACTCTG TGAAAAATGA
AATGAATCCT GTTATCATTT CCCTCCCAGG CCTTTTCTCC TTGTGGACAA TGTGTGGCTC AAGAGAAAAT
TCAGTCAGTA AATTTGTTCA GTGCACAAAC TCTTTATCAC CTCTCACTGT TCTCAAGTGA GATAGAACAG
AACATCCATC CAGTGTCTTA CAAATTGTCT GGTATATAGT AGGCACTCAA TAAATGTTTT TTGAATAAAT
GCATACATGA ATCCTATTCC TATATATAGT ATGGTAGACA GATCATTGAT ACCCAAAGAT GCCCAAATGC
TGATCCCCAG AACTTGTGAA TATGTTACAT TTCATGTCAA AAGGGACTTT GCTAATGTGA TTAAGGATTC
AGACCCTTGG ATTGTAAGAT TATCCCGGAT TAACCAGGGC CAATCTAATC ACATGAGACC TTAAAAAAGC
AGAAAACATT TCCCAGCTGG GTTAGAGAGA GATGAGACAG AGTAAAAAGG AAAGAGATTC AGGGCATGAA
AATGACTCTA CCCACTGTTG CTGGCTTTGA AGATAGAGGA ACTAGGCCAC AAAACAAGGA GTATGAGTGG
CCTTAAGAAA TAGGAAAAAG CCCTCATCTG ACAGCCAGCT AGAAAGCAGT CCTCTGACCA CAAGAAATTG
GATTCTGCCA ACCACTCAAA TGAGCAAGGA AATGGATTCT CCCCTAGAAC CTCCAGAAAG GAACACAGCT
CTGTAATGCC TTGATTTTAG CCAGGTGAGA CCTGTTTCAG ACTTTTGACC TATGGAAATA TAAGATAATA
AAGTTTTATT GTATGCTGCT AAATTTGCGG TAGTTTATTA CTGAAGCAAT GGAAAGCCAA TACAGACAGA
ATATACAGAG AGAAAGAGAA TGAGTTCTTT CCTGATAATT TGTAAATATT TGGGTCTTCA CTGGACAAGC
TTCACAGAGG ATTCACTGGT TCCCTAGCAA ACCAGCATGT CCAGTCCTGC AGCCTCCCTT TCTTAGGCCC
AGCATATGTC AGCTGTGTGC ATAGAAAAAT CAAAGCAGGA CCCTGAGTAG TTGGAAAGAA AAGATGGTTG
GAAATGGGTT GCACTTCAAG TGAGGAAACA AGAGGTAGGA GACCGGCATC TCTTTCTCAT ATGTCCCAGG
CTGACTCTTG TGAGTTGTTT TCCCTTGGAG CTATCGATG ACAGTCACAG TAACCTGATG GAACCTGGAT
CATGATGAAA GAAGTAAGTG TCAATGGCTC CGACTTCCAA GGACTCTGAT GTCCCACAGC ACTAGCTAAA
CAAAGCCAGT TGGAAATGAG CTTAAATGGG GAATTTCCTG AATATATTCC CTATTGTTAG GAAGCCAGGT
TGGCTTCCTT GCCTACAATT ATGCCAAGCA GTCACACTAT AGAGTCCCTA GGACATGAT ATTAAGTGAT
```

-continued

```
TCTTTTAACA CAAACAACTT AATAATCATT TATACTAATA GCAAACGGC  CAACGGCTGA TATTCCACTT
GAAGTAGAAT TGGCTATCCA ACTGGAAGAG AAGACAGGAA GACGTGATCT CCAGGGAGCC ACTAAAAGGA
TTGGCACCTG CCTCTGGATT CCCCTTTTCC TTATATTACC TCTCAGCACT GGCAGGCCTT TATTTCAGGA
TACAGTTTCA CAAGTATTAT GTCACGTCTC TGAGAATTAT GTTGGTAGAT ATTTGCTCCT CTGGCCAGAA
AGACCTAGTT TGGAGTCTGG AGTCATGAAG GTGACATACA TGTAGCTAGT GACATAAGTG TAGCTAGTAA
AAATAGTGAG TAATGGCCCT GAAATTCTAT TGAATGCCCA AAGTGCTGAC CAGGAACAAG CATGCTCTAG
CTTATCTCAC AAGGAACTTG ACAATTTTCT TCAAAAATCC TAGTAGCTAA GATTTCTTAG TAACAAAGCC
ACTAAGGCAC AATTATGATT AACTTGACCC TTAGGTGACT TTTAAGGACT ATTCTATAAA ATATTACAAC
TAATAGTGGA TCCAAGCCAG CACACTCTGC TATATAAGAT TAATTGACAG TGTCCACACT GGTAAAATAA
GTTGTTTCAT AAATACATTA GAATTCATTT GCACTTTCTA CACAGCCCCA AGTCCAGAAC TTTCCCCAGA
ATAGGTCTAT GTTTTGCAAT CTGCTACTCC ATACAGAGAT TTGAGTTCAC TTGGCAATTT AGTGCTGCTT
ATATGTGACC AGTTAGTCTG TTTTACTTAT CTATGCCTTA ACATTACTA  TACTTACTAA CTCCAAGATG
CCTGGTCTCA ACTTGACAAA AATACCCCAA GTTGGGAAAT CCTTATGTGA ATATGTAGAT AGTCACAATT
GCTGGTTGAT GATGATCTGT CTTTTCCTGT ATTTGAGAAA ATGGAGATAA AATGGACCAA TCCAAATAAT
GGATTAAACA TGGGAATAGG TGAGAGAGAG AGAGGAATAC ATGGTGGCTC TCAGTGTCTG GCTTAGGCAG
TAAACACTTT CGTTAATAAA GACGGAAAAT AAAAAAGGAA TAATTGGTGT CTAGGGGAAA ATAATGAGCT
CAAGTUTTAA CACTCTGAGT TCCCGGATGT GAGACATCCA GGCGCATTTA TCCAAGAGGC AGTTGGAAGC
AACGTTCCGG AGCTTAGGAG AGAGGCATGA CCAAAAGCTG GTGGGACTGT GAAAAGGTAT GGCCATTCTG
GAAAACTGTT TGGCAGTTTC TTAGAAAATT AAACATGTAC TAACAACCCA GCAATTGTAC TCTTGAGCAT
TTGTCCCAGA TAAATGAAAA AAAAAAAAAG CATTTTTTTT ACACAAAAAC ATATACATGA AAGTTCATAG
AAGTGTTATT CATAAAAAAC TGGAAAAAAC TGAGATGTCT TTATTGAGTG AATGCTTAGG CAAACGGTGG
TCTATCCATA CAATGGAATT ATGCTTAGCA ATAAAGAGAA AAGAACTATT GATACATGCA ATAACACAGA
TGAATCTCAA AGGAATTAAT GCTGAGTGGG AAAAAAAGCA CATCTCAAAA TGGTATATAC TGTACTATTT
TATTTACTTA ACATTTTAAA AATAGCAAAA TCATAGAGAT GGAGAACAGA TTAATGGGTA CTGTGTTTTG
GGATGGGGAG TGAGAAAAGG GTAAGGTGTA AATATAAAGG GGTAGCACAA AAGAGCCTTG TGGTTGAAGG
ATTCTATGTC TTGGTTGTAG TCGTGATTGC AGGAATCTAC ATGTGATAAA ATTGTATGGG TCTACATACG
CATACACACA AGAGCATATA AAACTGGTGA CATGTGAAGA AGCTCCGCAC ATTGTGCCAA CATCAGTATC
CTAGTTTCAA TATCAGACTA CAGTTATACA AAACATTGTC ATTGAGGGAA ACTGGGTAAA GGGAACACAG
GACATTTGGC ATATATTTTT GCAATTTCCT GTGAATCCGT AATTATTTAA AAATAACAGA TATACTACAT
ATCAAAAATT TAATGTCATA AAGTTGATGA GTTTACCTAG TGGATAGCTT TGTTAATATC TGCTATAAGA
CTACTGAAAA TGACAGTTAT GCAAGTATAA GCTCAGAGAA CTTTCCTCCC CCTTCGTAAA TGAAATGAGC
AAAAGAAATG AAACAGGAAA GGCAAGCAGT ACTGAAAACA GGGAAGGGCT CTTCCCCATA TAACTATATC
TGCGACTTCA ACAGCTATTC ATCCAGAAAC ACAGCCTCTT GCGCTAAGAG GAAACTTTGG ATAACAATAT
GTTTTCACTC TCCAAGAGAG AAAATGGATA GATTAATTTT TAAGAAAAAA AAAAAAACCT CACCAATTTC
ATGCTGTGGC TTGCACCTTT AATCCCAGCT ACCTACAAGG CTGAGGTGAG AGGCTTACTT GAGCCCAGGA
GTTCAAGGCT GCAATGAGCT ATGATTGATT GTGCTATCGC ACTCCAACCT GGAGTACTAA GCTAAGAGCT
AAGAACACAG CTGAGAGCGG AGAAGAAACA AACAAATCTG ACCAATAACC CCCACTCCCC TCATTTTACT
GGAGTGAGCT GAGACTGCTG GCAAACATGG CCTTTGACCT AGCCTGAACT GTAGCAAAAG TCATCAGATA
TTTTTCCACC AATCAACAGA CAGAAGTGGG GAGAAAACAA TCGTAGTTCA TAACTACAAC AAGCAGATAA
```

```
ACGAAGGCCA TGGTGAGGGA TGGAAGACAT TGTGATATAT CAAAGGCAGG CTCATTTAAA ACTCAACCCA
AATTCCAAAC AAAATATATA ATTGAATATG TATTAATGCC AAAGGAGCTT GAGTGAGCTT TAGCACAAAC
CCCGCCCTCC AGCCCCCACC CAAAAAAATC ACTCTGTTCT CTCCCCATTC TTTGATAGGC ATACTTGCTG
TTTTCTCACA GCCAAGGTAC AGAGGGGACT TAGAGGAACT AGAACTCTAA TACACTGCTA GCAGGAATGT
AAAATGAAGC ATCTACTTCA GAAAACCATT TTATCAGTTT CTAGAAAGTT AAACATAGAC CCACCATGCA
GCCCAGCCAC TCTACTCCTA AGTATTTACA CAAGAGAAAT GAAAACGTGT CCCCACACAG TTGTATTTAA
AGGTGATGGT TAGCCTTGTG TGTCAACTTG GCTAGGCTAT AATACCCAGT TACTGAATCA AATAGTAATC
TAGGTGCATC TGTGAAGGTA TTTTGTAGAT GTGGTTAACA GCTACAATCT GTTGACTTCA AGTAAAGGAG
ATTGCTCTTG ATAGTATGGG TGGGCTTCAT CCAATCAATT GAAGGCCTTA AGAGCAAAAA GTAAGGTTTC
CCGGAGAGAA AGAAATTCTG CCTCAAGACT GCAGCCTCAA CTCCTGCCTG AGTTCCAGT CAGCCAGCCA
GCCTAAAGAT TTGCTAGGCA TTATAATCAC ATCAGCTAAT TTCTTAAAAT AAACCTCTTT ATATATATTG
ATACAATGAA TGGTTATAGC AGCCTTATTT GTAATAGCCA CAAACTGGAA ACAACCTAAA TGTCCTTCAA
TAAGTGAATA CATAAACAAA TTGTGGTATA TCCACAATTT TTACGCAGCA GTAAAAAGGA ATAAATGGTT
GAATAAGGAA TAAACACATA ACAAGGATGA ACCTTAAAAC CGTAAGGCTG AATGGAAAAA GTCAGACAAA
ACTAATACAT ACTGAATAAT TCCATTTATA TTGAAGTTCT AGAAAATGAG GACTAACCTA TAGTAACAAA
AAGCAGAAAA ATTTTGCCCA CTGGTGATGG AGGGGCGCA GGTATTGTAG AGTATCTGAG AAAGGACAAC
TGGATAAAAG GGGGCACAAG AAAACTTTTG AGGGTGATTG ATATGTTCAT TATCTTGTGG CATGGTTTCA
TAGGTGCATA CATATGTCAA AACATCAAGT TATACACTTT TAAAATGTTC AGTTTACTGT ATATCTATTA
TACTTCAGTA GAGAGGAAGG AAGAAAGTGG GCAGGGTGGG GGAGAGGAAA GGAAACGAGG GAGGAAAGGC
CCTAATAGGA AGGATTTTGG AGTTTAGATT TTAAAATGAT AAAGGATGTT TGACACTCTA GGCATATGAC
GAATATAGGA TTATGAGTCC ACAAAAACCA CCAGGAAGTC ATGTATGTTT ATACTTTTAA GTGAAGGATC
AGTGGATTAT CAACTCCCTA ATGCTTTGCC TCTCTATGAC TGGCTGCTGT CCTTCTCATC CCAATACTCC
TTCCAAAGCC CCTTGCTTAA ATGTAAGCCT TCTTTCCTCC TTTCAACACA TCCTGCATTC CGTGACAAAA
TAAGTTTTCC TTAAACAGAA TGTACAGCAT ATTATTThTA CAATTAAAAA TTTTTGGCCA GGTGTGATGA
CTCATGCCTG TAATCCCAGC AATTTGGGAG GCCGAGATGT GTGGATTACC TGAGGTCAGG AGTTCGAGAC
CAGCCTGGCC AACATGGTGA AACCCTGTCT CTACTAAAAA TACAAAAATT AGCTGAGTGT AGTGTGGCAG
GTACCTGTAA TCCCAGCTAC TCAGGAAGCT GAGGCAGGAG AATCGCTTGA ACCTGGGAGG TGGAGGTTGC
TGTGAGCAGA GATCAGACTA TTGCATTCTA GGCTAGGAGA CAGAGTGAGA CTCGGTCCCC AAAAAAAAAC
ACATTTTTTT TTAATGTTTC CTCCTTGCCT GTAGGAAAAA GGCTCTGACT CCTTAGCCTG GGCATCAGAG
CTCTATCTAA ATGGACTTTA ACCTGATTTT GTGGCACTAA TTCCATTGCA GTACTTGTCC GCTCACTGGC
CTGTGCCTCT CTGCCACTAT TTTTGGAATA ATGTCCTCTC TCCATCTTGT TTACTCAACT ATATCCAACC
TCTAAGGCTG TGCTCCTACA AAGCCTCCCC TGGCTACTTC AGCCCACAGA GATATTTAAC TGCTCTGCAG
TTCAGGACAT TCTTCTGACT CTTTAAATCA CATTTACTTA TATATGATCT TGTGATATTT TTTGTTGACG
TGTTTACTTT AATTTTCTTC CATAACCTAT TCATTCAACA AACTCAACAA TTATTTATTA AATGCCAAGT
TAGAAAAATA TTATTGATTT TATATAGATT ATAGATATGT TTGAAATTTT ATTTGGCAAT CTGCAAGTAG
AAAAATAATT ATAATGTGGT ATATCTGTGA TAGAAGTATT AGTGCAGAGA CCATGGGGAA CATAATCCAG
CCTGGAAGTT CAGGAGAGAT ACGTGGAAGA AAGGACGTCA GAGCTTTTTT CCTACAGGCA TGGAAGAAAC
ATTAAAAAAA ATTTTTTTTT TTGAGATGGA GTCTCACTCT GTCTCCCAGC CTAGACTGTG GTGGTGCGAT
CTCTGCTCAC TGCAACCTCT GTCTCCCGGG TTCAAGTGAT TCTCCTGCCT CAGCTTCCCA AGTAGCTGGG
ATTACAGGTA CCTGCCACAC ATGGATGATA AATATGATCA TATTTTCTTG TTCTTTTCCT CCTCAGTTGT
```

```
CTTCCCTGAA GAAAGGAATG CCTTTTATAG ATGACAAACT CCCATTCTCA AGAACAAGGA TTTTTGACCA

ATTTAATTTA ATCAGATGTC TGGCTTTGAC CTAGAAACAC AGTCACGAAA CTTGGTGATT AGAGACCAAT

TCCCAAACAT GAGCATTTCT TAGGAAACAC AGTAAAGATC TGAGAGACCC AAGAGCAGAA GGGCGAGAAA

CCAAAAGCCA TCAGTTTGCA TAGGAAACAC CTTGTTTAGC CTAATCTTTT TATTTTTATT ACTCTATTAG

TCACTACAAC TATTTTCTGA TTGCTATGGT GATAGATGGT TTAAAACAAG CCTTCATTAA GAATTGTCAC

ACCATGGTCT CAGTCAAAAA CACCAACATT TTTATTGGTA TTGACAATTA TGGGAATATC CAATTCCAAG

AAGACAAGGA GACCTCTGAA CTTTCTAAAT GAAGACTCCA ATCTTCCTGA TCTGATGGGA AGCAGCTTGG

CAAGATTACC AACCACCACC ACAGAGAGTG GACTCTAAGC TAAGACTTAA AGATAAGTA GAAATTATCC

AGGTAAAGAT GTGTACAGAG AAGGAAGTAC ATCCAGGGGA AAAGAACAAT ACGTGCAAAA GTACGAAAT

GGTAAAAAGT AATACTACAT AGTCAAAGCC AAGCAGAGTT CAGAAGGGAT CTGGTGGTGA AAAATACGGC

TAGAGAAAGC AGCAAGGATT GGCTTCTAAA ACCTATGTAG TATCTTGGAC CTTACCCTAA ATGTAATGAG

AAGCTTCTAA AGAATCTTTC ATTTATTCAT TCATTGAACA AATATTTTGA GGCTTTCTGT GAAGAACATC

ATTCTAAGTA GTAAAGATAC AGCAGTGAAT AGGACACATA AAATCCTAGA TCTCACAGAA TTGACATTCC

AGAGAGGGAA AGGTAGACAA TAAATACATA AACAAATCAT TTAACAAGAT GATTTCAGAC AATGGTACGT

ACTGTGAAAA AAATGAAACA AGGTAATGGA CAGCGAAAAG GCACTGGAAG GAAGCCTGCT TACCTTTGCA

TGGTTAGAAA AGATCTCTCT AAGAAAGAGA CCACATGTGA GCTGCGACCT GAAGGATACC GAGAAGCTAG

GTGTGCAAAG ATGTGGGAC AGAACTTTTG GACTGAATAG CAAATACAAA TGCCCTTGGG TGCAAGCTTT

GCCTGTTCAA GGACCAAAAA GAAGGCCAGT GTGCCTGCAG CATACTAAGC ACAGAGGAAA ACACTGTTAT

ATGCTGAGAT TGGAATTATA AGTAGAGCCA GATAATATAG TCTCTTATAG GTCATAATAA GGCAACCAGA

TTTTATTCCA AGAGGATTTA AAAATCACTG GAGGTTTTGC ACTAGGGTGA GAGGTGTGAT TTGTATTTTT

AAAAGATAAT TCTGGAGAAT TAACTATAAT GAGGTAGGAG TAAACTAAGT TAGGGGCTAT TTCAGTGGCT

CAGACAAGAG ATAATGGTAG CTTAGACTAG GATAGTAGTC GTAGAAATAA ATAAAAGTGG CACTCTACTT

TGGGGGTAGA GTCTATAATA GGTTTGGTTT ATGGATCATA TATGAGAGTA AAAAAAAGAA AATAAATTAA

TAATGGTTCC TAGGTTTGTA CCTGAGCAAC TGAATAAATG GGTGCTGTGA ATTGAGATAA AGGAGATTGA

GAATCACAGG CTTTGTTTTG CAAATTAATT TTGAGAGGCT TATTAGACAT CCCAGTGGAG ATTTCAGGTG

AGTGGAGCCC ATTGAAAGGT AAGGGACAGG GTCAGGTGTG GTAGGTCAGG CCTGTGATCC CAGGACTTTG

GAAGGCCAAG GCAGACAGAT CAGTTGAGCT CAGGAGTTTG AGACCAGCCT GGGCAACATG GAAAACCCT

GTCTCTACAA AATATGCAAA ATATTACCTG GGCATGGTGG CATATGACTG TGGTCCAAGC CACTTGGGGG

GCTGAGATGG GAGGATCACT TGAGTACAGG AGGCGGAGGT TGCAGTGAGC CAAGATCTCG CCACTGCAAA

CCAGCTTAGG TGACAGAGTG AGAACCTGTC TCAATAAATA AATAAGAAAC GTAAGGGAAA AGGAAATTAA

TCTGATCATT GGCAAATGCA TAGTATTTAA AGCCAGGGGA GTAGATGAGA TACTCAAAGT AGGTGAAGAT

AAGGAGGCAA TGAAGGCCTA GGACTCTGGT GTACATTTAG ATGGTTATAA GAGGAATAGA AACTGGCAAA

ATAAGTAACA CTGAGCACCC AATGAGGTGG AGAGGAAAGC CAGGAGATGA AGCATCATAG AAGGCAAGAG

AAGAAGGGTG TCAAAGAGGC GAGGCAGTCA TCAACTTCTG GGCAGTCAAA TAATATAAGG ACAGAAAAGT

GACCATTGGA TTTGGAAATA TGATGAGCAC TTTGAGTGGA GTGTTGAGAC AGAAGACCAA TTAGAGTAGA

TTGAGGGAT AACGAGAAAT GAGAAAATGT AACCTGCAAG CACAGACAAT TCTTGAGAGA CTTTTCTGTG

AAAGGAAACA GACACAGAGT CTTAGCATGT CTTGTCTTTC TATGGGAAAT GTAAATAGTT TGAGATCAGG

GATAGTATTT TATTCTGCTT TTTGTACCTC TACATTACCT AGCATAGAGC TAGCTAATGT GCACTTAAGT

ATGTTCTCAA TTCTTATCGC CTGAATGACT GGATGGGTGA AAGAATGGAT GGATGGATGG ATGGATGGAT
```

```
GGAAGGATGG ATGGATGGAT GGAAGACTTC TGATTTGCCA AGAAGAGGAT ACTGGTAGCA GAAATAAAAA
CAGCACTGGA GAAAGAAGAG TTTAGATTTT TATTCTTTGG TGTCAGTTAG ACAGGAAAGT AAGACATTAG
AAGAGTCCTT AGATAATTTA TGTAATTGTT CACTTAGGAT TTTTAAATGT GATCACTGAT ATTGGACATG
TTCCTAGTGA AGCATTTTTG GTGTTTCACT GGTTGAAGTT AATAACTGTA AAATTATTTC CCGTTCAGGA
CAGAAAAACA GAAACTTGA AGCTCCTATT AGAAAGTTCA AGATTCTCTG GGGTTCTTAG GATTTACTGT
TCCCAAAACT CTGTCAAGAA CAAGAAAATG ACCTGTATAC TTAACTGGTC TAGGCAACAG TGGAAAGACA
ATCCTCAGAG AAGATTTGTT TTAAGAAGAC ACTTTCCATA GGAATCAAAC AATAGCTTTC AGTGACTAAC
ATGGTAAGAC ACAGGGTGTT AGCTCTTTCC TTCCAACCTC ATGGCTGTTG TACCTTACCT TTCGACCCCG
TGTTCCTGAA ATTGTTAAAT TCATAAACTT ACCAAGGACT AACCAGCCTC TGGGGAATTG CTGTATACTT
AGCAAACTTA CAATGGACAT ATTTATAAGC CATAATGATA ACTGACTAAT AGGAAATACC CTCAACTGAA
AATGAGAGAT CATCATTTGC AAATGAGTTC CCTTGCCCAG GCAACTACTG GGGAAAATGT CATGCAAGCA
AAATTAATCT TTGAAATCCT CCTTTTCCAT TTTTTGTGTC TTCCTTTTCC ATAGGCACCA GAAATATCAT
GGTGCCTGGA TCTCATCTCT ACAGAAAAAA AAAGTGATTT GATAAACTGA TTTATATTGT GTCCAAATGT
GATTGTATTT TCAAAGATAA CCTAAGGGGA GAATGCTGTC TGGCCCAACA GCAGGCTCTC GACTTCATTT
CAGACACTGT GGCCAATGGC TGGGAAACAG GTATGAACAG TAGGTTTCTG AGTCCCCTGG AATTATTCCA
TTTATGTAGC CACCTCCATG ACAGGAAGCC TCCCTACTCT TACTTCCCAG TTTGTTCATT CATGGCACCA
GGTTGCAGAT TAAAATTTGC TCAGTGACCT TTTATCTAAT AATGTGTTAC CTTCTTCTCT TAAAAAGTAC
AAGGGACAAA TGCTCATGGT ATACTTTTAG GAGATTGTGG CTCTCTATTA ACAGTATTTA TTCAACAAAC
ATTTATTGAG CATTTATATG TGCATCATGC TAGGGACTGG AACCTAGTAA GTGTAGCACA TATTATTTCA
TTTAATCCTC ACAACAAACC CATGAGGTTG GTTTTATGAT CCCAATTTTT CAGAAGAAGA AACTGATATT
CAGAACCAGT TAACTAACTG GTTCAAGGTC ATGCAATTTC TAAGATACAG AACCAAGAGT CAAAGACATG
ATTTTAAACC AAAGCTTTTT CTGCTACTCC ACATTGCTTC CCTAGGTGAG ATCTGAGGCA TTCCGCGAAA
AGAGAAGGGT CATAAAGCCA AGGGAAGACA AGCTTAGGAA AAAAAGGGA AATGTCCTAA ATAAACAGCT
TTCCTATTTA CCAGAAACCA CTAGTTTAAA AATATAATGG GAAAAATCCT ATTCACTTTA ACAATGTTAA
AAAAAAAAAA GATAGAAGAA ACATAGGGAT AAACTTAACA CATTTGTAGG ATATGTAAAG AAACTAAAAG
ATGTTAATAA TGGCCTAAAG AAAAAAAAAC TTACATGTAT GGGGAGATAG ACCATCTTAC TGGATTCTAA
TATTTAATAG TCTAGGTGTT CCATTTCTCA CCAAATTAAT GTATACATTT AATACAATGT CAAACGAAAT
ATCTTAGGAA TTGCTTACAA ATTGTCAGAT AATTACAAAG TTTACCTGGG AAATATAAGC ATATATGAAG
AGTGAATGGG ACCCCACCAC TCCCCCCAAA ACAAAAAAGG TCTGAAAAGG ACAGAAATCA AGGAGAGTCT
TGCCTGCCAG ATACAAAATT CTATTATAAA GGTGTATTGA TGAAAACAAT TAATACTAG TGTAGCAATA
GGCAGCAAAG CAATGAAACA GCATAAAAAG ACCAGAACTA TACCTAATTA TGATGAAGAT TTAAGGTATG
ATAAACATGA CATAATTCAA ATCAGCAGAA ATTGGCATAG ATAGGGTTAA GACAAATAGC TAATCATTAG
AGGGGAGGAA GGAAAGGAGG GAGGATAAAA TTAGGTTCCT GCCTTCATCT TACATTAAAA TAAATTCCAG
ATGTATTACA TTTAAATTTT TTTAAAAAAA GAAACCACAA AATACTTGAA GAAAATATAA GTTGTTATAT
AGTCTTTTGA TGGGAATTTT TTTTTTTTTC AGAGACAGGG TCTTGCTCTG TCACCTAGCC TAGAGTGCAA
TGGCATGATC ATGGCTCACT GCAGCCTTGA ACTCCTGGGC TCAAGTGATC CTCCCAGCTC AGCCCCCCAG
GTAGCAGGAA CTACAGGCAT GCGACACCCC ATCCAACTTA TTTTTTATTT TTGTAGAGA CAGGGGTCTT
GCTTTGTTTC CCAGGCTTAT CTCGAACTTC TGCCTTCAAG CACCTCAGCC TCCCAAAGAG CTGGGCTGAT
GGGACATTTT TTAACATAGT GCCACATTAC CATAAATGAA AAGCTTGTAA AATACTAATT TTTAAAACTA
ATATATATCA GAAATTTTTA TAAACAAAGT TAAAAAGCAA ACACAAAAAA TTTGTAGCAC TTATGACAAA
```

```
TATATGTATA TATATGAATA CAAAAAGAGC CTTTACAAAA CAGTAAGAAA ACAATGAATA CTCCCAATGG

AGTATTCAAA ACTAAACTGC TAAAAGCAAT TCAAAACAAA AAACATAAAC TATGCATATA TGTATGTGAA

AAAGTTTAAC CTTATCAAAG AAGTAAACTC TCAAAGAAAT AAACATCAAA TAAGGAAATA GCCTTTTCCC

ACAAATAACC AAAATCTGTA AGAATACTGA GCTGCGAATG TTTCAGAAAA AAAAAAAAAT CATACACCTA

GTTCGGCATG TAATTAATAT AGATCAGAAC ACTTTAAAAA TATTTATAGG CCAGGCACGG TGGCTCATGC

CTATAATCCC AGCACTTTGG GAGGCCAAGG CGGGTGGATC ACCTGAAGTC AGGAGTTTGA GACCATCCTG

ACCAACATGG TGAAACCCTG TCTCTACTAA AAATACAAAA ACTAGCCAGG CATGTTGGCG TATGCTGGTA

ATCCTGGCTA CTCGGGAGGC TGAGGCAGGA GAATTGCTTG AACCCAGGAG GTGGAGGTTG CAGTGAGCTG

ACATTGTGCC ACTGTACTCC AGCCTGGGCA ACAAGAGCAA AACTCTGTCT CAAAAAATAA TAATAAATAA

AAATAAAATA TTTATATACT CTGACCCATC AATTTGTCCA GCATAATTAG GCATGTGTAC AAGGGTTTAC

ACACAAGAAT GCCTATTGCA ATATTGCTTT TAATGCTAAA AAAAATTGGG GAAAATGCTT TAAAAATATA

GATTAAGACT GTACATTGTG GTACAGTCAT ATAATCAATA GTATACAGCT ATTATTTATT TTCAGCCACT

GTCCAAAATA TAGCCTGGCC TAACAACATT CTGTTAGGAT ACGCAAGCAC CGTGAGGAGA TCAGCTATAA

AGTATCAGTG TTTCACACCA CTGCTCCTTT GCTAATAACC TTCAATGGCT TTTAAGAAG TAAAAAACAA

AGGCAAAATT CCTTAGTCAG CCCTTAAGAC TCTCTGTTAC TTAGCTCAAA CTACCCTTTT CAACAACACT

GCCCTAACCA GGATGAGTTT TTTGCCCCCC TGGAGTACAT TCAGCCTTTC CTTATCAAAC CTTCCTTTAA

ATAAGTATCT TCTCCAGGAC CACTTCACTT TCTTCCCCAA TTTAGCATTT TCTATATCTC CAGGCCTACC

TCTATAAAGC CTGTCCTAAC CACTCAAACC CTAGCTTTTT CTCTGAACTG CTAGAAATAT TTTTCTCTCA

TTGGCCATTT AGGTAAAAAG GTTTTTACTG TTTATTACCT ACTCAATAAA AATTTTCTTT TTTGAGACA

AGGTCTTACT CTGTCGCCTA GAATGGGGGG AAGTGGTGTG ATCACAACTC ACTGCAGCTT CTACCTCCCA

GCTCAACAGT CCTCCCACCT CAGCCTAGTG AGTAGCTGTG ACTACAGGCA TGTGCCACCA TACCCCACTA

CTTTTCATTT TTTATTTTTT GTGAGATGGA ATCTCACTAT GTTACCCAGG CTGGTCTGCT GATCTCAATT

GATCCTCCCA CTGTGGCCTC CCAAAATGCT GGGATTACAG GCATGAGCCA CAATATCTGG CCCCAGTAAG

CTTTTAAGGC CATTAACATG AGGAACAGTG TTCTTTACAC TATTTTATCA GCTAGGGCTT TGCATGGAGT

AGGAGTTTAG TAAATGCGGT TGATGGGTTA ATCAATGTGT GAAAATATTC AGAGCCACCA AAAACAGATA

TTATGTCTAT TCTCATCAAC AATCAAAATT GAGTAAACAG CCATTTTCTA ATACAGGAAA CCACAAAACA

TTGAATGGTG ACATTAAAAA ATTCCCCCAG CAGGAGCCAA CCAATTTTTT CATCCTGATC CAAGTTAGCA

AACTGCAAAA GATAGGAAGC ACTAATGAGT GGAAATTTGA GTAGAAGCAT TTTTTATGAA GGCTGTCTTG

ACTGGATCAC ATTTTTATTG CTGTTGGAGG TGCCAAATGT GTGTGTTTAT GCTAATCCTC CACCTCAGGC

AACACACAGT CAAGGATCCT ACCAAGTGTT ACCGTCAAGT GTCTGTTGGC AGCTCAAGGC CCCAGCGTTG

TTCCCTTGCA CTAGGGAAAA GACATATTCC AGGTACAAGT ACTCCCACTT TGATGCTACA GAGGAGTTGC

TGAACTTTGT GTCATTAATC TCTCTTCGTT AGATCCCAAC CCTGTTTAAA TCCCACTATC TGCCTACTCT

GGGTCTTCAC CAATTTACTA GATCATAGTT GGAGAAAATC TACAAAGCCT TGCTCCCTTT AGATTTAAAC

AGGTCTCCGT TTAAATTTAG AATTGCTAAC TTCAAGCGGG CCCTTATGCG ACAGTATGCC TGTCAGTCAT

ACTACATTTC CTCAATTCCA TTCATGTGAC TGCTCCATAC CCTTCCCTCT CTCTTCATAC TACTATTATC

TCTTCCCCCC TCCCTCATTT TTAACTGATG ATCTTGTTTC CTATTTCTCT GAGAAAATAG AAGCCATCAA

AAGAGAGTTT CCACAAACTC CTACTGCCTT ATCTAGCCCT GTACCATATA CTTTGCATTT CCTCTCATTA

CCATGGATGT ACTGCCTATC TGTGCTTCTA TCTAAGGCTA ACCCTTCCAC TTCAGTTTTG AATATTATCA

GCTCTTACCA ACTCAAGGCC ATTGCTCTAG CAATTCTCTC ATTCTCTCTC ATTTTCTTCC ATCAAGTTTT
```

-continued

```
CCTTTTCTTC AATTAACAGA GTAGCTCCTA AAGGGAAAAA AAAGTCTTCT TTTTCAATGC TCATCATCAC
TGGCCATCAG AGAAATGCAA ATCAAAACCA CAATGAGATA TCATCTCACA CCAGTTAGAA TGGCAATCAT
TAAAAAGTCA GGAAACAACA GGTGCTGGAG AGGATGTGGA GAAATAGGAA CACTTTTACA CTGTTGGTGG
GACTGTAAAC TAGTTCAACC ATTGTGGAAG ACAGTGTGGC GATTCCTCAG GGATCTAGAA TTAGAAATAC
CATTTGACCC AGCCATCCCA TTACTGGGTA TATACCCAAA GGATTATAAA CAATGCTGCT ATAAAGACAC
ATGCACACGT ATGTTTATTG TGGCACTACT CACAATAGCA AAGACTTGGA ACCAACCCAA ACGTCCAACA
ATGATAGACT GGATTAAGAA AATGTGGCAC ATATACACCA TGGAATACTA TGCAGCCATA AAAAATGATG
AGTTCATGTC CTTTGTAGGG ACATGGAGGA AGCTGGAAAC CATCACTCTC AGCAAACTAT CACAAGGACA
AAAAACCAAA CACTGCATGT TCTCACTCAT AGGTGGGAAT TGAACAATGA GAACACTTGG ACACAGGAAG
GGGAACATCA CCCACTGGGG CCTGTTGTGG GATGAGGGGA GTGGGAGGG ATAGCATTAG GAGATATACC
TAATGTTAAA TGATGAGTTA ATGGGTGCAG CACACCAACA TAGCACATGT ATACATATGT AACAAACCTG
CACGTTGTGC ACATGTACCC TAAAACTTAA AGTATAATAA AAAAATATAT ATATATATAT AAAACAACTA
AAAATAAATC TTTTTTTTCT GCAGGATCAG TCCATCACCA CACACACAGG CTGTGTTTTA TGTTGTTCCC
CAGCTTAAGA GATCGTTCTC CAGATCCCAC TGCTCCTTCC AGTTGTCACC TCAGTTCTCC ACTTCTTTTT
GCTGATAAAC TACTCTAACT AGTTACATAT GATTTCTGTC CCCAGGTCCC CTCCCTCAGT TGTTTTGAAC
ATAATCATTT ATATCATTTA TCATTTTCAC TCTAATTGCA CAACCAAAAA CTCCCTTTTT TTTTAGATGG
AGTCTCACTC TGTCACCTAG GCTGGAGTGC AGTGGCATGA TCTCGGCTCA CTCCAACCTC CGCCTCACGG
GTTCAAGTGA TCCCCCTGCC TTAGCCTCCT GAATAGCTGG GATTATACAC ATGCACCACC ACACCTGGCT
AATTGCTTTG TTTTTGTTTG TGTGTGTGTG TTTTTTTTTT TTTTTTGGA CAGAGTCTCA CTCTGTTGCC
CAGGCTAGAC TGCAGTGGCA TGATCTCAGC TCACTGCAAC CTCCACCTCC TGGGTTCAAG CGATTCTCCT
GCCTCAGCCT CCCGAGTAGC TGGGACTACA GGCATGCACC ACCATGCCAG GCTAATTTTT TTGTATTTTC
AGTAGAGACC AGGTTTCACC ATGTTGGTCA GGCTGGTCTT GAACTCCTGA CCTCAAATGA TCTGCGCACC
TGGACCTCCC AAAGTGCTGG GATTACAGAC TTGAGCTACT GCGCCGGGCT ATTTTGTGTT TTTAGTAAAG
ACGGGGTTTC ACCATGTTGT CCAGGCTGGT CTCAAACTCC TGACCTCAAG TGATCCGCTC GCCTCAGGCC
CTCAAAGTGC TGGGATTACA GGAGTGAGCC ACCATGCCTG GCCATAAAAC TGCCCTTTGT AATATGACT
GTTGGCCTGC ACATTGTCAA ATCCAGTGGC ATTCATCTTA CTCGGCCAAC CTACGGCATT GACACTGTC
TGTCTTTCCT TCTGTTCCTC TATCTGTTTC CAGTATACTG GCCTGGCTTT CTTTTTACCT CTTTTATATG
CTCTTCCAGT CTCAGGCTCC TTTGGGGATT TGAAGGTATG TTGCATTTTG CTATTCAATG AATAATGACA
AGTAATGATC ACTTAAGACA TTAAGTGGTC AGTTCCTTTA CTAGGATAAA AATAATTTTC TTCCCAACAT
GGGGCATATT CCATTTCCAG TCTGACTGTT CTGTGTAATC TTTGTATTCC TTGGCAGCCC CTTTTATATC
AGTTCATCTA CTGTGCAGGA AATTGGACAA ACATTTGCAC TGGTATAACC AAATACAGTT GAACTTTTGG
CTTGACTCTT AGCTGAACTC ACCAAAAATA ATTTCTGTAA GAGACTGAGA CGTCTACGAG TAGGTTTTTC
AGAATTAGTA AACATAAATC AAGGATACAC AGGTAGATTT GAATTTCAGA TAAACAACAA ATACTTTTTT
AGTATGTCTA CTGAAATATT TGTATCTTAT CTGGCAATTC TACCTGGTAC AGAACTAATC CATTCTCTTG
AAAGATCTTG ACTCTGTAAT AAGTTCTTTG GTGATGGAAG GGAGGTATTT CTGTAATTAG AGTCACTGTC
TTCCTCCCAG TTTTTTATCC TGGCCCAGAT CTGCAATGAA CACACGACAG AATCCAGGGG GGATGAAGAT
GGGTGCTTTG CAGGAAAAAA AAATTAAAAA CATCTGAAAA AGCTTTTGTA CTAAAAGAAT GTGATCTAAA
AAAGAAAGCA GGAGAACTTT CTGTCTGCAC TTTACATCAG AACAACCTTG GCGTCTAGAA GCTGTGCCCT
GTGGGAAGTG GTGGTGCTTG GTAAGAGATG CCAGGACCAG TGGTACCCAC TGGGAGCACT GCCAATACCC
AGCAAGGAGC ATGGGTGCAC AGTAAGGCAT TGCACTGTGA TTCAGCATAA AATAACAATA AGGGAACGTC
```

-continued

```
ACGGAGAAAA GGCCAGACTT CCTTTGTTTA GAATGTGGGA AATGTCTTCT GAAAAATGGT AGTAAAAAAG
CATGCTTGGA TGGTCCACTC CAGGCAAAAC TGACTAATCG GGGGTCAGGG ATACAACCCC TGCATCATAT
GTTTGTTTCT GTTGGGCTGA CATGAGGTTC ACTGTGACCA CTGTGGTTTA ACCCCATAGT CTCCTGGAAA
TACAGCCAGG TCAAGAGAGC TCCACATAAA ACATAATCAA AAAAATAAAC TCAAGTTTCC ACTGATCAGC
TTTTCACAAC TCTTATCCTT TCACTAACTT TGGAGCAAGA TTTGAGAATT GGATGGCTAT TTGAGGGCTA
TTTCTGCGCT TTAGTTCAAT GTTTTGTTCT TTCTTTATTA GAGAACTATG GTTTTTTATT ATATTTACAC
TTTAAGTTCT AGGGTACATG TGCACAACGT GCAGATTTGT TACACAGGTA TAAATGTGCC ATGTTGGTTT
GCTGCACCCA TCAACTCGTC ATTTACATTA GGTATTTCTC CTAATGCTAT CCCTCCCCCA GTCCCCCACC
CCCCGACAGG CCCTGGTGTG TGATGTTCCC CTTCCTGTGT CCAAGTGTTC TGTTTATGTG ATAGATTACG
TTTATTGATT TGTGTATGTT GAACCAGCCT TGCATCACAG TCACTTGCTT ACAAGAAACA AACACTTCAC
AGATGGATCA TTATGTGTGA TAAGTGAAAT CCAAGGATTT ATGCTCAGAG GTGGGCTTAA CAGGTAGGAA
GAGCAGTATT TTCCTTCAAC CATGAGTGTA TGCAGGTTTT TCTTTTCTTT TTTGAGATGG AGTCTCACTC
TTTTACCCAG GCTGGCGCGC AGTGGTGCGA TCTTGGCTCA CTGTAACCTC TGCCACCTGG GTTCAAGCAA
TTCTCCTGCC TCAGCCTCCC AAGTGGCTGG GATTACAGGC ACCTGCCACT GTCTCCGGCT AATTTTTGTC
TTTTTAGTAG AGATGGGGTT TCACCATCTT GGCCAGCCTT GTCTTGAACT CCTGACCTCA TGAATCATCC
TTCTCAGCCT CCCAAAGTGC TGGGATTACA GGCATGAGCC ACTGCGCCCA GCCCACAGGT TTTTCAAAGA
CTAAACTTAA AAAAAAAAAA AAAATTTCCC AATGAAATAT AAAACTAAAG TGCTAAACTG TGATAGACTG
TTTTACAAGA ATGCCAGTTT TCACAAGTGT CTATAGAACA TGTAATTTAG ATAGGTAAGA TGAAATTTTG
ATAATATTTG ATGGCAAATT TAAACAGGTA TACAACAAAA ATAAAATTCT AAGCCCCTCA ACCAACTGAA
TGGACTCCTT CTCTCAGCCA AAGGAATACC AAAGTAAACC TGAAAAACTA GTTTTGGCCA GGATTGGGGG
TAGGTGGGGG AAGCCCAACA TGACTCATTA TTCTCTCCTC CCTTTGGAAT TCAGGCACAA CTGAATGTCA
GCATTGACAC TAAAACACAG ATCTTAAGAC TGACAAGCCA GACTCTTTGT AGCAGAGAGC CAGGCCCTGG
AAGAAATCAA GTTATTTTAT CCCAAAAAAT ATTTCTTTGA TATATTTTCA AATGGCCCTG CAAAGCTGTC
TCTTGTGGGG AAAATTGACA TGCTGTACAG AATTTCCTTC TCTTTCCAAG TTTTTACTGA TCCAGGAGAG
ATTTAACTAA GAGGCTAGCA TGTTTTTTTT TTTTTTTTTT TGAGGCGGAG TCTTGCTCTG TTGCCCAGGC
TGGAGTGCAG TGGCGTGATC TCAGCTCACT GCAACCTTCG CCTCCCGGGT TCAAGCGATT CTCCTGCCTC
AGCTTCCCGA GTAGCTGGGA TTACAGATCC ATGCCACTAT GCCCAGCTAA TTTTTGTATT TTTTGTAGAG
ACAGGGTTTC ACCATGTTGG CCAGGCTAGT ATTGAACTCC TGACCTCGTG ATCCGCCCAC CTCGGCCTCC
CAAAGTGCTG GCATTACAGG CGTGAGCCAC CGTGCCCAGC ACAAGACATT TACCGTCTAT TCTCTCTGAA
GCTACTATCT AGAGGCTTCA TCAACATAAT AAGACCCTTG GTCTCCACAA CTCCTTATCT TATCCTATTA
GTTTCTACTG ATTCCAGGTC TTTAGATAAT AACAACTCTT TCAACCAATT GCCAATCAGA AAGTCTTTGA
ATCCACCTAT GACTTAAAAG CCCCACTCCT TCAAGTTATC CCGCCTTTCT GGACTGAACC AATGTACACC
TTATATGTGT TGATGGATAT CTGCCTGTAA CTTCCATTCC CCTAAAATGT ATAACATCAA GCTGTAACCC
AACCACCTTG GGCACATGTT TTCAGGAACT CATGAGACTG TGTTGCAGAC CTTGGTCACT CATATTTGGC
TCACAGTAAA CTTCTTTAAA TATTGTATAG AGTTTGGCTT TTTTCATTGA CACAGGAAAA ATAAAGAATT
GGAAGGTCTT TCATCAGTCA CTGAGCCAGC TTCATATCTG ACTGAGGTCA TACAGTTCAG TGATTGTAG
CTTTGCTACT TAGATTGCTA TCCATTATCT AGAAGCATCA GGATCACGTG GGACCTATTG GAAATGCAGA
CTTTCCTCCT AGAACCCAGG ACCTGGAAT ATTCTTGGCA CATAGTAGGT GCTCAATACA TATTGAACTC
CTAGGTGCAA TTCATTAATT CATGAATTAA TGAATTAACA CGCTCTCAAA GTTTAGTGCT TTTTCACAGA
```

-continued

```
CTAGTCTTTC TGCCTCTTAA GCACTCAGCT CACCACGCTT CCAGTCTCAC TCCCCTATTA GTCTGATTAA
AATCTGCTTA CATGTGAGTC TGAGATCAAG TGTTATCTCT TCTGAGAAGT CTTCCCTCAC TGGCCCAAAG
GAATTTCTCC TCTATTTTAG CACTGTCCCA GTTGACTTGT CATTATTCTA GTCTTTTTCA TATTAGTTGT
TTTTCATATA TATGTTATTA AGGAAACTAG TCATTTCCCC TAATAGAACA AAATTGCTGG CCTTTGGGGT
TGGCAATGGA GGGGAGGCTC TTCTTGAAAA GGGGGAAGAG TGTTCTCCTA ATATTTTTCT TACGAGATTT
ATGTTGCTCA TCTTTAGCCT TTAGTCCCCC ATTGCCTGCC TACAGTTGGC AGAGACCATC TGTTCTCTCA
CTGTCAGGAA CTGTCTCAAT TCTTGAAGTT CAGAGTCAAA AAAGAAGCAA GTTTTCCTAG CTCTTTGATC
AACTTTCAAA GTTTTACTTC CATTTGAAAA TTTACTAAGT CACCAGGAGA TGGTTTATAC TGAGAAATAT
CCACTCATAC TCTTCCTCTT CAACTTTCTT CCATATACAC CCTATTACAG GGATATAGTC TTACTCTATA
GCTCAAAAGG ATGACCCTAT CAGAAACCTG CACAGTATGT AAAACATTCT CACCAGAGGT TCACTTGTGT
ATTTCCACCC TAGAATGGAA GCTCTACAAA AGCACAGAAT GTATCATTTT AACTTTAGAT TCTATTTTCA
CACCCAGTGC TTGACACATG ATTTGAAGTT AATATTTATT TATCAAGTGA TTGTTTTAAA ATCATGACTC
ACTCAACAAA GTTATAAGAA TAAGAATAGT GTTACAGAAT TGGTATACAC AAGCTGACCA TAATCAACAC
ACCTATTATC ATTTTTTTGC GACAGGTTCT CGCTGTCTCA CCCTGGCTGG AGTGGAGTGG CATGACCACG
GTTCACTGCA GGTTTGAACT TCCAGGCTCA AGCAATCCTC CCACCTCAGC CTCCCACATA GCTGAGCCCA
CAGGTGTGTG CCACCATGTC CAGCTAACTT TTTAATTCTT TGTAGAGACA GGGTCACCCT ATGTTGCCCA
AGCTGGTCTT GAACTCCTTG GCTAGAGAGA TCCTCCCTCC AAGGTCCCCC AAAATGCTGG GATCTCAGGC
AAGAGCCACC ATGCCTGGCC ATAATCAATA CACTTTTAAG AATGCTAGAA TGTTATATCA GATGCATACT
TCAGCACTAT CTCAAGCAAA CTGGGGTGTG GGTTATTCTA CATATAAAGT TCAGCAGTGT TGTTCCACAG
TCCCAAACTC CAACTGAGGT CAAATGTAGG GTGCAGCAAG GTCACTGGGG CTGTCATCAA GGGCCTCTCC
TTGCACTCTT GCCAACCCTG TTTCTTGATT GTCTCTACCA CCATGAGTCA CCAGCAATCT CCCACAGTCA
CTTGTTTAAA AGTTCACAAG TATTGTGTGA ATTGCAGGCA ACCCCTTGAC TCCCTGATTG CCTGGTCTTC
TTCCTTGGGC TCTACCATTT TTTTTCCCCA GCACTCTTTC TGCTGCTCTA AATTTTAATT CATGCAATTC
CATATGTGTT TCTCTATCAT TCTTCATCTC TTTCCTCTCC CTTCCATCCA ATTTTGTTTG TCTGTTTGCT
TGCTTGCTTG CTTTAATACA TTTCTCTTTT TCTGAGAAGG CTTGAGTCCA AAACTCTCAG TTACCTGTTG
TTCTGTTTCC CGTTAGTTAA TCTCCGAACC TTCATAAATT AAATCTGACA AAGTCCCCTG ACTAACAAAG
GAAATGCACA AGTCACAGTA AAAGGGGCAC ACACAGAACA CAAATAGACC CAGGGTCTTT TCTGTTCATC
ACTCAGCTTT TTATAGGAGA TCCAGGAGAA ATGAAGTGGA AAGGGAAGTG TGTTGAGTTA CTATACAACA
CAAGAGTAAA CTTTCTTATA AGTGGTAATT TTTTTTTACA GGAATAATTG AAAATGGAAA TTACCTTCTC
TACTCATAGT AAGTACTCAG TGCGTTCTTG ATGGGATGAG AATGTGTTTG AGCTTTAGTG TAAGGCAGAA
TTCTGTTTAG TCTGCCAGTA TTGGAGAAAA ATAAACACA AAGGGACTGA CATGTAGGAA GTGGCACCTG
GGAGGGTCTC AATTCTTCCT ATTACAAAAA TGCCCCAGAG AAATAAAAAG CTTGTGTACA TGTTGAGATG
GGAGAGTTCT CTGGCCCCCC TCGCAGGATG TGTGACAGTG GGGTGGCTCT CTGCTGCGCC ACCATGAGCT
CAAACCCCTC ATAGGAGGGG GAGCACACAG GCAGGAAGGT GCAGGAGCTG GGCGAGCTCT TTGGGCTCTG
GCCCCGTGGT ACTGTCTAGA GGTGGGTGCC TGCAACTCCT GAAAGCCCAA GTGGGCATGT GTTACAGTGC
ACTCTTTCAG CTTTGCTGTC TGCAGCTTAA GCGTTAACCA GCTCAGTTTC TTCTTGGTAC CCAGGTCCTT
GTCTGGCATC CAGGAAGAAT CAGGTTACAC ATGGACTTGA AGGATGAATG TGGGAGTTTT ATGGAGTGGT
GGAGGTGGCT CTCAGTGGGA TGGATGGGGA GCTGGAAGGG GGATGGAGTG GGAAGATGAT ATTCTCCTGG
AGTTTGGCTG TCCAGCAGCC GATCTCCTCT CCAGTCGTCC CCAGCCTCTC GACGTTCAGA TGCTCCTCTT
CTCTCCTTCT CTGCCATGCT GTTCTGCCGT TCATCTGCCT GTCTCTCTCT GGAGCCTGGA ATTTGGGGTT
```

```
TATATGGTAC ACAATAAGGG GCATGGCAGG CCAAAAGGGA ATTTTTTAGG TGCAAAAAAC AGGAATGCCT
CTTCTCACTT AGGGCTATAG ATTTTCAGGC TTGAAGGTGG GGCCTTTACC AGCGAACCTG TATTTCCCTG
TCTCCTGTGC ATATCAATGT AATCAAATAC TGGGCTGATC CAGGATGTTT CTTTAGACCA ATTATGGGTA
AAATAATTTA CATTCAGGTT TTTATATTTG CTTTTGTCAT TTCTTTTTAA GCAATCATGT AAAATATCTA
TACGACAGTA ATAGATGATA GCGAACCTAA TTAAAATTAC CAGAAACTTA AGAATCTCTA ATGATTTCAA
CTGTAACTAA GGTTATTTCT CTTTATGTTG AACAATGTTG GGAGATAAGA CACAAGAGTT TCTGAAGTAT
TTCAGAAACA CAAAGAGGGA GGTTATATAA ATAATATTTT TTTCCTACTT TGGGAAAATG AAAGCTAGTC
ACAAAGTTAA ACGAGTGGTT ATTTTAATAT TTAAAATACA GGCTTGGATG TATTTCCTGT TAAAGAAAAT
AAAATGCAGA ATATTCAAAA CGTCTGACCA CCCTTCTAAG AAAATGCATC TCTGAGGTAT TTTTCCTTAG
AAGTTATTGT AAAAATCCTG GAGAAGCTTG AACACAGCAA AGCAAACAGG ATGCAGAGTT TAATCTGTGG
AAAGCTTAGG GAAGAAAAGC AAATCATTAA AAATAGGTCT TCCTCTGAAG ATTTTTAAAA CGCAAAGAGG
GTGGAATAGC AATGATAATA AAAAAGCTGG CATAGAGAGT GGCACAATTT GCTGTGCCAC TGAGCTGACT
GGATGTGTTC TGAATTTCTA GGCATTAGTG TACCTTTCCA CACGCATTCT CCCTTTAAAA AAAATGCCCA
CACACTGAAT ACTTTTTTCA TGCAATTTAA AATAAGCGCA CCATCTAGTT TACAGAAATT CACTAGAAGT
TATTTATCCT AAAATAGCAG AGATCTAGAA GAATTTTGAG CTCTAGGACA TTTTAGACAC ACAGAAAGAA
GAATCTGGAC AAGTCTTGAC CAGACATGAC AGAATAGAAA TTTCTTTTCC TATTTATCTC TTTGAATAAA
ATTTTCAGGA TCTTACAGTG GACAAGTTTG TTATCTACAC ATTGTGAAGC ACATTGATTT CTCCTCTGTA
GCCTTAGGAA GATCTGAGAG GTGACTGAGC TGATTGAATG ATCCGTGACC GCTCTACTGG GACCAGTAGT
AGAACTTTAC TGGTGGAGAC CTGCTGGAGG TTTGAGAGCA GACTTTGAAA ATTACTAGAG CTACACAGAT
ACTGTGTGGC TAACTGGATT ATGTTTAGAG GCTTTCAGAA CTATGCTGCT GCTGCTGCAG TGTAGCCAGG
ACGCACAGAG AACATCTAAG GCTCTTGAAT GGGGCGATAG GGACAGATTT CAGCAGCCAT CTGACTTCAG
TGCTCATTTT GATGCTTTCC CTGCAGGGTG CAGTGTGCAG TGTGCAGTGT GCAGTGGTGG GAGGCTCACA
CAGGAATACT TGCTTCTGTA GCCCTAATTT CCGGTTCAAA CTCTGCATTC ACCTTGACAG ATTCTTTCCT
TGGCCAAAAT TTAGTTAGGC TTCTGGGCTT TCTCTTATGC CCACCTGCAG ACTTTTTGGT AAAATCCAGT
TTTAGTAAAG AGCTCTGCTA AGTCAGTTTA GCAAGAATCC CCACCTCAAA AGTCACTATC TCCCTCCCTG
GTAGTGTCTG GCTTGTCTTC AGCGAGAATT CTATTAGGTT CTGTTAGATT AGAATCCTCC TTACCCTTGA
TGCTTCCTCT TAGTATTTTT TCATCCACTG ACTCCTTGAC CCACCTTGCT CCTCGGCTAT AAATTCCCAC
TTGCCCATAC TCTGCAGTTA AGACTATTTT CTCCCCACTA CTGCAAAATC CCATTGCCAT GGTCCCTATA
CTATCTCAAT GGTAATGAAT AAAGTCTGCC TTACCATGCT TTAACAAGTA ACATTGAACC ATTTTTTTCT
TTAACAATCT GCTGCACAAT GAGATTACTA AAACTTTATT CCATTTTGCC ATGCTGGATG TCCTCAATGG
AATGGCTCTT GTGAGCACCA AATCATTGTG AGAAGGAAAA CCCATCTCTT ACAGCCCCT GTAACGTGAT
GTATGTTACA TGTGATGTAT GTTACATAGT TTTTTTTCAT GTTGATCACT TTTTGCCCAT TTTCCTATAT
CTTATCAGTT GGAAGACTGT GGAAGTTTGT AGTACTAAGC CACAAGATGA CTAAGAAGAG TTGAAAGGGC
AAGTGGGGCT AAAAACAGAT TTGTTTGAC TTACCCACC ATTCCCCCTA TCATGGGCT GAATCTGCCT
GGAGGAAGGA GCATCCTTAT CTTTGTACTG TGAACCACAC AGTCTAGCAG CAGCACAGCC AAGGCACTTG
GGGTTTCATG AGACTAAGTA CATGCAATTC TATTGTAAAG GCTTAAAATA TATACAACTG ACCCTTGAAC
AACATGAATT TGAATTGCAT GGTCAGTTAT ACGCAGATTT TCTTCCACCT CTGCCACCCC TGAGACAGTA
AGATCAATCA ATCCPCTTCC TCCTACTCCT CAGTCTACTC AAAGATACTT GAAGTCTACT TGAAGATGAC
AAGCACAAAG ACATTTATGA TGATCCACTT CCACTTAGTG AATAGTAAAT ATGTTTTCTC TTCCTCCTAA
```

```
TTTTTTAACA CTTTCTTCTC TCTAGCTTAA TTTATTGTTA AGAATACAAT CTATAATACA TATGACATAC

AAAATATGTC TTAGTTGACT GTTTATGTTA TCTGTAAGGC TTCAGGTCAA GAGTATGCTA TTAGTGGTTA

AGTTTTCGAG GAGTCAAAAG GTGTATGTGG ACTTTCAACT GCAGGGGGT GGGCACCCCT GCCCCCATGT

TGTTCAAGGG TCAACTTTAC TGCCAAAGGC AAGCCTTTAC ATCCACTTTT TCCATCCCAT CAGTAAATGG

AAAAAGATAG CTACAGTATC CCTGCGTCAA ATCTTTTTTT TTGCAGATCA CAAATTGGCC ACTCACCTTG

CTCTGTGAGG GGTAAAATGC CCCACTTTCT TTAGTAATAT TTAAGTTAGA TAATATTTAA GTTATAAAGT

TGTTCTTTGT AATCGTTAAT TGTAATTTTT ACATAGTTTC TTTCAAACAG AAATAGCATT TTTGTTAGAT

AACCTCCCGT ATAGATGATG AAACTCCTTT TAAGGGCTAT CTGAATTTTA ATTCCTTGAA AAGGCAGAAA

TTGGATAGCT AGTAGTCATA AATGTACTGT GGCTTCCCCC AACCATCTGG GCTATATAGA AGCTGCATCC

TTGGACTGCA GTAGAGGAGT CTTACAAAGC ACAGAGCAAC TTCTCTCCTG GGTTGCGCTA GTTATGATGG

CAATTTTAAA TGTGTACTTT TACCCAAAGA AAATCCTTAT TATCAACAAT CACAATGCCA TCATAACCAT

GGTATAAAAA ATTCAAAATG TCCCAGCTGA AGTGGAGGCA AAGACTCAAG TTCATGGAGT CAGAGTTTCC

TTGCTATTCC TCTTTTTCAA ATGACCATTT AGTAAGCACC TGAAGAAAAT ACTATGGACG GCATTGAAAA

GTGAAGATAG GTTTAATCTT CTCGAAAATC TAATTCTCCA GATGAAACGC TGACACTTAT CCACCCCACA

GACCCTATAG CAGATGTGTC ACTGGCCATC ACATTTGACA CAGAGAAGTC ATAACTCAGT CAGCACAGAG

ACATTTCCAT GAGTTTCTGA ACCATGGACA GAACGTCGTC TGTGGACAT GAAAACTGGA CTTAGAGGA

CAGGCACATC TGAGAAATGG GCAGTTTAAA GGCAGAACAT AGCACATATG TGACTGGGTT TTAGAAGCAA

ATTTACAAGA CGCACTCTTC TTCATCCTAA ATAATCTGCA ACCAAAGCTT CCAAAAAAGA CAATTTAGGA

ATGCAGAGGT GAGGAGTAGG GAGGGGAATG GGATGAGAGA GAGTGGAGAT TAATGGTGGG CAGAGCGAGG

TTTAGAACTT AGTGGTTTCT TCAGGTTCTG AACTGAAATT TGTATACTGT AAAGGCACAA ACACCATTTT

TAACAAAAGT GAGCAGGACT TCCTATCTGG TTCAGAAAAT AGGTGAATAA ATAGTACGAA TTATTAAAAA

TAATAATTTC CACTTATACA TAGGAAACTT GATAGGAACC ATGATAAATG CTTAACTCTT AATCTTCAAG

GAACTCTGCT AGGGATATAA TATTATAAAT CTTGTTTTGC AGATGGAGAA ATTGAATTTT AACCCAAGTT

ATCATAACCC TTAAATGATT AAATGATACT GTTACATGAG AAAGCTGCGT ATCTGTTTCC TGGATTTGTA

GCCATAATTT GTGTCTCAAG TCCCTTTTGC TGCCAGCTAT CTTGGGTAGG TGTGTTCCCT TTGGGCTGTT

TGATACCCCC ACATTTATCT TTTTTTTTTC TCTTTTTTTG TTGAGAGAGT CTTTCCCTGT TGCCTAGGCT

GGAGGGCAAT GGCGCGATCT CGGCTCACTG CAACCTCCGC CTCCTGGGTT CAAGTGCTTC TCACGATTCT

CTTGTCCCAG CCTCTCTAAT AGCTCGGATT ACTGGCATGC ACCACCACGC CCACCTAATT TTGTATTTTT

AGTAGACAAG GGGTTTCTCC ATGTTGGTCA GGGTGGTCTC AAACTCCTGA CCTCAGGTGA TCTGCCTGCC

TTGGCCTCCC AAAGTGCTGG GATTACAGGT GTGAGCCACC ATGCCTGGCC CCAAATTTAT CTTTAATGCC

CCAAATTATC TAGTTCCCAT GACTGGGCTT CTGCTTTGAT CCTTTCTGCA CTTGCTGGAC CCTCTCCCTG

GGAAATGAGA TTGTGTCCTG AGCCCCTAGT TAGAGGCTAT GTCTCTGCTG TTCCTGAATG GGCCTCCTGG

ATGAGACCTC ATTAAAAGTC TAATTCTCTT GGAGAATTGA GAGATACCTA TTTGTCTCAA AATCATTGAA

ACCAATTAAT GTATTATGAG CCTCTATCCA GTGATTTGTA CCTCAATTCC CCAATCCAGC TGTCAAGGCC

AATTTTTTCT ACCTTACCTA GTAGGTAAGT CTGGAATTGT AGCTGTGGCA TTTTGAGTAA TGGTACTCTA

GGTTAGCAGT CCCCAACCTT TTTGGCACCA GGGACCAGTT TTGTGGAAGA CAATTTTTCC ATGAAGGGCT

GGGCAGGGA GTGGTTTCAG GATGAAACTG TTCCACCTCA GATCATCAGG CATTAGATTC TCACAAGGAG

TGCGCAAGCT AGATCCCTCA CACATGCAGT TCACAATAGG GTGTGCACTC CCATGAGAAT CTAACACCGC

TGCTGATCTG ACAGGAGACA GAGCTCAGGC AGTAATACTC ATTTGCCTAC CGCTCACCTC CTGCCGTGCA

GCTCAGTTCC TAACAGGCCA CGGACCAGTA CTGGTCCACG GCGCAGGCAT CAGGGACCCC TGTTGCTAGG
```

```
TATAAGCATC TGGCTGCTGC ATGTCTTCTG TGTAGCTACA TCTGTATGTG TATCTGATGA GATATAAATT
ATTTGATTAT AAATTACTTT CTTCATATTA GAGTTGTGAA TGAGTATCAC ATATAATTAT ACATAAACTA
GGAATATGCT TTTTAATAAT GTATATAAGT AAGTTTCCTT AACTATGACT TTCATCTTAG CGTAGTAAGA
GGGTGCTAAG AAATATTTGT GATGAAAATA GGCATTGGTA GAGTTGAGAC CACTGGGTGA TGAAAGAGTG
TAAAGATTTT AAAGCCTTCA GATGCTGGTT CAAGGTGAGA AATGTGATTG GGAGCAAATC AATTAACTTC
TTGAAGTCTT ATAGGGCAGT TATGAATACT TAATGTTAAC ATATGTAAAG CTCTTCTGCC CTGTATACAG
TAAATGCTAG TTAGCTATTA TGATCACTAC TAAAATGGGG ATGACATAAA CCTCATAAGG TTTTAAGTAT
TATGCAAGAT ACTATACAAA GTCCAGTAAA TATCACATTC AATTGAATCC ATGATGTCCG ATTATTTTAG
CTACTTCCAA GAGAGAAAAA AATGCTGTCA GTTTTACTGT TCTTATAGAG AGCAAGGCAG ATCCCAATTC
CCAATGTGGT AACGTGAAAA TTTTTGCATT TGAATCAACA AAACACTTTC TCCTTTCTTT CCTACTATTT
AACAACTGGT AAGTCTATAC TCCCCCAAAT CTGGAATTCT CCTTTCTTAT TCTTTTCCCT CCTACCAAGA
CCGCAGGATC TTTTACTTGG CTATAAGGGG TAAACCTCAA GTAGTACAAG TTCTCTGTAT TACTTTTATA
CTCTGTCACA GATTCCCTTT GTTTCCTCAT CTCCATGTGA ATTTAGTTAA ATTCTCAGCA TTCTGATCCT
TACTATACAA GGTAAATGAA TATAAAAACA AAACGAAACA AAAACCTCTT CCTATTTACA TAAGGCCCCA
ACCTAATATT TAGTGATATA TATTAATGTG AACAAGGAAC TAACGAAGAC TGGGAAGAAA TTCACAGACT
TGAGAGAAGA AATGGCAGGA TTTCCTGGGA ACAATTTCAT GTAACGTCAA AGGTGGTAAA AGGTCAAATA
GAATGAAGAT GGAGAATACC GGATTTTCTT ACAAAATGAT TTCCCAGGAG ATCTCATCAA ATGCACGAGG
ATACCTTCTC AGTTTCACCT AGTGAGTAAA AGACTGGTAA CATAGCTCAC TTACAATTTG GATAAACAAA
ACTAAACAAA CAACATCAAA ATTTCAGAAA AAATAATAGC AAAACAGAAA TCAAACACTC AAATTTTTGG
TCCTTCTGTT TATTTCATTT TGGATACTCA GTGAATGTTA ATTAACCAGG AAACTTAAAA GTTATTTCAA
TTATGAACCT CTTCAATCCT TCATCAATTA TTTTGAGTAT TCTGGTCTTA AAAACATCTC TTTCTTCTAC
AAACTTCTGA AAGAGATGAA CACCTCCACC TACACCAAAA TAATGTGCTT TGCTGGCCAA AAGTACACGT
CCATTTTTAC TTAACAGTCT AAGGAAAGTC TGGTGCAAAT TACTATAATA ATCTGGGTTG TAAATGGTTT
CTGAGGTGAG AATGAGATCA TATTTTACAA AAAGTTTTTC ACTACTTAGT ACAAGCTTAC AAAACTCAGA
CCACTCACCA GAAAAAAATC GGCATTTATA TAGTTGTGTT ACTTTTGGTT TCCTGCATCT TTTCACATCT
GGCTCATTTA CATCATTTTC TTCATCTTCC AAAGTGGAGT TAGCTACTAC ATTAGGTAAG GTTACTTCAT
CAATCACCAT ACTGTTATAA TCTTGAAAGT GAATTTCTTT GGACCCTCCC TTGAATGCAG TTATACCTAG
TAAACCTGAT CCACAACCAA GATCCAAGAC TTTTTTCCCA GCAAATTTCA CTTTGGCCTT TGTGAAATAA
GCCAGGAGGT CAAAGGTACA TTCCCAGATT TTTAAGCCTC CCTCATAAAC ACCTGTAATC AGATCAGAGT
GAGAAGAAAA GCTTTTTGAA ACTATGTTTT CTCCAGGGAA GTTCTCTTTC AACAAGATGG TTTTCACTAC
TGATAACTTA ACATGCTGGA AACCTGGTAA TGTTTCTATG ACTTTATTTT CTAACATCTT CTTTAAATCT
TTAGGCATAG CATGCTCTTT GGCAGCTCTC AAGGAGGGCT GTTTTCCATG TGGCTCCAAG TTCCTTGAAC
TGCTGGCTGC ACTGAGTGGA CTGTCTGTGT CTTGAGAGGG AGCTGCATTT TCCATTGACT TATGTTCCCA
CAAGTGATCC TGAGGCAAGT CAAATTGTTC TGCAGAACAT TTTCTGTCCC TCTCTTCTCC TTTTTGACTT
TCTGAGACTG ACAGCTCTTT TGAGGAATCC AGGGTCAAAG CTCCATCTCT AATGGGTGTT AATTCATTTT
CCAGATGGTC TTCTATAGTG AAATTAAACT GAAAGGTCAT CCTCTTATTA AATGCACACA ATCTTTAAAT
TCAGATTCTT CAACTTCTGG ATAGAATTTG ATGATACACA CAAATCTGCC TCAATTATTC AATTAGTTTT
GTTGGGCCCA ATTTCTCTTT AGCAGCTTAT ACATGGTAAC AAATATTTAG AGATATTTCC AAATGACTTT
TTAGACGTCT TTGGTCCTCT TTCCAAGCAG CTCTGGAAAG AAAAAAAAAA AAAAAAGAAA GAAAATGATG
```

-continued

```
ATTAAAGCAA AATGGCACAT TTCACTAAAG TGTAATATTA AACAGCCACC CCCACCCCTC CCTGTCCCAC
CATACAGCTG CTTTTTCTTA AAAAGTTGTG GGGAAGAGAG AGAGATAAGA GATTTGGACA CTCATACACA
CCTTAAGGGT TCCAAAGTGG GAGAAGAAAA TCAACTATAA AAACAAACAG AAGAACAACA GCAACCACCA
CCACTACCAC CTGGACAAAC ATAAAGTCCA AGATATTCAG ACAGGACAGC CTAGCTACTT GCTGTCTTTC
AGCTGTCTTG ATTTGTGTCC AACCATATTC ACCCCCTAAG CTTCCAGAAT AACTTCACTT CTGTCTTTTA
CAGAAGAGGT GCAGTATTTT ATTTTGGTAA GTCAGCGTCC CTTTAAAAAC ATGCATAGGT ATGGCCTGGT
GTGTGTAAAT TCATCCAAGA CTTCACTCCA AACATTTAGT CGAGAACAGC AGCCCTAAGT GTATAGAAGT
GGGGGTAATT TGGCAATAAT TAGTAAAGAC TAATTCGGTG GCAGAGCAAA CGCAAACTAG GGCACTGCAG
TAGTTTGGAG AGACCTGTAG AAATAAGAAG CAACTTTATT GAGAATCTTC TATCTACTGC GCTAGACACT
ATACCATCTG CCTCAATTTT CACAGTTCTG GCAAGTGGGA TCTTTGTTCC CTTTATACAA GATTTACAAT
TTGGGGGAGA GGCGGGTCAC CCAGTCCCGC GGCTAGGAAC GCGCCTCTTT CCTCTCCCAT CACGCTGCAA
GGCTTGGAGT CACTTCCGGC TGCAGGTCCC GGAACAAATC CGACCCCAGA AGTGGGGACT TCTGGCCCTC
ACCTCCCCAT TTGAATGTAA TGTTTACAGT GATCCAGACC TGGGGATGCT TGCTTCCCGA CGTGTCCTGG
GATCGCGCTT CTGAAAAAGC TCACCTCACA ACGCCTCCTC CGGACCTAAA TCGCGCACCA GTGAGTCGAG
TCCTCCAGGG GCTAGAGAAG CCCGACTTTC TTTCCGGCCT TGAGGGACCC GGGCTCACCA AGAAACCAGC
CGCCCTCCTC TCTATGGTTT TGGAGCCGGC GGAGAGCGCG CAAGGGTTGG CGGGACTGCG AGTTTCCGGT
CTGGGCTTTG GCGGGTCTGG TTTGAAGCTC TCCTGTTTGA CGAAAGTATG TCTCAGGAAG GTGCGGTCCC
AGCTAGCGCG GTTCCCCTGG AAGAATTAAG TAGCTGGCCA GAGGAGCTAT GCCGCCGGGA ACTGCCGTCC
GTCCTGCCCC GACTCCTCAT ATCCTTCCTT GGTTGTCACT TCTACCTAGA GAAGGGTGTG GGCGGGTCGC
GAACCTTTCT CTTCTGTCCC TTCAGACCCA CCGCCAGGCT GGGTTATATT ACCGCGGCCT GAACCCCCTC
TTTTCTTTGT CAGTGAGTGG GATGAAAAGT GAGGGACTGG AGGGGAAGCG ACAACCGTGG TAGATTTAAG
TAAGGCTTTG GCCCTGGAAA GCCTCGCGGA CGTGTTCTGA CCCAAGGTTT TAGCAGTGGA TGTGGCGTTT
TCTTCCATTC CTTCTTTCAG TTTTTCTGTA CTCGTTGCTT GCAATTAAGT GTAAATACTT TTGCTAGTGG
ATAATGGGGG AGGCAAGGAC TGAGACCTGC GGTATGACGA TAGCTCTGGC TCTTAATAGT TTGAGGTAAA
GCGAGATACT CTGAGCTTTT GTCTCCCGTA AAAAGGGTGG TGAATATGAA TAAGGGCTTT CTTAGCGTTA
TAAGAATTAA AGGGCATAGT TCTGTGGTGT GAAATCTTTA AAAGATGTTC AGTAAATAAA AATGATTTTC
CTCCTTCCCC TCTCAGACCT CTTTTTCTTC TTTCTTTCTT TTTTTTTGAC AAGTTCTCAC TCCTCTCACC
CAGGCTGGAG TCTTTCTGAA AGAGTTCTTC CGCTTGTTGT TGGCTTTCAA CTGTTGGATT TGAGGCGCTT
AGCGCCTTCT TCGTCCGGGT GCAGCACATT CTTGATTGGT CTCATGCCTT TGTGGTTGTA AATGTGCCTG
GAATCCTAGC CTTTCATGGT AAACCATATG TATATGTATC TTTTTCACAA CATTTGAGCC CAGCTTTATA
CAATTACACT CAAAAGAAAA AAAGTAACCT TCACTTGAGA GAATCTCAAT ACTGCACAAA TATTGTGCAG
CTAAAGCCCT ATGTAATCAC ATAGAAGTCA TTCACCTAGG CATTAGCAAA ATCTCAGAAG GTGCCAAAGC
CCCCTTTTTT AGTTTTTGTG TAGGTACAGA ACTGCCGTCT TCAAGGAGTT TCAACTTGAA AACAAATAGC
CACCCTCAAA ACATTCAAAA ACACTTAAAC TGCGTGCATA ATGTGTGTGA GACATGGTGT TAGGCTTTGG
GAGAACAGAG ACACGGAACG TGATTCCTCT TCTTCCCCAC AAGCTTATAG AGAGACTTCA TTAAGTTGAA
AGTCAACATT CCCACCTAGC TTTGCACTTC AAACGACATA TTCAAAAAAG CCCAAACTTC CTCTAGTTTT
CTTCATCTGA GTAAATGGTT TCACAAACTG AAACCTTGAA TCCTCTCTGT CTCACACACC CGATCAGTAA
GTTCTATTGT TTCTGATTCC AAACTATGTC TTGAATCAAT CCGTTTATCT CCATCCTCAT TGCTACCACT
CTGATTCCAA ACCCTTATCA CCTCTCACTT GGAGTATTAA TAGTTTCCTT GTTTCTACTC ATAATTCATT
ATTCCAAAAA AGTTAAGAGG GGAAAAACAT AGATCTCGTC ATTTCCCTTT TTAAACCACT TTACCTTCAA
```

-continued

```
GGTTCCAGGT GATCTAAGCC TTGCCCTTCT CTCATACCTA GTTAATTAAC TACACTCTGT TCATGAATAC
ATTAGGCTCA CCTACCTCAA GATCTTTTTG CTCAGCCTGA TTTGTTCTCT CAGCCTTTTG CATATTTCAT
GTTTATGTCT TGGCCCAAAT GTCACTTCCT TAGAGGGGCT TTTTCAGAGC CTTTAATCTT AGGCAGTTCC
CCCAAACGCA GTCTTACACT TGTATCACAT TGGCCTGTTC AGTTTTCTAA AAAGCACATT ACCATTAAAA
GAAATGCTCT TGTTTGCTTT GTATATTTTC CACTTCTACA CATTATGTTG CAAAGTTCAT AAAGGCAGGA
TGTTGATTTT CTTCACAGCG TTACCCTCAG CACCTAGAAC AGTGCCTGAC ACATAGTAAG CATTCATTAA
AGGGCTAAAA ATATTTCATG TTTTAAAAAT ACTTGGGAGT CTAATTAGAC AATACTTTTT TTCAGCTTAA
TGGTAGTATT TTAGCTTCAC TATTTTAACA AATGAAAAAT TTGCAATAAA TCTACAATGC CATTACCCCC
CAAAATCTTT TTCATGTTTT GCATTTTACG TATTATTTTC CAGGCCTTAC CTGCATGTCT GCATAATCAT
AACTGACTAA TTTTGGAACA GCTGGTAATT ATTTGAGCTT TACTGAAATT TTTTCATGAG GCCAATTCTA
CCCTACTGAA CTCAAATTTG AGTTAATGAT GACCTCATTT TGATTGCTGC TGTAAAAAAT AAGATTTCGG
AAGAGGAATG AATTCTTGTA TTACTGTGGT AGGACTATGG GTTTTTTTTT GTTTGTTTGT TTGTTTTGAG
ACGGAGTCTC ACCCTGTCAC CCAGGCTGGA GTGCAGTGGT GCGATCTCAG CTCACAGCAG CCAGGTTCAA
GTGATTCTCC TTCCTCAGCC TCCCGAGTAG CTGAGATTAC AGGCACGTGC CACCATGCCC GGCTAATTTT
TTGTATCTTT AGTAGAGATG GTTTCACCAT GTTGGCCAGG CTGGTCTCGA ACTCCTGACC TCGTGATCCG
CCTGCCTCAG CCTCCCAAAG TGCTGGGACT ACAGGCGTGA GCCACCGTGC CCGGCCGGGT TATTCATTTT
TCTTATTAAC ATTCTTTGAT GATTCTTATG GTGTTGTTAC AGTAAAACAT TTCTAACAAT TATTCTAACA
ATTATTCTTG ATGGTGTATA TGAAGAATTT ATTGTCGTGT ATTTGTAAGC TGCTATGTGC AGAAGAATTT
CAGTCAAATA AAGTTGGTAA GATAGGTATG TAAGTAATAT CAAAAAAGAT AGAAGGTGAT GAGTGACTTA
GGTATAAATT AAGTACAATA GAAATGTTGA GGAAAGAAAA ATTTCTTGTA ATAGAAATCG GAAGTACAAA
CTGGGCATGG TGGTGTGCAT CTCTAATCCC AGCTCCTTGA GAGGCTGGTA TGGGAGGATC ACTTTAGCCC
AGGAGCTTGA GGCTGCAGTG AGGTGTGATC ATGTCACCGC ACTCCATCCT GGGTGACAGC AAGACCGTCT
CTCTTTTTTT TTTTTTTTGA GACGGAGTCT CGCCTATGCT GGAGTGCAAT GGCGCGATCT TGGCTCACTG
CAACCTCTGC CTCCCAGTTT CAAGTGATTC TCCTGCCTCA GCCTCCTGAG CAGCTGGGAT TACAGGTGTG
CGCCACCATG CCCAGCTAAT TATTTTGTAT TTTAAGTAGA GACGGGTTCT CACCATACTG GCCAGGCTGG
TCTTCAACTC CTGACCTCTT GTTCGCCCAT CTAGGTCTCC CAAAGTGCTG GGATTACAGG TGTGAGCCAC
CCCACTTGGC CCCGAGCGAG ACCCTCTCTC TAAAAAAAAA TAAATAAATA AATCATAAAC CTGTGGATTA
TTGTAGCATT GTTTCTCATC TGTCAAAAAT ATTTCATGAC TATGCATAGT TTGAAAAGGC AAGTTTGTCC
CTGGGCAATT TTCAAAATAT TTCTTTAATG TGTTTTCACA ATACTGTTTA CCTAATAAAT CTTAAGTTTT
TAAAAGCAAA ATTAAGCCAG TAATTTGAGT CCAATTCCAA TCTCTTATGA GTCATTGCTT AAATTTCAAA
AGGGTTTTAT TTTTTTTTTA GGTTTGTTCT GAGTAATGAA TACCCTATTA CTATGATACT AGTATCTTCC
TTAATTATCC TACTCATTGT CTCAACATTC TGACAGTTGG ATTGAGCATA TTCGTAAGTA AAATTGTTTT
AACTGTATGA TGTACTTTGA TGTTAAGGTC CGAGTCCCCA CATACCTCGG TAGATGTGTT CTTACAGTTT
TGTATTCCCT TGAAATGTAA CTGTTCTCTA TGTTACAGCC TTTATAACCT TCAGTTACTT GAAATGAACA
AATTCATTCA AATTCCAGCA CTTAAAAGTT TTAAATTACA TTTTGGATAA ATACCAAAGT GTTTTGTTGA
TGATGTATGT ATAAACAAAT TGTAAATATT AAACGTTAGT TGTTACGATT AGACCTATAT AAAACATGAT
ATGCAGTCTA CTGAATAGCT ATCAGCCTCT AACATGTTTA GTGTCATTTA GAAAATGCTT TCTAAATTGC
CAAAAGCTGA TTGTCTAGGT GATAACAAAT TTACCATTTG GAGGAAGTTG ACTTTCTCAT TTTCATGTCT
TCATCAGTCT TACTTGATGA GATTCATTCT TCTAGTCAGA AGAGAGTTTA GACTGCTCAG TTTACTCATA
```

```
TTTTGAGTTA GCTTTTCTAT TTAGAGTTCA CTTGGTTGTG GAATATTCAT TTATAATTTG AATCTACGTT
GTGTAATGGG ACCTAATTTT TTTTTCCTTT GTTTTTGTTG GAGTCTCGTT TTGTCACCCA GGTTGGAGTG
CAGTGGCGTG ATCTTTGCTC ACTGCAACCT CCACCTTCCA GGTTCAGGTG ATTCTCCTGC CTCAGTCTCC
CAAGTAGCTG GGATTACAGG CATGCTTCAC CACGCCTGGC TAATTTTTGT ATTTTTAGTA GAGATGGGGT
TTCACCATGT TGGCCAGGCT GGTCTCAAAA CTCCTGAGCT CAAGTGATCC TCCTGCCTTG GCCTCCATAA
GTGCTGGGAT TACAGGCGTG AGCCGCTGAG CCTGGCCCCA GAGTTTGTTT TGTTTTGTTT TCAAGACAAG
ATCTCACTCT ATTGCCCAGG CTGGAGAGCA GTAGTGCGAT CATAGCTCAC TGCAGCCTGA ACTCCTGGGT
TCAAGCTATT CTCCTGCCTC CATCTTCTAA AGTGCTGTGA TTACAGGTCT GAGCCATGAT GCTTGGCCTG
TGTTTTTGTT TGTTTGTTTT GGGGGACAGG GTCTTGCTTT GTCACCAAAA CTGGAGTGTA GTGGTGCGAA
CATAGCTAGC TCACTGCAGC CTCCATCTCC CACGCTCAAG CAATCCTCTC ACCTCAGCCT TCCAAGTAGC
TGAGACCGCA GGTGCGTGCT ACCATGCGTG GCTAATTTTC TATTTATATA TTTATTTTTT GGTAGACATG
AGGTCTTGTC ATGTTTCCCA GGTGGTCTTT AACTCCTGGG CTCAGACAGT CCTCCCGCCT CAGCCACCCA
AAGTGTTGGG ATTACAGGCG TGAGCCACCA TGCGTGGCAT AATTTTTTTT AAGTAAATTA TTTTTTTATC
TTGAGTATAG AAGTGATTCA TGTTCATTGT GGAAAATATG AAACATATAG AAAAACAGAA AAGATTACAA
AACATCTAAT CTGAAATGGT TAAGATTTTG ATGAGAACAG TCTCATCTCA TTTCCGTATA TTCCTGCCAG
CCTATCCATC ATTCTTCGTA CATGTTTATC TACATTAAAA TTGGTGTTAT ATTTTGGAAA CTTTTTGTTT
AACTACATTG TGAACATTTT TCATGTTTTA AAATGTCATT TTAATGATGG CAGATCCTAT TCAATAGATG
TACACACACC TATTTAACTG GTCCACAATT GTTGGATATG TAGGTCGTTT CCTTTCTCTC TTTTTTTTTT
TTTTTGGCTA CTACTTAATA GTTTCTCTGT ATAGAATGTG GTATTTTGAA AGTGTATCAA GCTTTAGATT
GGTAGTATTC TTGCATTTAA TAAAGGGCAG TGGCCTTTGT TGACTGACAT GACAATATTT TTATAAAATT
TGTTATTTGC TTTACAGAAA TTTTGAAAAT TATTGTAGAA ATGTTTTTAC CTCATATGAA CCACCTGACA
TTGGAACAGA CTTTCTTTTC ACAAGTGTTA CCAAAGGTAT AATACTATTA CCTGAAAATA CATGTTATAA
GGAATCTAGC CTCAGTCTTA GATGATTTAT TATTAATTAT GGCTCTCTTT TTCTAATATA TCAAATATAT
TCAAATAAA AATAAGGAGT AAGTAGATCT CATGTGAGAC TATAATGGTG TTAGTGTGAT CATTAGGCAG
TTAAAAACTG TTACAGGCTG GGCACGGTGG CTCATGCCTG TAATCCCAGC TCTCTGAGAG GCTGAGGTGG
GCAGATCATC TGAGGTCAGG AGTTCGAGAC CACCCATGGT CAACATGATG AAACCTCGTC TCTACTAAAA
GTACAAAAAA TTAGCTGGAC ATGGTGGCAG GTGCCTGTAA TCCCAGCTAC TTGGGAGACT GAGACAGGAG
AATTGCTTGA GCCTGGGAGG CGGAGGTTGC ATTGAGTCAA GATCGTGCCA TTGCACTCCA GCCTGGGCAA
TAAGAGCGAT GCTCCGTCTC AAAAAAAAAA AAAAAAAAA AAGAACTTAT ATTTTCAGAT TGTGTGGTTC
CTTTACTAAC TGAATTTAAA TTATTTGTAG TCAATTTTAA ATGCTCTTGT ATTTTAAAGC CACTGTACTC
CAGCCTGGGT GACAGAGTGA AACCCTTAAT TCAAAAAAAA AAAAAAAAA AAGAAAAGCT GGAATATTGG
CAAAATCAAG TAACTAAGAG AAAACATTAA ATTCACAGAA TACATTATTA CATTTTAGAT ATATATGGTA
TATGTTTTCT CTGAAAAGCA CAAGCATACC TTTTTTGTTT TAAATGGAGG GAACTAAAGA TACTTTGGTG
CCAAAATGAA ACATTATTTG TAATTAATCT CTTATTGAAA TGGGTGTCTA ACTTTAGCTT TGAATCGTAA
TCTTTCAAAT TTCTTGTACT CATAGTCACT TGATGATTCT CTATCTGAAA TATTTCTTAG AATTTGTTCT
TGACCACCAG AAAAAGATTC AACTGTTACA TAGATGAAAA TGGATGTTGA GTGTTAACAG GCCTATGGGA
AACAGTATTT TCTTTAGCTA CATTGTATTG TTGACTGTGT TGCTATTCTT ATAATGTTTA GGTCATTTAA
ATTGTTAGAA AGATCCAAGT ATTAAGATCT AGGGTGGCTA ACTTTTCACA GACAAAAAGC TTGTTTGTAA
GGTCATTTAC TATACCCTTA ATTCAGGAAG GTTAGCTTGA ATTGGGTCAA AAGGAAACTG GTTAGAAAAT
AAGTGAGTAG TGAATAGGCG ATTCAGTGCA AATTCCTTCC AGAAAATACC CTTGTAAATG ACTGTATGAA
```

-continued

```
TGTGGATTCT TCAAGACAGT CAAATTTATT GTGCGAAAGT AATACTTTTA TTTTTTGCAT CTCTAAAACA
TGAACTTTGA GTGATTTTTT AAAAAAATTG ATGCTATTAA ATAGATTCAA ACCATAGAAA TGGAAAATAA
ATTCCTGTTT GGGGCTTTTG GGGGATTAT GTTGTAAAAA TACCTTTTCT CTGTATTTTG TGCTTAATTA
GGTACAATTG TTAAGCTAGA TGATAGCCTG TGGATGTTAC TAGTGCAAAA TCAAATTATC GTATTGTGTT
TTCTCTGTAA AGTTTTGTCT TGTCTTTTCT AGTGATTTCT CTTATTCCTG TTTATTACTT GATTTGTTTT
TACAGACTGT GAAATTATTC GATGACATGA TGTATGAATT AACCAGTCAA GCCAGAGGAC TGTCAAGCCA
AAATTTGGAA ATCCAGACCA CTCTAAGGAA TATTTTACAA GTAAGTCAAA TGTATTAGAA AGCAGGAGAG
AGAGGGAGCT TAAAGAATGT CAAAATTTTT ATACTGATAC TGATTAGCTA TGTATTCTTA TGTAATGGCC
TAATGTTGGA ATTAAATTTA TAGAATTAAA GACGTGAATA TAGAAACATG AATTCTGAAT AATAAACTCT
TATAAGAAGA GAAGTCATCA AGCTAGCTGA CCCTACCTGT ATTTTCAAGG ATATGTGTGG AACACCTGCC
ATGTGTTTTG AAGTTTGTGT TAGTATTCTA AATGGCTAGA CAGTTGTTCC AGTATTTGTA GTTCTGATAG
ACTAAAGTTC TGTGAAAAGA GGAAGAGACT GTGTTTTGTT CATTGCTGTA TTTGTAGCAC CCAGCATGCT
GACTAATACC TTTTCAGTGC ACAAAAAATA TATTCTAAGT GAAATTTCCT TCCTTATTCA CAGACAATGG
TGCAGCTCTT AGGAGCTCTC ACAGGATGTG TTCAGCATAT CTGTGCCACA CAGGAATCCA TCATTTTGGA
AAATATTCAG AGTCTCCCCT CCTCAGTCCT TCATATAATT AAAAGCACAT TTGTGCATTG TAAGGTGAGT
AAAGGTCTAA TTATACTTTG AATGGTATAT AATCAATGTG CATAGGGGCT GAGTAAAATA ATGTTTGTAT
AAGATTTTAC ATTTTAGTCT ATATTATTGA AATAAACTTT TCCATAGAAT AAAGAACATG TAAGTAAATA
ATTGTTGCAA AAAAAGTGGT TTTAAGGAAG TCATTAAAAG TGGCTTTTTG GGGTTTTTA GTTTTATCTT
ATTTCCCCTC TATAAAGAAA GAAGTTTTAA GAATTTGTGT TGAGACAGAC ACAGGGATCC TGAAATAGTT
ATGTCATGTT GCATTGACCA ATATTCAATT ACCATTATGA TTAGATGTCA GAACTTCCTT TTATAAAGGA
AAGTTAATCC TTATTTAGTC CATCTCTACA TGCCAGAGGT AGCCTTGAGG CACAAAAGCT TGCCTAGAAT
TTATGGGTCA CAGACAGTTT TAATATTGCT ATTTGTTGGG CGAATGAAAA TCACTAGTTA ATTAATACCT
CTCTTTGCTG ATAGGATGCT AAAAATGTCA CGCACCTGGC CTAATGTTAC CCTTTTTTAG TTCTGTATTT
GCAAGATCAT GGAAGTCAGA AATAATATTT TATACATGCT TGCATCTCTT GAAGCACACT ATATTTAATG
GATGTTCACT AAACAATGAA TGAATATGTG ATTCAGTAAA TTTATGATCT CTAATAGTAT GAATTAAAGT
AAATTTGGCT CTTGAGCTTT GATTTGTTTT TTCTCTCATT TTTATTTATC CGTAATCAGA ATAGTGAATC
TGTGTATTCT GGGTGTTTAC ACCTAGTTTC AGACCTTCTC CAGGCTCTTT TCAAGGAGGC CTATTCTCTT
CAAAAGCAGT TAATGAACT GCTGGACATG GTTTGCATGG ACCCTTTAGT AGATGACAAT GATGATATTT
TGAATATGGT AATAGGTGAG TGAAGAAAAC TTTCTGCTTA GTATATGGTG ACTATAAATC ATGTATCAAT
TAAAATTGTC TCTAATGATT CATGTTATTT TCTTACTAAT TATGCATTAA AATTGATTTA AATCTTACCA
AATAAATTTT TAATCTTGAA ATTTGGAATT TGTAAAATTT ATTTTGGGTA CCTTAACCTA GATTTGCGTA
TTTAGTTACT GTAATTTCTC CACAATGATT AACTTATATA ACTTTATAAT CTCTGAGGTT GTCCATATTC
AGAGACAATA ACTTTCACAT TTTTTTAACC ATAACTGATA TTGAGATGCA GTTTATATTT CCTTCCAGAA
TACATATAAA TACGTGCATA TGTGTATGTA AATATGTCTA TTCTCATATA CATATTATAA TGAAATAACT
CATTTTACAT GTGATGCACT TTATACTAGT TTATTTTTAT TTTATTTTAT TTTTTGAGA CAGAGTCTCA
CTGTGTAGCC CAGGCTGGAG TGCAGTGGCA CAATCTCGGC TCACTGCAAC CTCGCCTCCC GGACTCAAGC
GATTCTCCTG CCTCAGCCTC ATGAGTAGCT GGGATTATAG GCGTCCGCCA CCACACCTGG CTAATTTTTG
TATTTTTAGT AGAGACAGGG TTTCACCGTG TTGGCCAGGC TGGTCTTGAA CTCCTGACCT CAGGTAATCC
ACCTGCCTCA GCCTCCCAAA GTGCTGGGAT TACAGGCATG AGCCACCGTG CCCAGCCAAT ACTAGTTTAT
```

-continued

```
TTTTAAAGAA TTGCTGGTCG TAACACACTT CATTGATTTT ATCACTCATT AATGGATTAT GAACAAGAGT
TTGAAAAACA ATATAAAGGC AAAGTTTGCA TTCAAAACTT TGGTATAAAG AGAGTAAGTT GGTTTTGTGC
AGTGTATCAG GCACCTGTTG CTCTGCAACA CACCACCTCA AAATCTATTT ATTCACTATT TATTTATTCA
TGATTCTGTG AGTCTGCAGT TTAGGGTGGG ATGTCCTGAG ACAACTTTCT CTGATCCACC TGGGGCACTA
GCTCACCCAT GTGACTTCAG TGACTTCATT CACATCTGGC TGTTGGCAGA GGCAGAAGTA CTTGAGAAAG
CCATGTGCAT CATCCAGCAG GTTCACCCTA TCTCAGATAC CTGATGCCAG TGGTTTCAGG GTTTCTAAGA
GTAGCAAAAG TGTGAGCAGG TCGCTGTGTG CTAGCACTTT TCAAGTTTCT GCTTGCCTTA ATTTTATTAT
TGTCCCCCGG GCCACAGCAG GTCATAGCGT TTAGCCCAGA GTCATTGTAG AAAAGTGTGG ATTCACAAAG
GGCAGTCATT GTGGCCATTT TTATAAATAA TCTACCACAG ACTGAGTAAA AGCCTTGCAT GAATACCATG
GATATTAATT TGAATTCTTC CTTTTTAGAT TTTCTTTCCT TAGCAATTTG TTTTGTCATT TTGGATTAGA
ATTATATCTG TAGAATATTT CAGTTATAAT AGGGTACAAC TTTTATTCCA CTGAACATCT TTAGTTTTAT
TTAGGTCATC TGGTAGGTAT AAACTTCAGA AGTTAATATT CAATATTTAT AAAAACCATT AACAAGTGTG
ACACTTAAAT AGTTTAAATA ATTCTTTTGA CACAACTGTT TCCAAGTTGT GTTACGTATT TTAATTCAAT
CAAATGTTGA AATTGTTCAG TAGATAGTTT TAATTATAGG AGAAACTCAC CCCCATGACA TTTGGATGTC
TTAAAAGTTC TGTTATCTTT CTTTGCAGTT ATTCATTCTT TATTGGATAT CTGCTCTGTT ATTTCCAGTA
TGGACCATGC ATTTCATGCC AATACTTGGA AGTTTATAAT TAAGTAAGTT TGTTTGTTAT TTTTTACTTT
TTAGAAAATG TTTTCCATAT TCCCCAATCT TAATTATTCA TGATTCTTTA GATTGCATTT AAAACATTTT
GTGTGAATTT AATGTTCACT GACACTGCTG TCTGATAATC CAGATATTCT ACATGTAGCT CTCAAGCCAA
ATTGGACTTC TTTACCCTGT GGCCTCTAAA ATTAAAAAAA ATGTTCTTCC TAGTTAGCTA GTACTTCAGA
AATAATGGGC CATGGGCCAG ACTAGAACTT AACCACTTTT CTTCTGCTAC TGTTGTTTAA CCAGCTATCA
AGTATCCTAT TTCTAGGATT AGATAAATTG ATAACTATAA TTAAAACTGA ATATAATCTT TTCATTAGGT
ACTTTTAAGT TGTTCACACT TAATTCCATT TGTACAGTAA TTTTAACTTT CTGAAACTGA AGCATTTTAA
AGGGTCACCA GGGATAGTGC CTGTAGCATT CATCAGATTC TTAGGGGTGA GAGGAGATGT GGTTGAGATG
TAAAAATGGT TAAGAATATC TACTTTATAC ACATACATAA AACATTAAAG GTCAGTGTAT TTTCAGGTCT
TAGGTACTTT TCTTGTACTA CCAGGACATT AAGTTGCCAT TCAGTGGTTA AGAGTGTTGC CTGGGAGCTG
TATCACATGT GCTTAAATCC ATTCTTGAAA TCATTTACTC CTTCTGAGCC CTTGGGCTAT TTGGTTAATT
TCTCTGAACG TTAGTTTGCT CATCTGAAAA TGGAAATAAT AATAGCAACT TCTTGACAGG GTTATAGTGA
GAATTGAGTT CATCACTGTG AAATGCTTAG AAATGTGCAT GACACATAGT TAATACTCAA GGAATTAGCC
ACATCACTAT CATCATCACT GATTATCTTC CACTCTTACC CTCTTCCAGT TCATTTTCTG CCCAGCAGAA
TGATCTTTTA AAAAGTAAAT CAGATCATGT TACTCTATTG CTTGAAGTCT ATCCCATTTG ATTAAGAATA
ACAACCTAAT CCTCTGTGGA TGCTGCCTCC TTCACCAGCC TGTCTCATGC TGCTCTCCCT ACTCTTAGTT
CCTCAAACAT ACCAAACTCT CCTGTCCCAG AGTCTTTTCG TGGTTTTTCC ATCTGCCTAG GATGCTTCTC
TCTCCTATTT TGTGTACCTT GCTAACTCCT GCTTACTGTC TTTCAGTTCT CAGCTTAAGA GTTATATCTT
CATGATAACA TTCTTTGATA TCCTTACCCT AAGATTAAGT TAGATTGATA TCCTTACCCT AAGAATAAGT
TAGATTAGGT CTCTCTATTG TAGCACCTTA GACTCTGTCA TTTGACAAAT CACAGCCCTA ATTAATTATT
CTTAAAATTA TTTAACATTC TCTCTCATGC TAGACCACAA GTTTCATGCA GGTAAGGCGG AGATTGTGTC
CATTTGTTTG ACCCCTTTGT CTCCAGGGCC TGGTAGAATG CCTCATACAT AGTAAGAATT CAATTAATAT
TTTACACAGA GAAAAAATTA GCAACTTATT TAAACAAATA TAACTGCTTC AGAGGTAAAC TGGGCACATC
TTAGTTTATAT TATGTGATAT ATGATGCTTT TTGATTGTTT TTTTAAATGT TCTACAAGGT AGATATTGTT
AGAGGTCCTA AGTTACTTGA TGTGTTACTT GTGGTGATTG TATTCTTTTC TTTTTATTCA TTTAGGCAGA
```

-continued

```
GCCTTAAGCA CCAGTCCATA ATAAAAAGCC AGTTGAAACA CAAAGATATA ATTACTAGCT TGTGTGAAGA
CATTCTTTTC TCCTTCCATT CTTGTTTACA GTTAGCTGAG CAGATGACAC AGTCAGATGC ACAGGTAAAA
TTTGGGCTAA TAGCATTTTA AACAGCAACT CTTATTTTCT TTGGCAGTTA GTAAATCTCA TTTGAATGTC
TGGGTCAGTC TATTTAAGAG GATTTTAATT TATTTCATTT GGGTGTTTTT TTTTGATCTG TGGGATTATT
TATATCCCAT AATTACTTTT CACCCAGAGC ATTGTATTAG ATTCCTAACT GCTGTCATTG CCTCTGGGGT
CTGCCTGGCT CCCTCTTTGC TTGGTAACTG GTTGGTCACA GCATTCTTCT CAGAATCCTT TCATTCTTTT
CTGCATGAGA ACAAAAATTC TTTTGTTCAT ATTTGTATAA GATCTGATAT AGCTGCAATC AATCTTGCAT
TTTTTCTTCA CCAACGCATT GCGACCTTTA GGGATACAAG TATGTTTGTG CATGTATATG TATGTATCAG
TCTTTTAAAT TTGATATAGT CATACATTTG TTTTTATTTT GAAAAGTTAG AGTGTTGAAT TGGTATCCCA
TTTATGAAAC ATTATATTCT AAAAATTTGT AGTACGATTA TTGGGAATTA TAACTCATTT TCCTGTAACA
CTGTTATACA TAGTACCTTT TGCTTTCAGA CTAGCCCTCA ATTTTATTTA ACTATAGTAG TCCTAAATTA
TAAGATTAAT AGTACTCAGG ACCTAACAGT TATATGTCAT TTGTTTTTTT TTTTTTGAG ATGGCGTCTC
ACTCTGTCAC CCAAGCTGGA GTGCAGTGGT ATGACCTTGG CTCACTGCAG CCTCTGCCTC ACGGGTTCAA
GGGATCGTTC TGCCTTAGCC TCCTGAGTAG CTGGGATTAT AGGCGCCTGC CACCACGCCT GGCTAATTTT
TTTAGTAGAG ACGGGGTTTC GCCATGTTGG CCAGGCTGGT CTCGAACTCC TGACCTCAGG TGGTCCACCC
GCCTTGGCCT CCCAAAGTGC TGGGATTACA GGTGTGAGCC ACCGCGCCCA GCCTATATGT AATAATTTTA
ATGGGACCAT GAATTGAATA TTTCTTCCTT GAATAGCAAT GACATAGCCC CTTCTATTGT ACATCTGCAA
GCTGATACAG GGAATTCCTT TGTACCTGCG CTCTTCCCTG CCAGTCAGCT ATGGGGGTGA AGTGTAGGG
GTTCATCCAA GTCCTAAAAC TGGTAGCAAC TCCTAGGGCA GGGCTGATCT GGAAGGACAG ACCCTAGGGG
AGGGTGGAAC TTTAAAAAGA AGTTCTGAAG GTAGTAAGAA GGAAATGAGG AGTAGTGTTA GGAAGGGGCT
AACTTTTTTC TTCTTGCTTC TCTTCTTTAT CTCACCTGCC CCTCCCCTTG TATCCCTTCT TCCTTTTTCC
CTTTCCTTTT TTGTCCTCAC TTCATTCGTG CATCCTTTCT GATTCCTCTT ACCTTGCTAA AGGAGAAGT
TTGTTTGGGT ATCCTATATC AATGGCAGGA AGGTTGTTTT CTTCTTTACC TTTATCCTAT AGATTCATAT
TCTCAACACC AACCTCCTCC TTTTTCAGTT TCCTTCTTGC TTCTCTTGAC ACCACAGAGT TTGCAGCTAG
TACTTGGAGA GGAAAATTAA ACAGAGATAC TTGGACCAAG AGTAAGATGA AGAAAGTCTA ACAACAGTA
TAGTCTATAG TGGCAAGAGA GAGTATGGGG GCTGCTTAGC CAGGGTGGCT GTACATAAAG TATATCTTCA
GTTTATATAA ACTGCTTATA GATGGAAATC AGAAAATTTA AATTCTCTTA ACTGTCCAAG AAAATTCTCA
TTTTTTCAAA TTTGGGACTG ATAAATGTGA CCAGTTCTGC TTACTGTCCA TTGCCTGAAA TGGAGCTTTG
AGGTGGACTG TATAATTTCT TCAATCTTAA CTCCAAATTC TGATCAGCGA CGCCCTCTGC TGTTCACTAT
TAATATTTAT TTACCAATCA AAGTAAAGTA TTGAAGTTTT CCTGGCAGTT TTCACTTTGT GTTTTAGTCC
ATTTAGGCTG CTATAACAAA ATCCCTTAAA CTGGGTAAGG GATTATAAAT ATTAGAAATT TATCTCTCAC
AGTTCTGGAA GCTGGGAAGC CCAATATCAA GGCACCAGTA GATTTGGTGT CTAACGAGGG TGTGCCGTCT
GCTTCAAAAA TGGCCCCTTG TTGCTGCATC CTCACTTAGT GCAAGGGGCA AGACAGCTCC CTTCAACCTC
TTTTATAAGG GCACTTATGT CATTCATGAG GGCAGAGCCC TCATGACTTA ACACTTCCC CAAAGGCCCC
ACCTCTTAAT AGTATCACAT TGGGTGTTAG GTGTCTGGGA GGACACCAAT CTTCAAGCCA TATCATCTCA
CTTGAAAAA AGTCAAAATA AAACCAGTAG ATTTAATTAA TATTCACTA TTTATAGAAG CATGTGATGT
ATCATTCCTT GTATTAATTT CCTGGGGTTG CCGTAACAAG TTACCACAAA CTAGGTGGCT TAAAACAATA
GAATTTTATT CTCTCACATT TCTAGAGGCA GAAGTTCACA GTGTGTCAAT AGGGCCATGT TCTCTGGAAG
GCTTTAGGGG AGAATATATT TCATATCTTT CTCTTAGCTT CTCGGTGTCA CTGGCAATCC TTAGCTTACT
```

```
TTGGCTTTCT GTGTCTTCAC ATCATCTTTT TATAAGAACA CCAGTGATAG TGATTAAGGG CATACCTTAC
TTTAATATGA CCTCATCTTA ACTAATTATG TCTTCAATAA CCCTATTTCC AAATAAGGCC ACATTCTGAA
GTATTGGGAG TTAGAACTTA AAGCTTTTTG GGAGGGACAC AGTTCAACCC ATAACAACCC CTAAAATCGA
TATTTATTCT CAATTAAGTC TTGAAATTGG TTTCAAAAAG AGAATATTCT ATTAGAGTTT TTAATGTATA
GTTTTAACAT ATAGTTCTTT AGCCCCCAAT TTTTTTTTTT TTTTTTTTTT TTTTTTTTTT TTTTTGAGAC
GGAGTCTCGC TCTGTCGCCC AGGCCGGACT GCGGACTGCA GTGGCGCAAT CTCGGCTCAC TGCAAGCTCC
GCTTCCCGGG TTCACGCCAT TCCCCTGCCT CAGCCTCCCG AGTAGCTGGG ACTACAGGCG CCTGCCACCG
CGCCCGGCTA ATTTTTTTGT ATTTTTAGTA GAGACGGGGT TTCACCTTGT TAGCCAGGAT GGTCTCGATC
TCCTGACCTC ATGATCCACC CGCCTCGGCC TCCCAAAGTG CTGGGATTAC AGGCGTGAGC CACCGCGCCC
GGCCTGCCCC CAATTATTTA GTTTTTCTAT AAACAGGGAA ATTTATTTGT GTGGCCCTTA GAACTAATTT
AATTTCCACT CTAATTCCTA CTTATGTTTA TATAATGCTT TTAGAAATTT GTATTATTCA GAAAATAAAC
ATATACTATT GTATCTGTTG CCTACACTTA GATTTTATTG CCTGCTATAT TTAAATTTTA TTAGTATTTT
AATTGTTTTA TTAAAGAAAG AATGTGCCTG TAATCTCAGC ACTTTTGAGA GGCCAAGGCA GAAGGATTGC
TTGAGCCCAG GAGTTTGAGA CCAGACTGAG CAACACAGGG AGACCCCCAT CTCTACAAAA AATAAAAAAA
TTCTCCAGGC CTCATGGCAC ATACCTGTAG TTCTAGTTAC TTGGGAGACT GGGGTGGGAG GATGCATTGA
GCCCAGGAGA TTGAGGCTGC AGTGAGCCAT GATCAGGCCA CTGTACTCCA GCTTGGACAA CAGAGTGAGA
GCTTGTCTAG ATAGATAGAT AGATAGATAA TCTAAATAGA TAATAGACAG ATTATCTAAA TAGATAATAG
ACAGATTATC TAAATAGATA ATAGACAGAT TATCTAAATA GATAATAGAC AGATTATCTA AATAGATAAT
AGACAGATTA TCTAAATAGA TAATAGACAG ATTATCTATC TAAATAGATA ATAGATTATC TAAATAGATA
ATAGATAGAT AGATTAGATA GATAGATAGA TAGATAGAGC TTGGACAACA GAGTGAGAGC CTGTCTAGAT
AGATAGAAAC AAAGAAAGAA AGAAAGAATG GTGCTCATAT TTTAAAGCAT TGAAAAATGG TCTTCCTTGC
TTATATTACC CACACCTTCT TTGTTGGCAT TAAGATGCAA ACTTTGTTTT AAACAGTTGA GTAAATCAAA
GATGGGACTG TTAAGTTATT TGTGTTATTT ACCTGCTTTT TGAAAATGTA AAAATAAAAC TCTAGGTTTA
ATTAGTAGTA TGCTATTTAG TAATGAAGTA AAGCTAGAGG CTTCGAACAA ATCTTGTGTA ATTTCCTCTT
GAATGAGAGA GAAAATTTAA AGTAAGCAAA CAAATAAGTT GTGTGTCACC ACTCATTCAG TCATTTAACA
AGTATTTCCA GAGTACTTAT TCTGTGCCAG GAAATGTTGT AGGTGCCCTC AACAACTTAG AGTCTAGCCT
GAGACACAAG TAAGTAGGTA ATTATTATAG AATGGTATGA TCTTTGGAGG ACTGGGTATT GGCTGGCTCA
TGGGAGTACA AGATAGGTAC CCAGTGATGA AGTCAGGAAA GGTTTCTTAT GGTGATATGA TGACGTCTAT
GCTGATTATA AGGTCAGTGT AGAATAAACT TTGTGCTTTT AAATTTGCAT AGCACTGTAT TAGAGAGTTC
ATCTTGAAAA TAATCGAAAA GGCTGAGTGT GGTGACCCAT GGCTGTAATC CCAGCACTTT GGGAGGCCGA
GGTGGGCAGA TTGCTTGAGC TAGGAGTTCG AGACCAGGCT GGCCAACATG GTGAAACCCC GTCTCTACTA
AAAATACAAA AATTAGCCAG GAGTGATGGT GCGCACCTGT AATGCCAGCT ACTTGGGAGG CTGAGGCAGG
AGGATCACTT GAACCCAGGA GGTGGAGGTT GAAGTAAGCC GAGGTCATGC CACTGCACTC CAGCCTGGGC
AACAGAGTGA GACTCCATCT CAAAAAAAAA AAAATGATC AAAGAAAGGT GAATTTTCAT CTACCCTATT
TCTGCTGAGG AAAATGGACT ATTTTCAAAT ATTTTTAATA AGGGTCAAAA TGAGGGATC GCATTTTTTC
AAGTTTTATG ATTTATTTAA CTTGTGGAAC AAAAATAAAC CAGAAACCAC CACCTCTCAC GCCAAAGCTC
ACACCTTCAG CCTCCAACAT GAAGGTCTCC GCAGCACTTC TGTGGCTGCT GCTCATAGCA GCTGCCTTCA
GCCCCCAGGG GCTCGCTGGG CCAGCTTCTG TCCCAACCAC CTGCTGCTTT AACCTGGCCA ATAGGAAGAT
ACCCCTTCAG CGACTAGAGA GCTACAGGAG AATCACCAGT GGCAAATGTC CCCAGAAAGC TGTGATCTTC
AAGACCAAAC TGGCCAAGGA TATCTGTGCC GACCCCAAGA AGAAGTGGGT GCAGGATTCC ATGAAGTATC
```

-continued

```
TGGACCAAAA ATCTCCAACT CCAAAGCCAT AAATAATCAC CATTTTTGAA ACCAAACCAG AGCCTGAGTG

TTGCCTAATT TGTTTTCCCT TCTTACAATG CATTCTGAGG TAACCTCATT ATCAGTCCAA AGGGCATGGG

TTTTATTATA TATATATATA TTTTTTTTTT AAAAAAAAAC GTATTGCATT TAATTTATTG AGGCTTTAAA

ACTTATCCTC CATGAATATC AGTTATTTTT AAACTGTAAA GCTTTGTGCA GATTCTTTAC CCCCTGGGAG

CCCCAATTCG ATCCCCTGTC ACGTGTGGGC AATGTTCCCC CTCTCCTCTC TTCCTCCCTG GAATCTTGTA

AAGGTCCTGG CAAAGATGAT CAGTATGAAA ATGTCATTGT TCTTGTGAAC CCAAAGTGTG ACTCATTAAA

TGGAAGTAAA TGTTGTTTTA GGAATAC ATGAAGGTCT CCGCAGCACT TCTGTGGCTG CTGCTCATAG

CAGCTGCCTT CAGCCCCCAG GGGCTCGCTG GGCCAGCTTC TGTCCCAACC ACCTGCTGCT TTAACCTGGC

CAATAGGAAG ATACCCCTTC AGCGACTAGA GAGCTACAGG AGAATCACCA GTGGCAAATG TCCCCAGAAA

GCTGTGATCT TCAAGACCAA ACTGGCCAAG GATATCTGTG CCGACCCCAA GAAGAAGTGG GTGCAGGATT

CCATGAAGTA TCTGGACCAA AAATCTCCAA CTCCAAAGCC ATAA CCACATATTC CCCTCCTTTT CCAAGGCAAG

ATCCAGATGG ATTAAAAAAT GTACCAAGTC CCTCCTACTA GCTTGCCTCT CTTCTGTTCT GCTTGACTTC

CTAGGATCTG GAATCTGGTC AGCAATCAGG AATCCCTTCA TCGTGACCCC CGCATGGGCA AAGGCTTCCC

TGGAATCTCC CACACTGTCT GCTCCCTATA AAAGGCAGGC AGATGGGCCA GAGGAGCAGA GAGGCTGAGA

CCAACCCAGA AACCACCACC TCTCACGCCA AAGCTCACAC CTTCAGCCTC CAACATGAAG GTCTCCGCAG

CACTTCTGTG GCTGCTGCTC ATAGCAGCTG CCTTCAGCCC CCAGGGGCTC GCTGGGCCAG GTAAGCCCCC

CAACTCCCTA CAGGAAAGGT AAGGTAACCA CCTCCAGGCT ACTAGGTCAG CAAGAATCTT TACAGACTCA

CTGCAAATTC TCCATTTGAA AAATAGGGAA ACAGGTTTTG TGGGTGGACA AGAAATGCCT CAACCGTCAC

ATCCAGTCAC TGGAAGAGCC AGAACTAGAA AGCTCCCGAG TCTTTTCCCC ACATTCAAGA GGGCCGCTGG

GTGCATCCTT ACCCAGCTAT CCCTACAGTG TTTGGGAATG GGGAATGGCT CTGTCTTACT GTGGGCATGG

TGGGCATTTT TGGCAGTGGG AGAGAAGGAA AATCTGTTGA TTAGAAGCTC AGTATGTTAA TTCGACTCCA

GGACAGCTTT CAGAGACAGT GGCTAAGAGA AGAACGAGGT CCCAGGGGAT CTCTTGAGGT GACTTATTTT

GACACTCTTT GGGAAAGTTA TCTAGGAGAT TTGTTCCATA ACTCATTTTC CCATACTCTG GTGACAAATT

TACTGAGTGT ATCGGTCCCA CTGAGCCAGT GCATAGCATG GTAACAAACA GTTCTAAATT ATCAATGACT

TAACAGAATT AACTAAATTA ACAAAAGTTA CTTTCTCACT TGTACTAAAT ATCTATAATG TATGGGCTCA

GGCTTCTGCA TTTTATACTC AGGATTCTAG ACTGATGGAG AAGTTGCCAT GTGGGGAAC ATTGATGGAT

ACTGTGATAA AGCAGAAGAA AGCTTTCAGG AGTCTTGCAT AGGCAATGCA CTGTGGCTCA AAAATGACAC

CCATCACTTT GTCTCCTTCT TTATTGATCA AAACTAATTA ATGCCTCCAA CCAAACAAAA GTGGCCAAGA

AATGCAAGTC TACCTTGTGT CTCAAAACAG AGGATGGAGA ATATTTGGTG AAAATTACCA TGACCATCAC

ATGGCCACGT AGGTCTTTAT AATGACAGAG CTAGCATTTG TCACATTGAC CAAGCTTTGT CCATACACTC

TACAGTAATG ATGAGTCCTC AGTGCACAGG GGAGGATGCT GAAGACACAG GACAGCATCC TCCAGACACA

TAAGACTTCA GAGCAGAGGG ATTCTCCCTC CACCTCTCGC AATTCCTTGC TTTCTCCTAA CTTCCTTTAC

AAAGTCATGC TTGGAAATGT CTATGTATCA TCATGTGGCT CATTTTTTTC TCTGTTCATT TTTTTTCCCC

AAAATTCAGC TTCTGTCCCA ACCACCTGCT GCTTTAACCT GGCCAATAGG AAGATACCCC TTCAGCGACT

AGAGAGCTAC AGGAGAATCA CCAGTGGCAA ATGTCCCCAG AAAGCTGTGA TGTAAGTAAA TAAAGTTCAC

CCTCCCCTAG ACAAAAAAAT AATGTCTAGG GCACAGAGTC AAGAACTGTG GGAGTCATAG ACTCTGATAG

TTTGACCTCT ATGGTCCAAT TCATTAATTT TCACAAGTGA GTGTTCACTC CCAGCTCCCT GCCTGGGAGA

TTGCTGTAGT CATATCAATT TCTTCAAGTC AAGAGCAAAG ATGGTTTTAC TGGGCCTTTA AGAGCAGCAA

CTAACCCAAG AGTCTCATCC TTCCTCCTCT CCGTAGCAAC CCTTTGTCCA GGGGCAGATG GTCCTTAAAT
```

```
ATTTAGGGTC AAATGGGCAG AATTTTCAAA AACAATCCTT CCAATTGCAT CCTGATTCTC CCCACAGCTT

CAAGACCAAA CTGGCCAAGG ATATCTGTGC CGACCCCAAG AAGAAGTGGG TGCAGGATTC CATGAAGTAT

CTGGACCAAA AATCTCCAAC TCCAAAGCCA TAAATAATCA CCATTTTTGA AACCAAACCA GAGCCTGAGT

GTTGCCTAAT TTGTTTTCCC TTCTTACAAT GCATTCTGAG GTAACCTCAT TATCAGTCCA AAGGGCATGG

GTTTTATTAT ATATATATAT ATATATTTTT TTTTAAAAAA AAACGTATTG CATTTAATTT ATTGAGGCTT

TAAAACTTAT CCTCCATGAA TATCAGTTAT TTTTAAACTG TAAAGCTTTG TGCAGATTCT TTACCCCCTG

GGAGCCCCAA TTCGATCCCC TGTCACGTGT GGGCAATGTT CCCCCTCTCC TCTCTTCCTC CCTGGAATCT

TGTAAAGGTC CTGGCAAAGA TGATCAGTAT GAAAATGTCA TTGTTCTTGT GAACCCAAAG TGTGACTCAT

TAAATGGAAG TAATGTTGTT TTAGGAATAC ATAAAGTATG TGCATATTTT ATTATAGTCA CTAGTTGTAA

TTTTTTTTTG GGAAATCCAC ACTGAGCTGA GGGGG GCCAGGTCGC TGTTGGTCCA CGCCGCCCGT

CGCGCCGCCC GCCCGCTCAG CGTCCGCCGC CGCCATGGGA GGCCGGAGCC GAGCCGGGGT CGGGCAGCAG

CAGGGACCCC CCAGAGGCGG GGCCTGTGGG ACCGCTATGG GCGTGGAGAT CGAGACCATC TCCCCCGGAG

ACGGAAGGAC ATTCCCCAAG AAGGGCCAAA CGTGTGTGGT GCACTACACA GGAATGCTCC AAAATGGGAA

GAAGTTTGAT TCATCCAGAG ACAGAAACAA ACCTTTCAAG TTCAGAATTG CAAACAGGA AGTCATCAAA

GGTTTTGAAG AGGGTGCAGC CCAGATGAGC TTGGGGCAGA GGGCGAAGCT GACCTGCACC CCTGATGTGG

CATATGGAGC CACGGGCCAC CCCGGTGTCA TCCCTCCCAA TGCCACCCTC ATCTTTGACG TGGAGCTGCT

CAACTTAGAG TGAAGGCAGG AAGGAACTCA AGGTGGCTGG AGATGGCTGC TGCTCACCCT CCTAGCCTGC

TCTGCCACTG GGACGGCTCC TGCTTTTGGG GCTCTTGATC AGTGTGCTAA CCTCACTGCC TCATGGCATC

ATCCATTCTC TCTGCCCAAG TTGCTCTGTA TGTGTTCGTC AGTGTTCATG CGAATTCTTG CTTGAGGAAA

CTTCGGTTGC AGATTGAAGC ATTTCAGGTT GTGCATTTTG TGTGATGCAT GTAGTAGCCT TTCCTGATGA

CAGAACACAG ATCTCTTGTT CGCACAATCT ACACTGCCTT ACCTTCACTT AAACCACACA CACAAGGTGC

TCAGACATGA AATGTACATG GCGTACCGTA CACAGAGGGA CTTGAGCCAG TTACCTTTGC TGTCACTTTC

TCTCTTATAA ATTCTGTTAG CTGCTCACTT AAACAATGTC CTCTTTGAGA AAATGTAAAA TAAAGGCTCT

GTGCTTGACA GAATTCGGGC CGCCGCCAGG TCGCTGTTGG TCCACGCCGC CGTCGCGCC GCCCGCCCGC

TCAGCGTCCG CCGCCGCCAT GGGAGTGCAG GTGGAAACCA TCTCCCCAGG AGACGGGCGC ACCTTCCCCA

AGCGCGGCCA GACCTGCGTG GTGCACTACA CCGGGATGCT TGAAGATGGA AAGAAATTTG ATTCCTCCCG

GGACAGAAAC AAGCCCTTTA AGTTTATGCT AGGCAAGCAG GAGGTGATCC GAGGCTGGGA AGAAGGGGTT

GCCCAGATGA GTGTGGGTCA GAGAGCCAAA CTGACTATAT CTCCAGATTA TGCCTATGGT GCCACTGGGC

ACCCAGGCAT CATCCCACCA CATGCCACTC TCGTCTTCGA TGTGGAGCTT CTAAAACTGG AATGACAGGA

ATGGCCTCCT CCCTTAGCTC CCTGTTCTTG GATCTGCCAT GGAGGGATCT GGTGCCTCCA GACATGTGCA

CATGAGTCCA TATGGAGCTT TTCCTGATGT TCCACTCCAC TTTGTATAGA CATCTGCCCT GACTGAATGT

GTTCTGTCAC TCAGCTTTGC TTCCGACACC TCTGTTTCCT CTTCCCCTTT CTCCTCGTAT GTGTGTTTAC

CTAAACTATA TGCCATAAAC CTCAAGTTAT TCATTTTATT TTGTTTTCAT TTTGGGGTGA AGATTCAGTT

TCAGTCTTTT GGATATAGGT TTCCAATTAA GTACATGGTC AAGTATTAAC AGCACAAGTG GTAGGTTAAC

ATTAGAATAG GAATTGGTGT TGGGGGGGGG GTTTGCAAGA ATATTTTATT TTAATTTTTT GGATGAAATT

TTTATCTATT ATATATTAAA CATTCTTGCT GCTGCGCTGC AAAGCCATAG CAGATTTGAG GCGCTGTTGA

GGACTGAATT ACTCTCCAAG TTGAGAGATG TCTTTGGGTT AAATTAAAAG CCCTACCTAA AACTGAGGTG

GGGATGGGGA GAGCCTTTGC CTCCACCATT CCCACCCACC CTCCCCTTAA ACCCTCTGCC TTTGAAAGTA

GATCATGTTC ACTGCAATGC TGGACACTAC AGGTATCTGT CCCTGGGCCA GCAGGGACCT CTGAAGCCTT

CTTTGTGGCC TTTTTTTTTT TTCATCCTGT GGTTTTTCTA ATGGACTTTC AGGAATTTTG TAATCTCATA
```

```
ACTTTCCAAG CTCCACCACT TCCTAAATCT TAAGAACTTT AATTGACAGT TTCAATTGAA GGTGCTGTTT

GTAGACTTAA CACCCAGTGA AAGCCCAGCC ATCATGACAA ATCCTTGAAT GTTCTCTTAA GAAAATGATG

CTGGTCATCG CAGCTTCAGC ATCTCCTGTT TTTTGATGCT TGGCTCCCTC TGCTGATCTC AGTTTCCTGG

CTTTTCCTCC CTCAGCCCCT TCTCACCCCT TTGCTGTCCT GTGTAGTGAT TTGGTGAGAA ATCGTTGCTG

CACCCTTCCC CCAGCACCAT TTATGAGTCT CAAGTTTTAT TATTGCAATA AAAGTGCTTT ATGCCCGAAT TC

GCCGCCGCCA TGGGAGTGCA GGTGGAAACC ATCTCCCCAG GAGACGGGCG CACCTTCCCC AAGCGCGGCC

AGACCTGCGT GGTGCACTAC ACCGGGATGC TTGAAGATGG AAAGAAATTT GATTCCTCCC GGGACAGAAA

CAAGCCCTTT AAGTTTATGC TAGGCAAGCA GGAGGTGATC CGAGGCTGGG AAGAAGGGGT TGCCCAGATG

AGTGTGGGTC AGAGAGCCAA ACTGACTATA TCTCCAGATT ATGCCTATGG TGCCACTGGG CACCCAGGCA

TCATCCCACC ACATGCCACT CTCGTCTTCG ATGTGGAGCT TCTAAAACTG GAATGACAGG AATGGCCTCC

TCCCTTAGCT CCCTGTTCTT GGATCTGCCR TGGAGGGATC TGGTGCCTCC AGACATGTGC ACATGARTCC

ATATGGAGCT TTTCCTGATG TTCCACTCCA CTTTGTATAG ACATCTGCCC TGACTGAATG TGTTCTGTCA

CTCAGCTTTG CTTCCGACAC CTCTGTTTCC TCTTCCCCTT TCTCCTCGTA TGTGTGTTTA CCTAAACTAT

ATGCCATAAA CCTCAAGTTA TTCA AGCTTCTAC CCTAGTCTGG TGCTACACTT ACATTGCTTA CATCCAAGTG

TGGTTATTTC TGTGGCTCCT GTTATAACTA TTATAGCACC AGGTCTATGA CCAGGAGAAT TAGACTGGCA

TTAAATCAGA ATAAGAGATT TTGCACCTGC AATAGACCTT ATGACACCTA ACCAACCCCA TTATTTACAA

TTAAACAGGA ACAGAGGGAA TACTTTATCC AACTCACACA AGCTGTTTTC CTCCCAGATC CATGTTTTTT

TGCGTTTATT ATTTTTTAGA GATGGGGGCT TCACTATGTT GCCCACACTG GACTAAAACT CTGGGCCTCA

AGTGATTGTC CTGCCTCAGC CTCCTGAATA GCTGGGACTA CAGGGGCATG CCATCACACC TAGTTCATTT

CCTCTATTTA AAATATACAT GGCTTAAACT CCAACTGGGA ACCCAAAACA TTCATTTGCT AAGAGTCTGG

TGTTCTACCA CCTGAACTAG GCTGGCCACA GGAATTATAA AAGCTGAGAA ATTCTTTAAT AATAGTAACC

AGGCAACATC ATTGAAGGCT CATATGTAAA AATCCATGCC TTCCTTTCTC CCAATCTCCA TTCCCAAACT

TAGCCACTGG TTCTGGCTGA GGCCTTACGC ATACCTCCCG GGGCTTGCAC ACACCTTCTT CTACAGAAGA

CACACCTTGG GCATATCCTA CAGAAGACCA GGCTTCTCTC TGGTCCTTGG TAGAGGGCTA CTTTACTGTA

ACAGGGCCAG GGTGGAGAGT TCTCTCCTGA AGCTCCATCC CCTCTATAGG AAATGTGTTG ACAATATTCA

GAAGAGTAAG AGGATCAAGA CTTCTTTGTG CTCAAATACC ACTGTTCTCT TCTCTACCCT GCCCTAACCA

GGAGCTTGTC ACCCCAAACT CTGAGGTGAT TTATGCCTTA ATCAAGCAAA CTTCCCTCTT CAGAAAAGAT

GGCTCATTTT CCCTCAAAAG TTGCCAGGAG CTGCCAAGTA TTCTGCCAAT TCACCCTGGA GCACAATCAA

CAAATTCAGC CAGAACACAA CTACAGCTAC TATTAGAACT ATTATTATTA ATAAATTCCT CTCCAAATCT

AGCCCCTTGA CTTCGGATTT CACGATTTCT CCCTTCCTCC TAGAAACTTG ATAAGTTTCC CGCGCTTCCC

TTTTTCTAAG ACTACATGTT TGTCATCTTA TAAAGCAAAG GGGTGAATAA ATGAACCAAA TCAATAACTT

CTGGAATATC TGCAAACAAC AATAATATCA GCTATGCCAT CTTUCACTAT TTTAGCCAGT ATCGAGTTGA

ATGAACATAG AAAAATACAA AACTGAATTC TTCCCTGTAA ATTCCCCGTT TTGACGACGC ACTTGTAGCC

ACGTAGCCAC GCCTACTTAA GACAATTACA AAAGGCGAAG AAGACTGACT CAGGCTTAAG CTGCCAGCCA

GAGAGGGAGT CATTTCATTG GCGTTTGAGT CAGCAAAGGT ATTGTCCTCA CATCTCTGGC TATTAAAGTA

TTTTCTGTTG TTGTTTTTCT CTTTGGCTGT TTTCTCTCAC ATTGCCTTCT CTAAAGCTAC AGTCTCTCCT

TTCTTTTCTT GTCCCTCCCT GGTTTGGTAT GTGACCTAGA ATTACAGTCA GATTTCAGAA AATGATTCTC

TCATTTTGCT GATAAGGACT GATTCGTTTT ACTGAGGGAC GGCAGAACTA GTTTCCTATG AGGGCATGGG

TGAATACAAC TGAGGCTTCT CATGGGAGGG AATCTCTACT ATCCAAAATT ATTAGGAGAA AATTGAAAAT
```

```
TTCCAACTCT GTCTCTCTCT TACCTCTGTG TAAGGCAAAT ACCTTATTCT TGTGGTGTTT TTGTAACCTC

TTCAAACTTT CATTGATTGA ATGCCTGTTC TGGCAATACA TTAGGTTGGG CACATAAGGA ATACCAACAT

AAATAAAACA TTCTAAAAGA AGTTTACGAT CTAATAAAGG AGACAGGTAC ATAGCAAACT AATTCAAAGG

AGCTAGAAGA TGGAGAAAAT GCTGAATGTG GACTAAGTCA TTCAACAAAG TTTTCAGGAA GCACAAAGAG

GAGGGGCTCC CCTCACAGAT ATCTGGATTA GAGGCTGGCT GAGCTGATGG TGGCTGGTGT TCTCTGTTGC

AGAAGTCAAG ATGGCCAAAG TTCCAGACAT GTTTGAAGAC CTGAAGAACT GTTACAGGTA AGGAATAAGA

TTTATCTCTT GTGATTTAAT GAGGGTTTCA AGGCTCACCA GAATCCAGCT AGGCATAACA GTGGCCAGCA

TGGGGGCAGG CCGGCAGAGG TTGTAGAGAT GTGTACTAGT CCTGAAGTCA GAGCAGGTTC AGAGAAGACC

CAGAAAAACT AAGCATTCAG CATGTTAAAC TGAGATTACA TTGGCAGGGA GACCGCCATT TTAGAAAAAT

TATTTTTGAG GTCTGCTGAG CCCTACATGA ATATCAGCAT CAACTTAGAC ACAGCCTCTG TTGAGATCAC

ATGCCCTGAT ATAAGAATGG GTTTTACTGG TCCATTCTCA GGAAAACTTG ATCTCATTCA GGAACAGGAA

ATGGCTCCAC AGCAAGCTGG GCATGTGAAC TCACATATGC AGGCAAATCT CACTCAGATG TAGAAGAAAG

GTAAATGAAC ACAAAGATAA AATTACGGAA CATATTAAAC TAACATGATG TTTCCATTAT CTGTAGTAAA

TACTAACACA AACTAGGCTG TCAAAATTTT GCCTGGATAT TTTACTAAGT ATAAATTATG AAATCTGTTT

TAGTGAATAC ATGAAAGTAA TGTGTAACAT ATAATCTATT TGGTTAAAAT AAAAAGGAAG TGCTTCAAAA

CCTTTCTTTT CTCTAAAGGA GCTTAACATT CTTCCCTGAA CTTCAATTAA AGCTCTTCAA TTTGTTAGCC

AAGTCCAATT TTTACAGATA AGCACAGGT AAAGCTCAAA GCCTGTCTTG ATGACTACTA ATTCCAGATT

AGTAAGATAT GAATTACTCT ACCTATGTGT ATGTGTAGAA GTCCTAAAT TTCAAAGATG ACAGTAATGG

CCATGTGTAT GTGTGTGACC CACAACTATC ATGGTCATTA AAGTACATTG GCCAGAGACC ACATGAAATA

ACAACAATTA CATTCTCATC ATCTTATTTT GACAGTGAAA ATGAAGAAGA CAGTTCCTCC ATTGATCATC

TGTCTCTGAA TCAGGTAAGC AAATGACTGT AATTCTCATG GGACTGCTAT TCTTACACAG TGGTTTCTTC

ATCCAAAGAG AACAGCAATG ACTTGAATCT TAAATACTTT TGTTTTACCC TCACTAGAGA TCCAGAGACC

TGTCTTTCAT TATAAGTGAG ACCAGCTGCC TCTCTAAACT AATAGTTGAT GTGCATTGGC TTCTCCCAGA

ACAGAGCAGA ACTATCCCAA ATCCCTGAGA ACTGGAGTCT CCTGGGGCAG GCTTCATCAG GATGTTAGTT

ATGCCATCCT GAGAAAGCCC CGCAGGCCGC TTCACCAGGT GTCTGTCTCC TAACGTGATG TGTTGTGGTT

GTCTTCTCTG ACACCAGCAT CAGAGGTTAG AGAAAGTCTC CAAACATGAA GCTGAGAGAG AGGAAGCAAG

CCAGCTGAAA GTGAGAAGTC TACAGCCACT CATCAATCTG TGTTATTGTG TTTGGAGACC ACAAATAGAC

ACTATAAGTA CTGCCTAGTA TGTCTTCAGT ACTGGCTTTA AAAGCTGTCC CCAAAGGAGT ATTTCTAAAA

TATTTTGAGC ATTGTTAAGC AGATTTTTAA CCTCCTGAGA GGGAACTAAT TGGAAAGCTA CCACTCACTA

CAATCATTGT TAACCTATTT AGTTACAACA TCTCATTTTT GAGCATGCAA ATAAATGAAA AAGTCTTCCT

AAAAAAATCA TCTTTTTATC CTGGAAGGAG GAAGGAAGGT GAGACAAAAG GGAGAGAGGG AGGGAAGCCT

AATGAAACAC CAGTTACCTA AGACCAGAAT GGAGATCCTC CTCACTACCT CTGTTGAATA CAGCACCTAC

TGAAAGAACT TTCATTCCCT GACCATGAAC AGCCTCTCAG CTTCTGTTTT CCTTCCTCAC AGAAATCCTT

CTATCATGTA AGCTATGGCC CACTCCATGA AGGCTGCATG GATCAATCTG TGTCTCTGAG TATCTCTGAA

ACCTCTAAAA CATCCAAGCT TACCTTCAAG GAGAGCATGG TGGTAGTAGC AACCAACGGG AAGGTTCTGA

AGAAGAGACG GTTGAGTTTA AGCCAATCCA TCACTGATGA TGACCTGGAG GCCATCGCCA ATGACTCAGA

GGAAGGTAAG GGGTCAAGCA CAATAATATC TTTCTTTTAC AGTTTAAGC AAGTAGGGAC AGTAGAATTT

AGGGGAAAAT TAAACGTGGA GTCAGAATAA CAAGAAGACA ACCAAGCATT AGTCTGGTAA CTATACAGAG

GAAAATTAAT TTTTATCCTT CTCCAGGAGG GAGAAATGAG CAGTGGCCTG AATCGAGAAT ACTTGCTCAC

AGCCATTATT TCTTAGCCAT ATTGTAAAGG TCGTGTGACT TTTAGCCTTT CAGGAGAAAG CAGTAATAAG
```

```
ACCACTTACG AGCTATGTTC CTCTCATACT AACTATGCCT CCTTGGTCAT GTTACATAAT CTTTTCGTGA

TTCAGTTTCC TCTACTGTAA AATGGAGATA ATCAGAATCC CCCACTCATT GGATTGTTGT AAAGATTAAG

AGTCTCAGGC TTTACAGACT GAGCTAGCTG GGCCCTCCTG ACTGTTATAA AGATTAAATG AGTCAACATC

CCCTAACTTC TGGACTAGAA TAATGTCTGG TACAAAGTAA GCACCCAATA AATGTTAGCT ATTACTATCA

TTATTATTAT TATTTTATTT TTTTTTTTTG AGATGGAGTC TGGCTCTGTC ACCCAGGCTG GAGTGCAGTG

GCACAATCTC GGCTCACTGC AAGCTCTGCC TCCTGGGTTC ATGCCATTCT CCTGCCTCAG CCTCCCGAGT

AAGCTGGGAA TACAGGCACC CGCCACTGTT CCCGGCTAAT TTTTTGTATT TTTAGTAGAG ACGGAGTTTC

ACCGTGGTCT CCATCTCCTC GTGATCCACC CACCTTGGCC TCCCAAAGTG CCGGGATTAC AGGCGTGAGC

CACCGCGCCC GGCCTATTAT TATTATTATT ACTACTACTA CTACCTATAT GAATACTACC AGCAATACTA

ATTTATTAAT GACTGGATTA TGTCTAAACC TCACAAGAAT CCTACCTTCT CATTTTACAT AAAAGGAAAC

TAAGCTCATT GAGATAGGTA AACTGCCCAA TGGCATACAT CTGTAAGTGG AGAGCCTCA AATCTAATTC

AGTTCTACCT GAGTAAAAAA ATCATGGTTT CTCCTCCATC CCTTTACTGT ACAAGCCTCC ACATGAACTA

TAAACCCAAT ATTCCTGTTT TTAAGATAAT ACCTAAGCAA TAACGCATGT TCACCTAGAA GGTTTTAAAA

TGTAACAAAA TATAAGAAAA TAAAAATCAC TCATATCGTC AGTGAGAGTT TACTACTGCC AGCACTATGG

TATGTTTCCT TAAAATCTTT GCTATACACA TACCTACATG TGAACAAATA TGTCTAACAT CAAGACCACA

CTATTTACAA CTTTATATCC AGCTTTTCTT ACTTAGCAAT GTATTGAGGA CATTTTAGAG TGCCCGTTTT

TCACCATTAT AAGCAATGCA ACAATGAACA TCTGTATAAA TAAATATTCA TTTCTCTCAC CCTTTATTTC

CTTAGAATAT ATTCCTAGAA GTAGAATTTC CCAGAGCCAT GAGGATTTGT GACGCTATTG ATATGTGCCA

CTTTGCACTC TCTGTGACAT ATATAATTAT TTTTAATGCA TTCATTTTTT TCTCAGAGTG CATTCGTTTG

AAAACATAGA CGGGAAATAC TGGTAGTCTT CCTTGTCAGT TAGAAACACC CAAACAATGA AAAATGAAAA

AGTTGCACAA ATAGTCTCTA AAAACAATGA AACTATTGCC TGAGGAATTG AAGTTTAAAA AGAAGCACAT

AAGCAACAAC AAGGATAATC CTAGAAAACC AGTTCTGCTG ACTGGGTGAT TTCACTTCTC TTTGCTTCCT

CATCTGGATT GGAATATTCC TAATACCCCC TCCAGAACTA TTTTCCCTGT TTGTACTAGA CTGTGTATAT

CATCTGTGTT TGTACATAGA CATTAATCTG CACTTGTGAT CATGGTTTTA GAAATCATCA AGCCTAGGTC

ATCACCTTTT AGCTTCCTGA GCAATGTGAA ATACAACTTT ATGAGGATCA TCAAATACGA ATTCATCCTG

AATGACGCCC TCAATCAAAG TATAATTCGA GCCAATGATC AGTACCTCAC GGCTGCTGCA TTACATAATC

TGGATGAAGC AGGTACATTA AAATGGCACC AGACATTTCT GTCATCCTCC CCTCCTTTCA TTTACTTATT

TATTTATTTC AATCTTTCTG CTTGCAAAAA ACATACCTCT TCAGAGTTCT GGGTTGCACA ATTCTTCCAG

AATAGCTTGA AGCACAGCAC CCCCATAAAA ATCCCAAGCC AGGGCAGAAG GTTCAACTAA ATCTGGAAGT

TCCACAAGAG AGAAGTTTCC TATCTTTGAG AGTAAAGGGT TGTGCACAAA GCTAGCTGAT GTACTACCTC

TTTGGTTCTT TCAGACATTC TTACCCTCAA TTTTAAAACT GAGGAAACTG TCAGACATAT TAAATGATTT

ACTCAGATTT ACCCAGAAGC CAATGAAGAA CAATCACTCT CCTTTAAAAA GTCTGTTGAT CAAACTCACA

AGTAACACCA AACCAGGAAG ATCTTTATTA TCTCTGATAA CATATTTGTG AGGCAAAACC TCCAATAAGC

TACAAATATG GCTTAAAGGA TGAAGTTTAG TGTCCAAAAA CTTTTATCAC ACACATCCAA TTTTCATGGC

GGACATGTTT TAGTTTCAAC AGTATACATA TTTTCAAAGG TCCAGAGAGG CAATTTTGCA ATAAACAAGC

AAGACTTTTT CTGATTGGAT GCACTTCAGC TAACATGCTT TCAACTCTAC ATTTACAAAT TATTTTGTGT

TCTATTTTTC TACTTAATAT TATTTCTGCA ATTTTCCCAA TATTGACATC GTGTATGTAT TTGCCATTTT

TAATATCACT AGACAATTCA ATCAGGTTGC TACGTTGGTC CCTTGGGTTT ACTCTAAATA GCTTGATTGC

AAATATCTTT GTATATATTA TTGTTTTTTC TCCTATCTTG TAATTTCTTT GAGCACATCC CAAAGAGGAA
```

```
TGCCTAGATC AATGGGCACA AATAATTTGA CAGCTCTTAT TAAACATTAT TCTGTAAGTA AAAACTGAAC

TACTTTTCAG TATCACTAGC AACATATGAG TGTATCAGCT TCCTAAACCC CTCCATGTTA GGTCATTATG

AACTTATGAT CTAACAAATT ACAGGGTCTT ATCCCACTAA TGAAATTATA AGAGATTCAA CACTTATTCA

GCCCCGAAGG ATTCATTCAA CGTAGAAAAT TCTAAGAACA TTAACCAAGT ATTTACCTGC CTAGTGAGTG

TGGAAGACAT TGTGAAGGAC ACAAAGATGT ATAGAATTCC ATTCCTGACT TCCAGGTATT TACACCATAG

GTGGGGACCT AACTACACAC ACACACACAC ACACACACAC ACACACACAC ACCATGCACA CACAATCTAC

ATCAACACTT GATTTTATAC AAATACAATG AATTTACTTT CTTTTTGGTT CTTCTCTTCA CCAGTGAAAT

TTGACATGGG TGCTTATAAG TCATCAAAGG ATGATGCTAA AATTACCGTG ATTCTAAGAA TCTCAAAAAC

TCAATTGTAT GTGACTGCCC AAGATGAAGA CCAACCAGTG CTGCTGAAGG TCAGTTGTCC TTTGTCTCCA

ACTTACCTTC ATTTACATCT CATATGTTTG TAAATAAGCC CAATAGGCAG ACACCTCTAA CAAGGTGACA

CTGTCCTCTT TCCTTCCTAC CACAGCCCCC ACCTACCCAC CCCACTCCCA TTGATTCCAG AGGCGTGCCT

AGGCAGGATC TATGAGAAAA TATAACAGAG AGTAAGAGGA AAATTACCTT CTTTCTTTTT CCTTTCCCTG

CCTGACCTTA TTCACCTCCC ATCCCAGAGC ATCCATTTAT TCCATTGATC TTTACTGACA TCTATTATCT

GACCTACACA ATACTAGACA TTAGGACAAT GTGGCCTGCC TCCAAGAAAC TCAAATAAGC CAACTGAGAT

CAGAGAGGAT TAATCACCTG CCAATGGGCA CAAAGCAACA AGCTGGGAGC CAAGTCCCAA AATGGGGCCT

GCTGCTTCCA GTTCCCCTCT CTCTGCATTG ATGTCAGCAT TATCCTTCGT CCCAGTCCTG TCTCCACTAC

CACTTTCCCC CTCAAACACA CACACACACA ACAGCCTTAG ATGTTTTCTC CACTGATAAG TAGGTGACTC

AATTTGTAAG TATATAATCC AAGACCTTCT ATTCCCAAGT AGAATTTATG TGCCTGCCTG TGCTTTTCTA

CCTGGATCAA GTGATGTCTA CAGAGTAGGG CAGTAGCTTC ATTCATGAAC TCATTCAACA AGCATTATTC

ACTGAGAGCC TTGTATTTTT CAGGCATAGT GCCAACAGCA GTGTGGACAG TGGTGCATCA AAGCCTCTAG

TCTCATAGAA CTTAGTCTTC TGGAGGATAT GGAAAACAGA CAACCCAAAC AACCAACAAA AGAGCAAGAT

GCTGCAAAAA AAAAAAAAAT GAATAGGGTG CTAAGATAGA GAAAAGTGGG AGAGTGCTAT TTAGACAAAG

TGGTAAAAAC AAAGCCCCTT GTGAGATGAG AGCTGCCGAC AGAGGGGCG GGTCATGGTT GTGGGTTTTT

GGGTAGGACA TTCAGAGGAG GGGGCGGGTC GTGGTTGTGG GTTTTTGGGT AGGACATTCA GAGGAGGGGG

CGGGTCGTGG TTGTGGGTTT TTGGGTAGGA CATTCAGAGG AGGGGGCGGG TCGTGGTTGT GGGTTTTTGG

GTAGGACATT CAGAGGAGGG GGCGGGTCGT GGTTGTGGGT TTTTGGGACA TTCAGAGGAG TCTGAATGCA

CCCAGGCCTA CAACTTCAAG ATGGTAAAGG ACAGCTCCAA GGATCAGAAG AAGCATTCTT GGAACTGGGG

CATTTTGAGA AGGAGGAAAA ATATGCAGAG ACTAGTGCTT GCAGAGCTTG CATTTGGATT TCATTTGAGG

TACAATGAAA ACCCATTAAT GGGTTTCACA CAGTGCAATG GCCTGACCTC ACTTATATTT CCTAAAATAG

AAAACAGATC AGAAGGAAGG CAATAGAGAA GCAGAAAGTC CAATGAGGAG GTTTCACAGC AGTCATGGGG

GTGGGGTAAG GAAAAGAAGT GGAAAGAAAC AGACAGAATT GGGTTATATT TTGGAGATAG AACCAACAGA

AGGAAGAGGA GAAACAACAT TTACTGAGAA GGGAAAAAGT AGGAGAGGAA TAGGTTTGGG AAATAAATCC

TGCTGACATT GGAAACCCCA AGGAAGCCTC AAAAGTATAT TTACTTGCTT TAGATTTAAA AGAATAGGAA

AGAAGCATCT CAACTTGGAA TTTGAAATCT ATTTTTCCAT AAAAGTATTG TTAAATTCTA CTCATACTCA

CAAGAAAAGT ACATTCTAAA GAGTATATTG AAAGAGTTTA CTGATATACT TAGGAATTTT GTGTGTATGT

GTGTGTGTGT ATGTGTGTGT GTGTGTTTAA CCTTCAATTG TTGACTTAAA TACTGAGATA AATGTCATCT

AAATGCTAAA TTGATTTCCC AAAGGTATGA TTTGTTCACT TGGAGATCAA AATGTTTAGG GGGCTTAGAA

TCACTGTAGT GCTCAGATTT GATGCAAAAT GTCTTAGGCC TATGTTGAAG GCAGGACAGA AACAATGTTT

CCCTCCTACC TGCCTGGATA CAGTAAGATA CTAGTGTCAC TGACAATCTT CATAACTAAT TTAGATCTCT

CTCCAATCAA CTAAGGAAAT CAACTCTTAT TAATAGACTG GGCCACACAT CTACTAGGCA TGTAATAAAT
```

```
GCTTGCTGAA TGAACAAATG AATGAAGAGC CTATAGCATC ATGTTACAGC CATAGTCCTA AAGTGGTGTT

TCTCATGAAG GCCAAATGCT AAGGGATTGA GCTTCAGTCC TTTTTCTAAC ATCTTGTTCT CTAACAGAAT

TCTCTTCTTT TCTTCATAGG AGATGCCTGA GATACCCAAA ACCATCACAG GTAGTGAGAC CAACCTCCTC

TTCTTCTGGG AAACTCACGG CACTAAGAAC TATTTCACAT CAGTTGCCCA TCCAAACTTG TTTATTGCCA

CAAAGCAAGA CTACTGGGTG TGCTTGGCAG GGGGGCCACC CTCTATCACT GACTTTCAGA TACTGGAAAA

CCAGGCGTAG GTCTGGAGTC TCACTTGTCT CACTTGTGCA GTGTTGACAG TTCATATGTA CCATGTACAT

GAAGAAGCTA AATCCTTTAC TGTTAGTCAT TTGCTGAGCA TGTACTGAGC CTTGTAATTC TAAATGAATG

TTTACACTCT TTGTAAGAGT GGAACCAACA CTAACATATA ATGTTGTTAT TTAAAGAACA CCCTATATTT

TGCATAGTAC CAATCATTTT AATTATTATT CTTCATAACA ATTTTAGGAG GACCAGAGCT ACTGACTATG

GCTACCAAAA AGACTCTACC CATATTACAG ATGGGCAAAT TAAGGCATAA GAAAACTAAG AAATATGCAC

AATAGCAGTT GAAACAAGAA GCCACAGACC TAGGATTTCA TGATTTCATT TCAACTGTTT GCCTTCTGCT

TTTAAGTTGC TGATGAACTC TTAATCAAAT AGCATAAGTT TCTGGGACCT CAGTTTTATC ATTTTCAAAA

TGGAGGGAAT AATACCTAAG CCTTCCTGCC GCAACAGTTT TTTATGCTAA TCAGGGAGGT CATTTTGGTA

AAATACTTCT CGAAGCCGAG CCTCAAGATG AAGGCAAAGC ACGAAATGTT ATTTTTTAAT TATTATTTAT

ATATGTATTT ATAAATATAT TTAAGATAAT TATAATATAC TATATTTATG GAACCCCTT CATCCTCTGA

GTGTGACCAG GCATCCTCCA CAATAGCAGA CAGTGTTTTC TGGGATAAGT AAGTTTGATT TCATTAATAC

AGGGCATTTT GGTCCAAGTT GTGCTTATCC CATAGCCAGG AAACTCTGCA TTCTAGTACT TGGGAGACCT

GTAATCATAT AATAAATGTA CATTAATTAC CTTGAGCCAG TAATTGGTCC GATCTTTGAC TCTTTTGCCA

TTAAACTTAC CTGGGCATTC TTGTTTCATT CAATTCCACC TGCAATCAAG TCCTACAAGC TAAAATTAGA

TGAACTCAAC TTTGACAACC ATGAGACCAC TGTTATCAAA ACTTTCTTTT CTGGAATGTA ATCAATGTTT

CTTCTAGGTT CTAAAAATTG TGATCAGACC ATAATGTTAC ATTATTATCA ACAATAGTGA TTGATAGAGT

GTTATCAGTC ATAACTAAAT AAAGCTTGCA ACAAAATTCT CTGACACATA GTTATTCATT GCCTTAATCA

TTATTTTACT GCATGGTAAT TAGGGACAAA TGGTAAATGT TTACATAAAT AATTGTATTT AGTGTTACTT

TATAAAATCA AACCAAGATT TTATATTTTT TTCTCCTCTT TGTTAGCTGC CAGTATGCAT AAATGGCATT

AAGAATGATA ATATTTCCGG GTTCACTTAA AGCTCATATT ACACATACAC AAAACATGTG TTCCCATCTT

TATACAAACT CACACATACA GAGCTACATT AAAAACAACT AATAGGCCAG GCACGGTGGC TCAGACCTGT

AATCCCAGCA CTTTGGGAGG ACCAACCTCT TCGAGGCACA AGGCACAACA GGCTGCTCTG GGATTCTCTT

CAGCCAATCT TCATTGCTCA AGTGTCTGAA GCAGCCATGG CAGAAGTACC TGAGCTCGCC AGTGAAATGA

TGGCTTATTA CAGTGGCAAT GAGGATGACT TGTTCTTTGA AGCTGATGGC CCTAAACAGA TGAAGTGCTC

CTTCCAGGAC CTGGACCTCT GCCCTCTGGA TGGCGGCATC CAGCTACGAA TCTCCGACCA CCACTACAGC

AAGGGCTTCA GGCAGGCCGC GTCAGTTGTT GTGGCCATGG ACAAGCTGAG GAAGATGCTG GTTCCCTGCC

CACAGACCTT CCAGGAGAAT GACCTGAGCA CCTTCTTTCC CTTCATCTTT GAAGAAGAAC CTATCTTCTT

CGACACATGG GATAACGAGG CTTATGTGCA CGATGCACCT GTACGATCAC TGAACTGCAC GCTCCGGGAC

TCACAGCAAA AAAGCTTGGT GATGTCTGGT CCATATGAAC TGAAAGCTCT CCACCTCCAG GGACAGGATA

TGGAGCAACA AGTGGTGTTC TCCATGTCCT TTGTACAAGG AGAAGAAAGT AATGACAAAA TACCTGTGGC

CTTGGGCCTC AAGGAAAAGA ATCTGTACCT GTCCTGCGTG TTGAAAGATG ATAAGCCCAC TCTACAGCTG

GAGAGTGTAG ATCCCAAAAA TTACCCAAAG AAGAAGATGG AAAAGCGATT TGTCTTCAAC AAGATAGAAA

TCAATAACAA GCTGGAATTT GAGTCTGCCC AGTTCCCCAA CTGGTACATC AGCACCTCTC AAGCAGAAAA

CATGCCCGTC TTCCTGGGAG GGACCAAAGG CGGCCAGGAT ATAACTGACT TCACCATGCA ATTTGTGTCT
```

```
TCCTAAAGAG AGCTGTACCC AGAGAGTCCT GTGCTGAATG TGGACTCAAT CCCTAGGGCT GGCAGAAAGG
GAACAGAAAG GTTTTTGAGT ACGGCTATAG CCTGGACTTT CCTGTTGTCT ACACCAATGC CCAACTGCCT
GCCTTAGGGT AGTGCTAAGA GGATCTCCTG TCCATCAGCC AGGACAGTCA GCTCTCTCCT TTCAGGGCCA
ATCCCCAGCC CTTTTGTTGA GCCAGGCCTC TCTCACCTCT CCTACTCACT TAAAGCCCGC CTGACAGAAA
CCACGGCCAC ATTTGGTTCT AAGAAACCCT CTGTCATTCG CTCCCACATT CTGATGAGCA ACCGCTTCCC
TATTTATTTA TTTATTTGTT TGTTTGTTTT ATTCATTGGT CTAATTTATT CAAGGGGGC AAGAAGTAGC
AGTGTCTGTA AAAGAGCCTA GTTTTTAATA GCTATGGAAT CAATTCAATT TGGACTGGTG TGCTCTCTTT
AAATCAAGTC CTTTAATTAA GACTGAAAAT ATATAAGCTC AGATTATTTA AATGGGAATA TTTATAAATG
AGCAAATATC ATACTGTTCA ATGGTTCTGA AATAAACTTC TCTGAAG AGAAAGAAAG AGAGAGAGAA
AGAAAAGAAA GAGGAAGGAA GGAAGGAAGG AAGAAAGACA GGCTCTGAGG AAGGTGGCAG TTCCTACAAC
GGGAGAACCA GTGGTTAATT TGCAAAGTGG ATCCTGTGGA GGCANNCAGA GGAGTCCCCT AGGCCACCCA
GACAGGGCTT TTAGCTATCT GCAGGCCAGA CACCAAATTT CAGGAGGGCT CAGTGTTAGG AATGGATTAT
GGCTTATCAA ATTCACAGGA AACTAACATG TTGAACAGCT TTTAGATTTC CTGTGGAAAA TATAACTTAC
TAAAGATGGA GTTCTTGTGA CTGACTCCTG ATATCAAGAT ACTGGGAGCC AAATTAAAAA TCAGAAGGCT
GCTTGGAGAG CAAGTCCATG AAATGCTCTT TTTCCCACAG TAGAACCTAT TTCCCTCGTG TCTCAAATAC
TTGCACAGAG GCTCACTCCC TTGGATAATG CAGAGCGAGC ACGATACCTG GCACATACTA ATTTGAATAA
AATGCTGTCA AATTCCCATT CACCCATTCA AGCAGCAAAC TCTATCTCAC CTGAATGTAC ATGCCAGGCA
CTGTGCTAGA CTTGGCTCAA AAAGATTTCA GTTTCCTGGA GGAACCAGGA GGGCAAGGTT TCAACTCAGT
GCTATAAGAA GTGTTACAGG CTGGACACGG TGGCTCACGC CTGTAATCCC AACATTTGGG AGGCCGAGGC
GGGCAGATCA CAAGGTCAGG AGATCGAGAC CATCCTGGCT AACATGGTGA AACCCTGTCT CTACTAAAAA
TACAAAAAAT TAGCCGGGCG TTGGCGGCAG GTGCCTGTAG TCCCAGCTGC TGGGGAGGCT GAGGCAGGAG
AATGGTGTGA ACCCGGGAGG CGGAACTTGC AGGGGGCCGA GATCGTGCCA CTGCACTCCA GCCTGGGCGA
CAGAGTGAGA CTCTGTCTCA AAAAAAAAAA AAAAGTGTTA TGATGCAGAC CTGTCAAAGA GGCAAAGGAG
GGTGTTCCTA CACTCCAGGC ACTGTTCATA ACCTGGACTC TCATTCATTC TACAAATGGK GGGCTCCCCT
GGGCAGATCC CTGGAGCAGG CACTTTGCTG GTGTCTCGGT TAAAGAGAAA CTGATAACTC TTGGTATTAC
CAAGAGATAG AGTCTCAGAT GGATATTCTT ACAGAAACAA TATTCCCACT TTTCAGAGTT CACCAAAAAA
TCATTTTAGG CAGAGCTCAT CTGGCATTGA TCTGGTTCAT CCATGAGATT GGCTAGGGTA ACAGCACCTG
GTCTTGCAGG GTTGTGTGAG CTTATCTCCA GGGTTGCCCC AACTCCGTCA GGAGCCTGAA CCCTGCATAC
CGTATGTTCT CTGCCCCAGC CAAGAAAGGT CAATTTTCTC CTCAGAGGCT CCTGCAATTG ACAGAGAGCT
CCCGAGGCAG AGAACAGCAC CCAAGGTAGA GACCCACACC CTCAATACAG ACAGGGAGG CTATTGGCCC
TTCATTGTAC CCATTTATCC ATCTGTAAGT GGGAAGATTC CTAAACTTAA GTACAAAGAA GTGAATGAAG
AAAAGTATGT GCATGTATAA ATCTGTGTGT CTTCCACTTT GTCCCACATA TACTAAATTT AAACATTCTT
CTAACGTGGG AAAATCCAGT ATTTTAATGT GGACATCAAC TGCACAACGA TTGTCAGGAA ACAATGCAT
ATTTGCATGG TGATACATTT GCAAAATGTG TCATAGTTTG CTACTCCTTG CCCTTCCATG AACCAGAGAA
TTATCTCAGT TTATTAGTCC CCTCCCCTAA GAAGCTTCCA CCAATACTCT TTTCCCCTTT CCTTTAACTT
GATTGTGAAA TCAGGTATTC AACAGAGAAA TTTCTCAGCC TCCTACTTCT GCTTTTGAAA GCTATAAAAA
CAGCGAGGGA GAAACTGGCA GATACCAAAC CTCTTCGAGG CACAAGGCAC AACAGGCTGC TCTGGGATTC
TCTTCAGCCA ATCTTCATTG CTCAAGTATG ACTTTAATCT TCCTTACAAC TAGGTGCTAA GGGAGTCTCT
CTGTCTCTCT GCCTCTTTGT GTGTATGCAT ATTCTCTCTC TCTCTCTCTT TCTTTCTCTG TCTCTCCTCT
CCTTCCTCTC TGCCTCCTCT CTCAGCTTTT TGCAAAAATG CCAGGTGTAA TATAATGCTT ATGACTCGGG
```

```
AAATATTCTG GGAATGGATA CTGCTTATCT AACAGCTGAC ACCCTAAAGG TTAGTGTCAA AGCCTCTGCT

CCAGCTCTCC TAGCCAATAC ATTGCTAGTT GGGGTTTGGT TTAGCAAATG CTTTTCTCTA GACCCAAAGG

ACTTCTCTTT CACACATTCA TTCATTTACT CAGAGATCAT TTCTTTGCAT GACTGCCATG CACTGGATGC

TGAGAGAAAT CACACATGAA CGTAGCCGTC ATGGGAAGT CACTCATTTT CTCCTTTTTA CACAGGTGTC

TGAAGCAGCC ATGGCAGAAG TACCTGAGCT CGCCAGTGAA ATGATGGCTT ATTACAGGTC AGTGGAGACG

CTGAGACCAG TAACATGAGC AGGTCTCCTC TTTCAAGAGT AGAGTGTTAT CTGTGCTTGG AGACCAGATT

TTTCCCCTAA ATTGCCTCTT TCAGTGGCAA ACAGGGTGCC AAGTAAATCT GATTTAAAGA CTACTTTCCC

ATTACAAGTC CCTCCAGCCT TGGGACCTGG AGGCTATCCA GATGTGTTGT TGCAAGGGCT TCCTGCAGAG

GCAAATGGGG AGAAAAGATT CCAAGCCCAC AATACAAGGA ATCCCTTTGC AAAGTGTGGC TTGGAGGGAG

AGGGAGAGCT CAGATTTTAG CTGACTCTGC TGGGCTAGAG GTTAGGCCTC AAGATCCAAC AGGGAGCACC

AGGGTGCCCA CCTGCCAGGC CTAGAATCTG CCTTCTGGAC TGTTCTGCGC ATATCACTGT GAAACTTGCC

AGGTGTTTCA GGCAGCTTTG AGAGGCAGGC TGTTTGCAGT TTCTTATGAA CAGTCAAGTC TTGTACACAG

GGAAGGAAAA ATAAACCTGT TTAGAAGACA TAATTGAGAC ATGTCCCTGT TTTTATTACA GTGGCAATGA

GGATGACTTG TTCTTTGAAG CTGATGGCCC TAAACAGATG AAGGTAAGAC TATGGGTTTA ACTCCCAACC

CAAGGAAGGG CTCTAACACA GGGAAAGCTC AAAGAAGGGA GTTCTGGGCC ACTTTGATGC CATGGTATTT

TGTTTTAGAA AGACTTTAAC CTCTTCCAGT GAGACACAGG CTGCACCACT TGCTGACCTG GCCACTTGGT

CATCATATCA CCACAGTCAC TCACTAACGT TGGTGGTGGT GGCCACACTT GGTGGTGACA GGGGAGGAGT

AGTGATAATG TTCCCATTTC ATAGTAGGAA GACAACCAAG TCTTCAACAT AAATTTGATT ATCCTTTTAA

GAGATGGATT CAGCCTATGC CAATCACTTG AGTAAACTC TGAAACCAAG AGATGATCTT GAGAACTAAC

ATATGTCTAC CCCTTTTGAG TAGAATAGTT TTTTGCTACC TGGGGTGAAG CTTATAACAA CAAGACATAG

ATGATATAAA CAAAAAGATG AATTGAGACT TGAAAGAAAA CCATTCACTT GCTGTTTGAC CTTGACAAGT

CATTTTACCC GCTTTGGACC TCATCTGAAA ATAAAGGGC TGAGCTGGAT GATCTCTGAG ATTCCAGCAT

CCTGCAACCT CCAGTTCTGA AATATTTTCA GTTGTAGCTA AGGGCATTTG GCAGCAAAT GGTCATTTTT

CAGACTCATC CTTACAAAGA GCCATGTTAT ATTCCTGCTG TCCCTTCTGT TTTATATGAT GCTCAGTAGC

CTTCCTAGGT GCCCAGCCAT CAGCCTAGCT AGGTCAGTTG TGCAGGTTGG AGGCAGCCAC TTTTCTCTGG

CTTTATTTTA TTCCAGTTTG TGATAGCCTC CCCTAGCCTC ATAATCCAGT CCTCAATCTT GTTAAAAACA

TATTTCTTTA GAAGTTTTAA GACTGGCATA ACTTCTTGGC TGCAGCTGTG GGAGGAGCCC ATTGGCTTGT

CTGCCTGGCC TTTGCCCCCC ATTGCCTCTT CCAGCAGCTT GGCTCTGCTC CAGGCAGGAA ATTCTCTCCT

GCTCAACTTT CTTTTGTGCA CTTACAGGTC TCTTTAACTG TCTTTCAAGC CTTTGAACCA TTATCAGCCT

TAAGGCAACC TCAGTGAAGC CTTAATACGG AGCTTCTCTG AATAAGAGGA AAGTGGTAAC ATTTCACAAA

AAGTACTCTC ACAGGATTTG CAGAATGCCT ATGAGACAGT GTTATGAAAA AGGAAAAAAA AGAACAGTGT

AGAAAAATTG AATACTTGCT GAGTGAGCAT AGGTGAATGG AAAATGTTAT GGTCATCTGC ATGAAAAAGC

AAATCATAGT GTGACAGCAT TAGGGATACA AAAAGATATA GAGAAGGTAT ACATGTATGG TGTAGGTGGG

GCATGTACAA AAAGATGACA AGTAGAATCG GGATTTATTC TAAAGAATAG CCTGTAAGGT GTCCAGAAGC

CACATTCTAG TCTTGAGTCT GCCTCTACCT GCTGTGTGCC CTTGAGTACA CCCTTAACCT CCTTGAGCTT

CAGAGAGGGA TAATCTTTTT ATTTATTTT ATTTTATTTT GTTTTGTTTT GTTTTGTTTT GTTTTATGAG

ACAGAGTCTC ACTCTGTTGC CCAGGCTGGA GTGCAGTGGT ACAATCTTGG CTTACTGCAT CCTCCACCTC

CTGAGTTCAA GCGATTCTCC TTCCTCAGTC TCCTGAATAG CTAGGATTAC AGGTGCACCC CACCACACCC

AGCTAATTTT TGTATTTTTA GTAGAGAAGG GGTTTCGCCA TGTTGGCCAG GCTGGTTTTG AAGTCCTGAC
```

```
CTAAATGATT CATCCACCTC GGCTTCCCAA AGTGCTGGGA TTACAGGCAT GAGCCACCAC GCCTGGCCCA
GAGAGGGATG ATCTTTAGAA GCTCGGGATT CTTTCAAGCC CTTTCCTCCT CTCTGAGCTT TCTACTCTCT
GATGTCAAAG CATGGTTCCT GGCAGGACCA CCTCACCAGG CTCCCTCCCT CGCTCTCTCC GCAGTGCTCC
TTCCAGGACC TGGACCTCTG CCCTCTGGAT GGCGGCATCC AGCTACGAAT CTCCGACCAC CACTACAGCA
AGGGCTTCAG GCAGGCCGCG TCAGTTGTTG TGGCCATGGA CAAGCTGAGG AAGATGCTGG TTCCCTGCCC
ACAGACCTTC CAGGAGAATG ACCTGAGCAC CTTCTTTCCC TTCATCTTTG AAGAAGGTAG TTAGCCAAGA
GCAGGCAGTA GATCTCCACT TGTGTCCTCT TGGAAGTCAT CAAGCCCCAG CCAACTCAAT TCCCCCAGAG
CCAAAGCCCT TTAAAGGTAG AAGGCCCAGC GGGGAGACAA AACAAAGAAG GCTGGAAACC AAAGCAATCA
TCTCTTTAGT GGAAACTATT CTTAAAGAAG ATCTTGATGG CTACTGACAT TTGCAACTCC CTCACTCTTT
CTCAGGGCC TTTCACTTAC ATTGTCACCA GAGGTTCGTA ACCTCCCTGT GGGCTAGTGT TATGACCATC
ACCATTTTAC CTAAGTAGCT CTGTTGCTCG GCCACAGTGA GCAGTAATAG ACCTGAAGCT GGAACCCATG
TCTAATAGTG TCAGGTCCAG TGTTCTTAGC CACCCCACTC CCAGCTTCAT CCCTACTGGT GTTGTCATCA
GACTTTGACC GTATATGCTC AGGTGTCCTC CAAGAAATCA AATTTTGCCA CCTCGCCTCA CGAGGCCTGC
CCTTCTGATT TTATACCTAA ACAACATGTG CTCCACATTT CAGAACCTAT CTTCTTCGAC ACATGGGATA
ACGAGGCTTA TGTGCACGAT GCACCTGTAC GATCACTGAA CTGCACGCTC CGGGACTCAC AGCAAAAAAG
CTTGGTGATG TCTGGTCCAT ATGAACTGAA AGCTCTCCAC CTCCAGGGAC AGGATATGGA GCAACAAGGT
AAATGGAAAC ATCCTGGTTT CCCTGCCTGG CCTCCTGGCA GCTTGCTAAT TCTCCATGTT TTAAACAAAG
TAGAAAGTTA ATTTAAGGCA AATGATCAAC ACAAGTGAAA AAAATATTA AAAGGAATA TACAAACTTT
GGTCCTAGAA ATGGCACATT TGATTGCACT GGCCAGTGCA TTTGTTAACA GGAGTGTGAC CCTGAGAAAT
TAGACGGCTC AAGCACTCCC AGGACCATGT CCACCCAAGT CTCTTGGGCA TAGTGCAGTG TCAATTCTTC
CACAATATGG GGTCATTTGA TGGACATGGC CTAACTGCCT GTGGGTTCTC TCTTCCTGTT GTTGAGGCTG
AAACAAGAGT GCTGGAGCGA TAATGTGTCC ATCCCCCTCC CCAGTCTTCC CCCCTTGCCC CAACATCCGT
CCCACCCAAT GCCAGGTGGT TCCTTGTAGG GAAATTTTAC CGCCCAGCAG GAACTTATAT CTCTCCGCTG
TAACGGGCAA AAGTTTCAAG TGCGGTGAAC CCATCATTAG CTTTGGTGAT CTGCCTGGCA TCGTGCCACA
GTAGCCAAAG CCTCTGCACA GGAGTGTGGG CAACTAAGGC TGCTGACTTT GAAGGACAGC CTCACTCAGG
GGGAAGCTAT TTGCTCTCAG CCAGGCCAAG AAAATCCTGT TTCTTTGGAA TCGGGTAGTA AGAGTGATCC
CAGGGCCTCC AATTGACACT GCTGTGACTG AGGAAGATCA AAATGAGTGT CTCTCTTTGG AGCCACTTTC
CCAGCTCAGC CTCTCCTCTC CCAGTTTCTT CCCATGGGCT ACTCTCTGTT CCTGAAACAG TTCTGGTGCC
TGATTTCTGG CAGAAGTACA GCTTCACCTC TTTCCTTTCC TTCCACATTG ATCAAGTTGT TCCGCTCCTG
TGGATGGGCA CATTGCCAGC CAGTGACACA ATGGCTTCCT TCCTTCCTTC CTTCAGCATT TAAAATGTAG
ACCCTCTTTC ATTCTCCGTT CCTACTGCTA TGAGGCTCTG AGAAACCCTC AGGCCTTTGA GGGGAAACCC
TAAATCAACA AAATGACCCT GCTATTGTCT GTGAGAAGTC AAGTTATCCT GTGTCTTAGG CCAAGGAACC
TCACTGTGGG TTCCCACAGA GGCTACCAAT TACATGTATC CTACTCTCGG GCTAGGGGT TGGGGTGACC
CTGCATGCTG TGTCCCTAAC CACAAGACCC CCTTCTTTCT TCAGTGGTGT TCTCCATGTC CTTTGTACAA
GGAGAAGAAA GTAATGACAA AATACCTGTG GCCTGGGCC TCAAGGAAAA GAATCTGTAC CTGTCCTGCG
TGTTGAAAGA TGATAAGCCC ACTCTACAGC TGGAGGTAAG TGAATGCTAT GGAATGAAGC CCTTCTCAGC
CTCCTGCTAC CACTTATTCC CAGACAATTC ACCTTCTCCC CGCCCCATC CCTAGGAAAA GCTGGGAACA
GGTCTATTTG ACAAGTTTTG CATTAATGTA AATAAATTTA ACATAATTTT TAACTGCGTG CAACCTTCAA
TCCTGCTCCA GAAAATTAAA TCATTTTGCC GATGTTATTA TGTCCTACCA TAGTTACAAC CCCAACAGAT
TATATATTGT TAGGGCTGCT CTCATTTGAT AGACACCTTG GGAAATAGAT GACTTAAAGG GTCCCATTAT
```

```
CACGTCCACT CCACTCCCAA AATCACCACC ACTATCACCT CCAGCCTTCT CAGCAAAAGC TTCATTTCCA

AGTTGATGTC ATTCTAGGAC CATAAGGAAA AATACAATAA AAAGCCCCTG GAAACTAGGT ACTTCAAGAA

GCTCTAGCTT AATTTTCACC CCCCCAAAAA AAAAAAATTC TCACCTACAT TATGCTCCTC AGCATTTGGC

ACTAAGTTTT AGAAAAGAAG AAGGGCTCTT TTAATAATCA CACAGAAAGT TGGGGCCCA GTTACAACTC -

AGGAGTCTGG CTCCTGATCA TGTGACCTGC TCGTCAGTTT CCTTTCTGGC CAACCCAAAG AACATCTTTC

CCATAGGCAT CTTTGTCCCT TGCCCCACAA AAATTCTTCT TTCTCTTTCG CTGCAGAGTG TAGATCCCAA

AAATTACCCA AGAAGAAGA TGGAAAAGCG ATTTGTCTTC AACAAGATAG AAATCAATAA CAAGCTGGAA

TTTGAGTCTG CCCAGTTCCC CAACTGGTAC ATCAGCACCT CTCAAGCAGA AACATGCCC GTCTTCCTGG

GAGGGACCAA AGGCGGCCAG GATATAACTG ACTTCACCAT GCAATTTGTG TCTTCCTAAA GAGAGCTGTA

CCCAGAGAGT CCTGTGCTGA ATGTGGACTC AATCCCTAGG GCTGGCAGAA AGGGAACAGA AAGGTTTTTG

AGTACGGCTA TAGCCTGGAC TTTCCTGTTG TCTACACCAA TGCCCAACTG CCTGCCTTAG GGTAGTGCTA

AGAGGATCTC CTGTCCATCA GCCAGGACAG TCAGCTCTCT CCTTTCAGGG CCAATCCCCA GCCCTTTTGT

TGAGCCAGGC CTCTCTCACC TCTCCTACTC ACTTAAAGCC CGCCTGACAG AAACCACGGC CACATTTGGT

TCTAAGAAAC CCTCTGTCAT TCGCTCCCAC ATTCTGATGA GCAACCGCTT CCCTATTTAT TTATTTATTT

GTTTGTTTGT TTTGATTCAT TGGTCTAATT TATTCAAAGG GGGCAAGAAG TAGCAGTGTC TGTAAAAGAG

CCTAGTTTTT AATAGCTATG GAATCAATTC AATTTGGACT GGTGTGCTCT CTTTAAATCA AGTCCTTTAA

TTAAGACTGA AAATATATAA GCTCAGATTA TTTAAATGGG AATATTTATA AATGAGCAAA TATCATACTG

TTCAATGGTT CTGAAATAAA CTTCACTGAA GAAAAAAAA AAAGGGTCTC TCCTGATCAT TGACTGTCTG

GATTGACACT GACAGTAAGC AAACAGGCTG TGAGAGTTCT TGGGACTAAG CCCACTCCTC ATTGCTGAGT

GCTGCAAGTA CCTAGAAATA TCCTTGGCCA CCGAAGACTA TCCTCCTCAC CCATCCCCTT TATTTCGTTG

TTCAACAGAA GGATATTCAG TGCACATCTG AACAGGATC AGCTGAAGCA CTGCAGGGAG TCAGGACTGG

TAGTAACAGC TACCATGATT TATCTATCAA TGCACCAAAC ATCTGTTGAG CAAGCGCTAT GTACTAGGAG

CTGGGAGTAC AGAGATGAGA ACAGTCACAA GTCCCTCCTC AGATAGGAGA GGCAGCTAGT TATAAGCAGA

ACAAGGTAAC ATGACAAGTA GAGTAAGATA GAAGAACGAA GAGGAGTAGC CAGGAAGGAG GGAGGAGAAC

GACATAAGAA TCAAGCCTAA AGGGATAAAC AGAAGATTTC CACACATGGG CTGGGCCAAT TGGGTGTCGG

TTACGCCTGT AATCCCAGCA CTTTGGGTGG CAGGGGCAGA AGATCGCTT GAGCCCAGGA GTTCAAGACC

AGCCTGGGCA ACATAGTGAG ACTCCCATCT CTACAAAAAA TAAATAAATA AATAAAACAA TCAGCCAGGC

ATGCTGGCAT GCACCTGTAG TCCTAGCTAC TTGGGAAGCT GACACTGGAG GATTGCTTGA GCCCAGAAGT

TCAAGACTGC AGTGAGCTTA TCCGTTGACC TGCAGGTCGA C ACAAACCTTT TCGAGGCAAA AGGCAAAAAA

GGCTGCTCTG GGATTCTCTT CAGCCAATCT TCAATGCTCA AGTGTCTGAA GCAGCCATGG CAGAAGTACC

TAAGCTCGCC AGTGAAATGA TGGCTTATTA CAGTGGCAAT GAGGATGACT TGTTCTTTGA AGCTGATGGC

CCTAAACAGA TGAAGTGCTC CTTCCAGGAC CTGGACCTCT GCCCTCTGGA TGGCGGCATC CAGCTACGAA

TCTCCGACCA CCACTACAGC AAGGGCTTCA GGCAGGCCGC GTCAGTTGTT GTGGCCATGG ACAAGCTGAG

GAAGATGCTG GTTCCCTGCC CACAGACCTT CCAGGAGAAT GACCTGAGCA CCTTCTTTCC CTTCATCTTT

GAAGAAGAAC CTATCTTCTT CGACACATGG GATAACGAGG CTTATGTGCA CGATGCACCT GTACGATCAC

TGAACTGCAC GCTCCGGGAC TCACAGCAAA AAGCTTGGT GATGTCTGGT CCATATGAAC TGAAAGCTCT

CCACCTCCAG GGACAGGATA TGGAGCAACA AGTGGTGTTC TCCATGTCCT TTGTACAAGG AGAAGAAAGT

AATGACAAAA TACCTGTGGC CTTGGGCCTC AAGGAAAAGA ATCTGTACCT GTCCTGCGTG TTGAAAGATG

ATAAGCCCAC TCTACAGCTG GAGAGTGTAG ATCCCAAAAA TTACCCAAAG AAGAAGATGG AAAAGCGATT
```

```
TGTCTTCAAC AAGATAGAAA TCAATAACAA GCTGGAATTT GAGTCTGCCC AGTTCCCCAA CTGGTACATC

AGCACCTCTC AAGCAGAAAA CATGCCCGTC TTCCTGGGAG GGACCAAAGG CGGCCAGGAT ATAACTGACT

TCACCATGCA ATTTGTGTCT TCCTAAAGAG AGCTGTACCC AGAGAGTCCT GTGCTGAATG TGGACTCAAT

CCCTAGGGCT GGCAGAAAGG GAACAGAAAG GTTTTTGAGT ACGGCTATAG CCTGGACTTT CCTGTTGTCT

ACACCAATGC CCAACTGCCT GCCTTAGGGT AGTGCTAAGA GGATCTCCTG TCCATCAGCC AGGACAGTCA

GCTCTCTCCT TTCAGGGCCA ATCCCAGCCC TTTTGTTGAG CCAGGCCTCT CTCACCTCTC CTACTCACTT

AAAGCCCGCC TGACAGAAAC CAGGCCACAT TTTGGTTCTA AGAAACCCTC CTCTGTCATT CGCTCCCACA

TTCTGATGAG CAACCGCTTC CCTATTTATT TATTTATTTG TTTGTTTGTT TTGATTCATT GGTCTAATTT

ATTCAAAGGG GGCAAGAAGT AGCAGTGTCT GTAAAAGAGC CTAGTTTTTA ATAGCTATGG AATCAATTCA

ATTTGGACTG GTGTGCTCTC TTTAAATCAA GTCCTTTAAT TAAGACTGAA AATATATAAG CTCAGATTAT

TTAAATGGGA ATATTTATAA ATGAGCAAAT ATCATACTGT TCAATGGTTC TCAAATAAAC TTCACT

CTGGCAGGAG TAGCAGCTGC CCCTTGGCGC GACTGCTGGA GCCGCGAACT AGAGAAACAC AGACACGCCT

CATAGAGCAA CGGCGTCTCT CGGAGCGTGG AGCCCGCCAA GCTCGAGCTG AGCTTTCGCT TGCCGTCCAC

CACTGCCCAC ACTGTCGTTT GCTGCCATCG CAGACCTGCT GCTGACTTCC ATCCCTCTGG ATCCGGCAAG

GGCCTGCGAT TTTGACAATG TCAAGATTTA CCGTATATCC CTGTTTGTTT GGATACACCA GTGACGTCCA

CTTCTAGAAG ACAAAGTTAT ATTACTTAAA CAACCAAAGA TATGAAACTA TCCATGAAGA ACAATATTAT

CAATACACAG CAGTCTTTTG TAACCATGCC CAATGTGATT GTACCAGATA TTGAAAAGGA AATACGAAGG

ATGGAAAATG GAGCATGCAG CTCCTTTTCT GAGGATGATG ACAGTGCCTC TACATCTGAA GAATCAGAGA

ATGAAAACCC TCATGCAAGG GGTTCCTTTA GTTATAAGTC ACTCAGAAAG GGAGGACCAT CACAGAGGGA

GCAGTACCTG CCTGGTGCCA TTGCCATTTT TAATGTGAAC AACAGCGACA ATAAGGACCA GGAACCAGAA

GAAAAAAGA AAAAGAAAAA AGAAAAGAAG AGCAAGTCAG ATGATAAAAA CGAAAATAAA AACGACCCAA

AGAAGAAGAT GGAAAAGCGA ATGGCCAAAG TTCCAGACAT GTTTGAAGAC CTGAAGAACT GTTACAGTGA

AAATGAAGAA GACAGTTCCT CCATTGATCA TCTGTCTCTG AATCAGAAAT CCTTCTATCA TGTAAGCTAT

GGCCCACTCC ATGAAGGCTG CATGGATCAA TCTGTGTCTC TGAGTATCTC TGAAACCTCT AAAACATCCA

AGCTTACCTT CAAGGAGAGC ATGGTGGTAG TAGCAACCAA CGGGAAGGTT CTGAAGAAGA GACGGTTGAG

TTTAAGCCAA TCCATCACTG ATGATGACCT GGAGGCCATC GCCAATGACT CAGAGGAAGA AATCATCAAG

CCTAGGTCAG CACCTTTTAG CTTCCTGAGC AATGTGAAAT ACAACTTTAT GAGGATCATC AAATACGAAT

TCATCCTGAA TGACGCCCTC AATCAAAGTA TAATTCGAGC CAATGATCAG TACCTCACGG CTGCTGCATT

ACATAATCTG GATGAAGCAG TGAAATTTGA CATGGGTGCT TATAAGTCAT CAAAGGATGA TGCTAAAATT

ACCGTGATTC TAAGAATCTC AAAAACTCAA TTGTATGTGA CTGCCCAAGA TGAAGACCAA CCAGTGCTGC

TGAAGGAGAT GCCTGAGATA CCCAAAACCA TCACAGGTAG TGAGACCAAC CTCCTCTTCT TCTGGGAAAC

TCACGGCACT AAGAACTATT TCACATCAGT TGCCCATCCA AACTTGTTTA TTGCCACAAA GCAAGACTAC

TGGGTGTGCT TGGCAGGGGG GCCACCCTCT ATCACTGACT TTCAGATACT GGAAAACCAG GCGTAGGTCT

GGAGTCTCAC TTGTCTCACT TGTGCAGTGT TGACAGTTCA TATGTACCAT GTACATGAAG AAGCTAAATC

CTTTACTGTT AGTCATTTGC TGAGCATGTA CTGAGCCTTG TAATTCTAAA TGAATGTTTA CACTCTTTGT

AAGAGTGGAA CCAACACTAA CATATAATGT TGTTATTTAA AGAACACCCT ATATTTTGCA TAGTACCAAT

CATTTTAATT ATTATTCTTC ATAACAATTT TAGGAGGACC AGAGCTACTG ACTATGGCTA CCAAAAAGAC

TCTACCCATA TTACAGATGG GCAAATTAAG GCATAAGAAA ACTAAGAAAT ATGCACAATA GCAGTTGAAA

CAAGAAGCCA CAGACCTAGG ATTTCATGAT TTCATTTCAA CTGTTTGCCT TCTGCTTTTA AGTTGCTGAT

GAACTCTTAA TCAAATAGCA TAAGTTTCTG GGACCTCAGT TTTATCATTT TCAAAATGGA GGGAATAATA
```

```
CCTAAGCCTT CCTGCCGCAA CAGTTTTTTA TGCTAATCAG GGAGGTCATT TTGGTAAAAT ACTTCTCGAA
GCCGAGCCTC AAGATGAAGG CAAAGCACGA AATGTTATTT TTTAATTATT ATTTATATAT GTATTTATAA
ATATATTTAA GATAATTATA ATATACTATA TTTATGGGAA CCCCTTCATC CTCTGAGTGT GACCAGGCAT
CCTCCACAAT AGCAGACAGT GTTTTCTGGG ATAAGTAAGT TTGATTTCAT TAATACAGGG CATTTTGGTC
CAAGTTGTGC TTATCCCATA GCCAGGAAAC TCTGCATTCT AGTACTTGGG AGACCTGTAA TCATATAATA
AATGTACATT AATTACCTTG AGCCAGTAAT TGGTCCGATC TTTGACTCTT TTGCCATTAA ACTTACCTGG
GCATTCTTGT TTCATTCAAT TCCACCTGCA ATCAAGTCCT ACAAGCTAAA ATTAGATGAA CTCAACTTTG
ACAACCATAG ACCACTGTTA TCAAAACTTT CTTTTCTGGA ATGTAATCAA TGTTTCTTCT AGGTTCTAAA
AATTGTGATC AGACCATAAT GTTACATTAT TATCAACAAT AGTGATTGAT AGAGTGTTAT CAGTCATAAC
TAAATAAAGC TTGCAAGTGA GGGAGTCATT TCATTGGCGT TTGAGTCAGC AAAGAAGTCA AG AGCTGCCAGC
CAGAGAGGGA GTCATTTCAT TGGCGTTTGA GTCAGCAAAG AAGTCAAGAT GGCCAAAGTT CCAGACATGT
TTGAAGACCT GAAGAACTGT TACAGTGAAA ATGAAGAAGA CAGTTCCTCC ATTGATCATC TGTCTCTGAA
TCAGAAATCC TTCTATCATG TAAGCTATGG CCCACTCCAT GAAGGCTGCA TGGATCAATC TGTGTCTCTG
AGTATCTCTG AAACCTCTAA AACATCCAAG CTTACCTTCA AGGAGAGCAT GGTGGTAGTA GCAACCAACG
GGAAGGGTCT GAAGAAGAGA CGGTTGAGTT TAAGCCAATC CATCACTGAT GATGACCTGG AGGCCATCGC
CAATGACTCA GAGGAAGAAA TCATCAAGCC TAGGTCATCA CCTTTTAGCT TCCTGAGCAA TGTGAAATAC
AACTTTATGA GGATCATCAA ATACGAATTC ATCCTGAATG ACGCCCTCAA TCAAAGTATA ATTCGAGCCA
ATGATCAGTA CCTCACGGCT GCTGCATTAC ATAATCTGGA TGAAGCAGTG AAATTTGACA TGGGTGCTTA
TAAGTCATCA AAGGATGATG CTAAAATTAC CGTGATTCTA AGAATCTCAA AAACTCAATT GTATGTGACT
GCCCAAGATG AAGACCAACC AGTGCTGCTG AAGGAGATGC CTGAGATACC CAAAACCATC ACAGGTAGTG
AGACCAACCT CCTCTTCTTC TGGGAAACTC ACGGCACTAA GAACTATTTC ACATCAGTTG CCCATCCAAA
CTTGTTTATT GCCACAAAGC AAGACTACTG GGTGTGCTTG GCAGGGGGGC CACCCTCTAT CACTGACTTT
CAGATACTGG AAAACCAGGC GTAGGTCTGG AGTCTCACTT GTCTCACTTG TGCAGTGTTG ACAGTTCATA
TGTACCATGT ACATGAAGAA GCTAAATCCT TTACTGTTAG TCATTTGCTG AGCATGTACT GAGCCTTGTA
ATTCTAAATG AATGTTTACA CTCTTTGTAA GAGTGGAACC AACACTAACA TATAATGTTG TTATTTAAAG
AACACCCTAT ATTTTGCATA GTACCAATCA TTTTAATTAT TATTCTTCAT AACAATTTTA GGAGGACCAG
AGCTACTGAC TATGGCTACC AAAAAGACTC TACCCATATT ACAGATGGGC AAATTAAGGC ATAAGAAAAC
TAAGAAATAT GCACAATAGC AGTCGAAACA AGAAGCCACA GACCTAGGAT TTCATGATTT CATTTCAACT
GTTTGCCTTC TGCTTTTAAG TTGCTGATGA ACTCTTAATC AAATAGCATA AGTTTCTGGG ACCTCAGTTT
TATCATTTTC AAAATGGAGG GAATAATACC TAAGCCTTCC TGCCGCAACA GTTTTTTATG CTAATCAGGG
AGGTCATTTT GGTAAAATAC TTCTCGAAGC CGAGCCTCAA GATGAAGGCA AAGCACGAAA TGTTATTTTT
TAATTATTAT TTATATATGT ATTTATAAAT ATTTAAGA TAATTATAAT ATACTATATT TATGGGAACC
CCTTCATCCT CTGAGTGTGA CCAGGCATCC TCCACAATAG CAGACAGTGT TTTCTGGGAT AAGTAAGTTT
GATTTCATTA ATACAGGGCA TTTTGGTCCA AGTTGTGCTT ATCCCATAGC CAGGAAACTC TGCATTCTAG
TACTTGGGAG ACCTGTAATC ATATAATAAA TGTACATTAA TTACCTTGAG CCAGTAATTG GTCCGATCTT
TGACTCTTTT GCCATTAAAC TTACCTGGGC ATTCTTGTTT CATTCAATTC CACCTGCAAT CAAGTCCTAC
AAGCTAAAAT TAGATGAACT CAACTTTGAC AACCATGAGA CCACTGTTAT CAAAACTTTC TTTTCTGGAA
TGTAATCAAT GTTTCTTCTA GGTTCTAAAA ATTGTGATCA GACCATAATG TTACATTATT ATCAACAATA
GTGATTGATA GAGTGTTATC AGTCATAACT AAATAAAGCT TGCAACAAAA TTCTCTG GCTCAGGGCA
```

```
CATGCCTCCC CTCCCCAGGC CGCGGCCCAG CTGACCCTCG GGGCTCCCCC GGCAGCGGAC AGGGAAGGGT
TAAAGGCCCC CGGCTCCCTG CCCCCTGCCC TGGGGAACCC CTGGCCCTGT GGGGACATGA ACTGTGTTTG
CCGCCTGGTC CTGGTCGTGC TGAGCCTGTG GCCAGATACA GCTGTCGCCC CTGGGCCACC ACCTGGCCCC
CCTCGAGTTT CCCCAGACCC TCGGGCCGAG CTGGACAGCA CCGTGCTCCT GACCCGCTCT CTCCTGGCGG
ACACGCGGCA GCTGGCTGCA CAGCTGAGGG ACAAATTCCC AGCTGACGGG ACCACAACC TGGATTCCCT
GCCCACCCTG GCCATGAGTG CGGGGGCACT GGGAGCTCTA CAGCTCCCAG GTGTGCTGAC AAGGCTGCGA
GCGGACCTAC TGTCCTACCT GCGGCACGTG CAGTGGCTGC GCCGGGCAGG TGGCTCTTCC CTGAAGACCC
TGGAGCCCGA GCTGGGCACC CTGCAGGCCC GACTGGACCG GCTGCTGCGC CGGGTGCAGC TCCTGATGTC
CCGCCTGGCC CTGCCCCAGC CACCCCCGGA CCCGCCGGCG CCCCCGCTGG CGCCCCCCTC CTCAGCCTGG
GGGGGCATCA GGGCCGCCCA CGCCATCCTG GGGGGGCTGC ACCTGACACT TGACTGGGCC GTGAGGGGAC
TGCTGCTGCT GAAGACTCGG CTGTGACCCG GGGCCCAAAG CCACCACCGT CCTTCCCAAG CCAGATCTTA
TTTATTTATT TATTTCAGTA CTGGGGGCGA AACAGCCAGG TGATCCCCCC GCCATTATCT CCCCCTAGTT
AGAGACAGTC CTTCCGTGAG GCCGGGGGGA CATCTGTGCC TTATTTATAC TTATTTATTT CAGGAGCAGG
GGTGGGAGGC AGGTGGACTC CTGGGTCCCC GAGGAGGAGG GGACTGGGGT CCCGGATTCT TGGGTCTCCA
AGAAGTCTGT CCACAGACTT CTGCCCTGGC TCTTCCCCAT CTAGGCCTGG GCAGGAACAT ATATTATTTA
TTTAAGCAAT TACTTTTCAT GTTGGGGTGG GGACGGAGGG GAAAGGGAAG CCTGGGTTTT TGTACAAAAA
TGTGAGAAAC CTTTGTGAGA CAGAGAACAG GGAATTAAAT GTGTCATACA TATCC CAGCTGCGGC
ATCCTCTGTC TCAGAGTCTT GGTGTCTCTG TTCCTTTCCC CTCGGGGTCT CCCTGGGTCT CCCCAAGTCC
CTCCTGCTGT CTTCCTCCCG CTCTCTGATC TCTGACTCCC AGAACCTCTC CCTCTGTCTC CAGGGCTGCC
CCTCTGATCC TCTTTGCTTC TCTGGTGTGT CTCTCTGGCT GCCTCCATCT CTGTGGATCT CCGTCTCCCT
GTCTCTGTCT CAGTCTGTCC TTCACTCTGT GTGTGTGTGT GTCTCTCTCT CTCTCTCTCC TTCCCTTCCA
CTCCCTCTTC CTCCTGCCTC CACCTCTCCA GGCCCCTGTC TTGTCCCTCC GTCCGGCCTT TCTCTGCCTT
TCCGTCCTCC TGCCTCCCCA TCTCTCTCTG CTAGTCCTGT CCAGCCGGAC CCCCACCCAC AGTCGGGCCC
CAGCGCTTGA GCCTGAGTGT CTGCTCCGGC CCGTGGAGGT GGAGGGAGGG GACGCCAATG ACCTCACCAG
CCCCTCTCCG ACCACCCCCC CCTTTCCCTT TTCAACTTTT CCAACTTTTC CTTCCGTGCC CTCCTCCGAG
CGCGGCGGCG TGAGCCCTGC AAGGCAGCCG CTCCGTCTGA ATGGAAAAGG CAGGCAGGGA GGGTGAGTCA
GGATGTGTCA GGCCGGCCCT CCCCTGCCGC CTGCCCCCCG CCCGCCCGCC CCAGGCCCCC TATATAACCC
CCCAGGCGTC CACACTCCCT CACTGCCGCG GGCCCTGCTG CTCAGGGCAC ATGCCTCCCC TCCCCAGCCG
CGGGCCCAGC TGACCCTCGG GGCTCCCCG GCAGCGGACA GGGAAGGGTT AAAGGCCCCC GGCTCCCTGC
CCCCTGCCCT GGGGAACCCC TGGCCCTGTG GGGACATGAA CTGTAAGTTG GTTCATGGGG AGGGTGGAGG
GGACAGGGAG GCAGGGAGGA GAGGGACCCA CGGCGGGGT GGGAGCAGAC CCCGCTGAGT CGCACAGAGA
GGGACCCGGA GACAGGCAGC CGGGGAGGAG AGCAGCTTCG GAGACAGGAG GCGGCGGAGG AGATGGGCAG
AGAGAGACAC AGACAGGAGC GGATGGAGGC AGCCAATCAG AGGCGCCGCA GGAGGGACGG GCCAGACAGG
GCCCGAGAGG AGCGAGACGC GAGACCGAGC AGGGGCAGGG ACGCAGGGAC TGGTGCCGGG AGGGAGGTGA
CCCCCATCGA CCCAGGCCCC AGGGAGCCCG CGGGGACCGG GAGACTCCCT GGGATTCCGG CAGAGAGGCT
CCGGAGGGAA ACTGAGGCAG GGTCCGCGGA GAGCGGAGCA AGCCAGGGAG TAGCGACCCC AGCCGGGGGG
AGGAGAGAGA CTGGGCGCCG GGGGAAAGCG GGGAGAGCCG GGCAGATGCG GCCGACGGAG GCGCGGACAG
ACCGACGGCT GGCGGCCCG GGGGCGGGC TGGGGGTGTG CGAGGCGCGG GCGGCCGGGG AGCGCTGATT
GGCTGGCGGG TGGCCGGGTG GGCGGGGCGG CCGGGGTGGG CTGCGGGGAG CGAGCTCCGG ACCCCCGCGC
CCCCGGCGCC CCCCGCGCCC CCCGCCGCCA GCTCTCCCGC TCCCGGCGCC CGGCCGGGCC ATGGCTCTGC
```

```
CCCTCTCCGC CCAGGTGCGC TGCGGCCCGG GCTTCTGCCG CCCACCCGGC GGGCTCCTGG GAGGGCGTCT
AAGGGGTCTC CCGTGGGAGA GGTCCGTGTC TCCCGGACTC CGTCCTGGGC TTTTGGCTCC TTCCCCTGCT
CCCAGCCAGC TCGGGCTCCC GCGGCCCGGG GAGGGGGCAG GTTCTGGCCT GTGCCTCCCC CACCATCCGC
GCCCCGGGGC CCAGATTCCG GCGTCCGGGG GCGGACGGGA GACGCCCGGG CCGCGTCTGC TCCGACGGGC
GGGGCAGCCA GAGCCAGGGA GGGAGAGGGA AGCCCGCCTG GCCCTGCGAC CTGCCCGCGG GCGTTCCACC
CTGGGACTTA AGACCTCCAG CTCCATCCTC CCTAAGGCCG GGAGTCCAGG CCCCAGACCC TCCTCCCCGA
GACCCAGGAG TCCAGACCCC AGGCCTTCCT CCCTCAGACC TAGGAGTCCA GGCCCCAGCC CTCTCCTCCC
TCAGACCCAG GAGGAGTCCA GACCCCAGTT CCTCCTCCCT CAGACCCGGG AGTCCAGCCC AGGCCCTCCT
CTCTCAGACC CGGAGTCCAG CCTGAGCTCT CTGCCTTATC CTGCCCCAG GTGTTTGCCC CCTGGTCCTG
GTCGTGCTGA GCCTGTGGCC AGATACAGCT GTCGCCCCTG GCCACCACC TGGCCCCCCT CGAGTTTCCC
CAGACCCTCG GGCCGAGCTG ACAGCACCG TGCTCCTGAC CCGCTCTCTC CTGGCGGACA CGCGGCAGCT
GGCTGCACAG CTGGTAGGAG AGACTGGGCT GGGGCCAGCA CAGGAGTGAG AGGCAGAGAG GAACGGAGAG
GAGTCTGCGG GCAGCCACTT GGAGGGGTTC TGGGCTCTCA GGTGGCAGAG TGAGGGAGGG GAAGAGTTGG
GGGCCTGGCG TGGGGGATGG AGGGAGCCCC GAGGCTGGGC AGGGGCCACC TCACAGCTTT TTTCCCTGCC
AGAGGGACAA ATTCCCAGCT GACGGGGACC ACAACCTGGA TTCCCTGCCC ACCCTGGCCA TGAGTGCAGG
GGCACTGGGA GCTCTACAGG TAAGGGCAAG GGAGTGGGCT GGGGACAAGG TGGGAGGCAG GCAGTGAAGG
GGGCGGGGAG GATGAGGGGC ACTGGTCGGG TGTTCTCTGA TGTCCCGGCT CTATCCCCAG CTCCCAGGTG
TGCTGACAAG GCTGCGAGCG GACCTACTGT CCTACCTGCG GCACGTGCAG TGGCTGCGCC GGGCAGGTGG
CTCTTCCCTG AAGACCCTGG AGCCCGAGCT GGGCACCCTG CAGGCCCGAC TGGACCGGCT GCTGCGCCGG
CTGCAGCTCC TGGTATGTCC TGGCCCCAAG ACCTGACACC CCAGACCCCC ACCCCTGGCC CCAAAATCCT
GTGGCCTGAG TCCTTGAAGC CTGAGACCCC AGACCCGAGT GCAACAGCCC CGCTCTGAGA CCCTGACACC
CTAACAGCCC GCTCTGAGAC CCTGACACCG TAACAGCCCC GCTCTGAGAC CCTGACCCTA ACAGTCCTGC
TCTGAGACCC TGACCCTGCA GTCCCAAGAT CCTGTGGCCC TGAGACCCTG AGGCCCTAGA CCCCCAAATC
CTGCCCAGAA ACTTCAAATT CTCACCCAAG ACCCTGAGAC TCCATCATCC ATGACCTCAA AGTCCCCAGA
TCCCAGCCCC TAAGACCCAA GACCCCATCC TGAAGCCCAA AGCCTTGAGA ATTCAAATCC TCACCTCAAG
ACTTGGAGAC CCTGGCCCCA TGACATTGAA AACCATGGAC CTGGCCAGGC GTGGTGGCTC ACGCCTGTAA
TCCCAGCACT TTGGGAGGCC GAGGCAAGTG GATCACCTGA GGTCGGGAGT TCAAGACCAG CCAGACCAAC
ATGGTGAAAC CCTGTCTCTA CTAAAAATAC AAAATTAGCC AGGCGTGGTG GTGCATGCCT GTAATCCCAG
CTACTTGGGA GGCTGAGGCA GGAGAATCGC TTGAACCTGG GAGGCGGAGG TTGCAGTGAG CCGAGATCGC
ACCATTACAC TCCAGCCTGG GCAACAAGAG CAAAACTCCC TCTCTCTCAA AAAAAAAAAA AAAAAAAAA
AAGAAGGAAA AGAAAACCAT GGACCTCCAG ACCCTGAGAC CCCAGGCCCC AGCCCTGAGA TCCTGACATC
TTAAAGATCC CAGGCCCTAA GATCAAGAC CTTGACCCAA AGCCAGCCTT GGGACCCTGG CTGTACAAAC
CCAAGACCTC CAGGACCTAG ACCCCGAGCC CTGAGGCCCT ATGTCTCACT CCCAACATCG AAAACCCTGA
CACCTCAGAT CCTGAGCCTG CGCCTGTACG ACTCCAAGAC CCTCACTTCC AAAGCCAGGC CCAAAGCCCT
GAGACCAGAA GACTTCAAAC CCTGGTTCTT GGGCCTAACT CCAAAGACCC TGGATCTCAA ATTCCAACTT
CTAGCTCTGA GACTCCAGCC CTCACCCATG AGTTCCTGAA CTTGAACCCA GAGACCCCAT CTCTAAGACT
TCAGCCTTGA GATCCAGGGC CTGACCCTAG ACTCGAGCCC ACAGACCTCA GATACTGTCT GTAAAACCCC
AGCTCTGGTG GGGAGCAGTG GCTCACTCCT GTAATCCCAA GGCAGGGGAG GCCAAGGCAG AAGGACCTCT
TGAGGCCATG AGTTTGAGAC AGCCTGGGCA GCATAGCAAG ACTCTGTTTC TTAATTATTA TTATTATTAT
```

-continued

```
TATTTTTTGG AGACAGAGTC TCGCGCTCTG TTGCCCAGGC TAGAGTGCAA TGGTGCCATT TCGGCTTGCT
GGAACCTCCG CCTCCTGGGC TCAAGCGATT CTCCTGCCTC AGCCTCCTGA GTAGCTGGGA CTTCAGGTGC
ACACTGCCAC ACCCGGATAA TTTTTTTGTA TTTTAGTAGA CACAGGGTTT CACCGTGTTG CCCAGGCTGG
TCACAAACTC CTGAGCTCAG GCCATCCGCC CGCCTCGGCC TCCCAAAGCG CTGGGATAAC AGGCGTGACG
CCGCGCCTGG CTTCTTAATT GTTCTAACAG CAGCGACAAC AACAAAAACC CAGCTCTGAG ATTCCAGCCC
CGGCGACTCT AACAGTCCCA GGCCCGATCC CTCACCTAGA ACCGAGATGC CAGCCCTGAC TCCACAGACT
TCACCCCCAA CCCCCACACT CAGCTCTGGA AGCCCGTCCT GACTCCAGCC TCCATTTTCG GAACCCCACA
GCCTGAAGAG CTCCCGGCCT AAACACTTCA CCCCACGCGC CACAGTCCCC CTGTGAATAT GCAGCCCCGA
TTCAGCTGCA GCTCCACAGC ACCCCTGCCC TGCACCCCCG CTGCACCCCC TACCTGTGAC TCACCTCTCT
CCTCTCCCCA CAGATGTCCC GCCTGGCCCT GCCCCAGCCA CCCCCGGACC CGCCGGCGCC CCCGCTGGCG
CCCCCCTCCT CAGCCTGGGG GGCATCAGG GCCGCCCACG CCATCCTGGG GGGCTGCAC CTGACACTTG
ACTGGGCCGT GAGGGACTG CTGCTGCTGA AGACTCGGCT GTGACCCGGG GCCCAAAGCC ACCACCGTCC
TTCCAAAGCC AGATCTTATT TATTTATTTA TTTCAGTACT GGGGGCGAAA CAGCCAGGTG ATCCCCCCGC
CATTATCTCC CCCTAGTTAG AGACAGTCCT TCCGTGAGGC CTGGGGGCA TCTGTGCCTT ATTTATACTT
ATTTATTTCA GGAGCAGGGG TGGGAGGCAG GTGGACTCCT GGGTCCCCGA GGAGGAGGGG ACTGGGGTCC
CGGATTCTTG GGTCTCCAAG AAGTCTGTCC ACAGACTTCT GCCCTGGCTC TTCCCCATCT AGGCCTGGGC
AGGAACATAT ATTATTTATT TAAGCAATTA CTTTTCATGT TGGGGTGGGG ACGGAGGGGA AAGGGAAGCC
TGGGTTTTTG TACAAAAATG TGAGAAACCT TTGTGAGACA GAGAACAGGG AATTAAATGT GTCATACATA
TCCACTTGAG GGCGATTTGT CTGAGAGCTG GGGCTGGATG CTTGGGTAAC TGGGGCAGGG CAGGTGGAGG
GGAGACCTCC ATTCAGGTGG AGGTCCCGAG TGGGCGGGC AGCGACTGGG AGATGGGTCG GTCACCCAGA
CAGCTCTGTG GAGGCAGGGT CTGAGCCTTG CCTGGGGCCC CGCACTGCAT AGGGCCGTTT GTTTGTTTTT
TGAGATGGAG TCTCGCTCTG TTGCCTAGGC TGGAGTGCAG TGAGGCAATC TAAGGTCACT GCAACCTCCA
CCTCCCGGGT TCAAGCAATT CTCCTGCCTC AGCCTCCCGA TTAGCTGGGA TCACAGGTGT GCACCACCAT
GCCCAGCTAA TTATTTATTT CTTTTGTATT TTTAGTAGAG ACGGGTTTC ACCATGTTGG CCAGGCTGGT
TTCGAACTCC TGACCTCAGG TGATCCTCCT GCCTCGGCCT CCCAAAGTGC TGGGATTACA GGTGTGAGCC
ACCACACCTG ACCCATAGGT CTTCAATAAA TATTTAATGG AAGGTTCCAC AAGTCACCCT GTGATCAACA
GTACCCGTAT GGGACAAAGC TGCAAGGTCA AGATGGTTCA TTATGGCTGT GTTCACCATA GCAAACTGGA
AACAATCTAG ATATCCAACA GTGAGGGTTA AGCAACATGG TGCATCTGTG ATAGAACGC CACCCAGCCG
CCCGGAGCAG GGACTGTCAT TCAGGGAGGC TAAGGAGAGA GGCTTGCTTG GGATATAGAA AGATATCCTG
ACATTGGCCA GGCATGGTGG CTCACGCCTG TAATCCTGGC ACTTTGGGAG GACGAAGCGA GTGGATCACT
GAAGTCCAAG AGTTTGAGAC CGGCCTGCGA GACATGGCAA AACCCTGTCT CAAAAAAGAA AGAATGATGT
CCTGACATGA AACAGCAGGC TACAAAACCA CTGCATGCTG TGATCCCAAT TTTGTGTTTT TCTTTCTATA
TATGGATTAA AACAAAAATC CTAAAGGGAA ATACGCCAAA ATGTTGACAA TGACTGTCTC CAGGTCAAAG
GAGAGAGGTG GGATTGTGGG TGACTTTTAA TGTGTATGAT TGTCTGTATT TTACAGAATT CTGCCATGA
CTGTGTATTT TGCATGACAC ATTTTAAAAA TAATAAACAC TATTTTTAGA ATAACAGAAT ATCAGCCTCC
TCCTCTCCAA AAATAAGCCC TCAGGAGGGG ACAAAGTTGA CCGCTGATTG AGCCTGTCAG GGCTGTGCAC-3'
```
(SEQ. ID NO: 3004)

Human Adenosine A$_1$ Receptor Nucleic Acid and Antisense Oligonucleotide Fragments

```
5'-ATGCCGCCCT CCATCTCAGC TTTCCAGGCC GCCTACATCG GCATCGAGGT GCTCATCGCC CTGGTCTCTG
```

```
TGCCCGGGAA CGTGCTGGTG ATCTGGGCGG TGAAGGTGAA CCAGGCGCTG CGGGATGCCA CCTTCTGCTT
CATCGTCTCG CTGGCGGTGG CTGATGTGGC CGTGGGTGCC CTGGTCATCC CCCTCGCCAT CCTCATCAAC
ATTGGGCCAC AGACCTACTT CCACACCTGC CTCATGGTTG CCTGTCCGGT CCTCATCCTC ACCCAGAGCT
CCATCCTGGC CCTGCTGGCA ATTGCTGTGG ACCGCTACCT CCGGGTCAAG ATCCCTCTCC GGTACAAGAT
GGTGGTGACC CCCCGGAGGG CGGCGGTGGC CATAGCCGGC TGCTGGATCC TCTCCTTCGT GGTGGGACTG
CCCCTATGT TTGGCTGGAA CAATCTGAGT GCGGTGGAGC GGGCCTGGGC AGCCAACGGC AGCATGGGGG
AGCCCGTGAT CAAGTGCGAG TTCGAGAAGG TCATCAGCAT GGAGTACATG GTCTACTTCA ACTTCTTTGT
GTGGGTGCTG CCCCCGCTTC TCCTCATGGT CCTCATCTAC CTGGAGGTCT TCTACCTAAT CCGCAAGCAG
CTCAACAAGA AGGTGTCGGC CTCCTCCGGC GACCCGCAGA AGTACTATGG GAAGGAGCTG AAGATCGCCA
AGTCGCTGGC CCTCATCCTC TTCCTCTTTG CCCTCAGCTG GCTGCCTTTG CACATCCTCA ACTGCATCAC
CCTCTTCTGC CCGTCCTGCC ACAAGCCCAG CATCCTTACC TACATTGCCA TCTTCCTCAC GCACGGCAAC
TCGGCCATGA ACCCCATTGT CTATGCCTTC CGCATCCAGA AGTTCCGCGT CACCTTCCTT AAGATTTGGA
ATGACCATTT CCGCTGCCAG CCTGCACCTC CCATTGACGA GGATCTCCCA GAAGAGAGGC CTGATGACTA G
ATGAGTGTCA GAAGTGTGAA GGGTGCCTGT TCTGAATCCC AGAGCCTCCT CTCCCTCTGT GAGGCTGGCA
GGTGAGGAAG GGTTTAACCT CACTGGAAGG AATCCCTGGA GCTAGCGGCT GCTGAAGGCG TCGAGGTGTG
GGGGCACTTG GACAGAACAG TCAGGCAGCC GGGAGCTCTG CCAGCTTTGG TGACCTTGGG CCGGGCTGGG
AGCGCTGCGG CGGGAGCCGG AGGACTATGA GCTGCCGCGC GTTGTCCAGA GCCCAGCCCA GCCCTACGCG
CGCGGCCCGG AGCTCTGTTC CCTGGAACTT TGGGCACTGC CTCTGGGACC CCTGCCGGCC AGCAGGCAGG
ATGGTGCTTG CCTCGTGCCC CTTGGTGCCC GTCTGCTGAT GTGCCCAGCC TGTGCCCGCC ATGCCGCCCT
CCATCTCAGC TTTCCAGGCC GCCTACACTG GCATCGAGGT GCTCATCGCC CTGGTCTCTG TGCCCGGGAA
CGTGCTGGTG ATCTGGGCGG TGAAGGTGAA CCAGGCGCTG CGGGATGCCA CCTTCTGCTT CATCGTGTCG
CTGGCGGTGG CTGATGTGGC CGTGGGTGCC CTGGTCATCC CCCTCGCCAT CCTCATCAAC ATTGGGCCAC
AGACCTACTT CCACACCTGC CTCATGGTTG CCTGTCCGGT CCTCATCCTC ACCCAGAGCT CCATCCTGGC
CCTGCTGGCA ATTGCTGTGG ACCGCTACCT CCGGGTCAAG ATCCCTCTCC GGTACAAGAT GGTGGTGACC
CCCCGGAGGG CGGCGGTGGC CATAGCCGGC TGCTGGATCC TCTCCTTCGT GGTGGGACTG ACCCCTATGT
TTGGCTGGAA CAATCTGAGT GCGGTGGAGC GGGCCTGGGC AGCCAACGGC AGCATGGGGG AGCCCGTGAT
CAAGTGCGAG TTCGAGAAGG TCATCAGCAT GGAGTACATG GTCTACTTCA ACTTCTTTGT GTGGGTGCTG
CCCCCGCTTC TCCTCATGGT CCTCATCTAC CTGGAGGTCT TCTACCTAAT CCGCAAGCAG CTCAACAAGA
AGGTGTCGGC CTCCTCCGGC GACCCGCAGA AGTACTATGG GAAGGAGCTG AAGATCGCCA AGTCGCTGGC
CCTCATCCTC TTCCTCTTTG CCCTCAGCTG GCTGCCTTTG CACATCCTCA ACTGCATCAC CCTCTTCTGC
CCGTCCTGCC ACAAGCCCAG CATCCTTACC TACATTGCCA TCTTCCTCAC GCACGGCAAC TCGGCCATGA
ACCCCATTGT CTATGCCTTC CGCATCCAGA AGTTCCGCGT CACCTTCCTT AAGATTTGGA ATGACCATTT
CCGCTGCCAG CCTGCACCTC CCATTGACGA GGATCTCCCA GAAGAGAGGC CTGATGACTA GACCCCGCCT
TCCGCTCCCA CCAGCCCACA TCCAGTGGGG TCTCAGTCCA GTCCTCACAT GCCCGCTGTC CAGGGGTCT
CCCTGAGCCT GCCCCAGCTG GGCTGTTGGC TGGGGGCATG GGGGAGGCTC TGAAGAGATA CCCACAGAGT
GTGGTCCCTC CACTAGGAGT TAACTACCCT ACACCTCTGG GCCCTGCAGG AGGCCTGGGA GGGCAAGGGT
CCTACGGAGG GACCAGGTGT CTAGAGGCAA CAGTGTTCTG AGCCCCCACC TGCCTGACCA TCCCATGAGC
AGTCCAGCGC TTCAGGGCTG GGCAGGTCCT GGGGAGGCTG AGACTGCAGA GGAGCCACCT GGGCTGGGAG
AAGGTGCTTG GGCTTCTGCG GTGAGGCAGG GGAGTCTGCT TGTCTTAGAT GTTGGTGGTG CAGCCCCAGG
ACCAAGCTTA AGGAGAGGAG AGCATCTGCT CTGAGACGGA TGGAAGGAGA GAGGTTGAGG ATGCACTGGC
```

```
CTGTTCTGTA GGAGAGACTG GCCAGAGGCA GCTAAGGGGC AGGAATCAAG GAGCCTCCGT TCCCACCTCT

GAGGACTCTG GACCCCAGGC CATACCAGGT GCTAGGGTGC CTGCTCTCCT TGCCCTGGGC CAGCCCAGGA

TTGTACGTGG GAGAGGCAGA AAGGGTAGGT TCAGTAATCA TTTCTGATGA TTTGCTGGAG TGCTGGCTCC

ACGCCCTGGG GAGTGAGCTT GGTGCGGTAG GTGCTGGCCT CAAACAGCCA CGAGGTGGTA GCTCTGAGCC

CTCCTTCTTG CCCTGAGCTT TCCGGGGAGG AGCCTGGAGT GTAATTACCT GTCATCTGGG CCACCAGCTC

CACTGGCCCC CGTTGCCGGG CCTGGACTGT CCTAGGTGAC CCCATCTCTG CTGCTTCTGG GCCTGATGGA

GAGGAGAACA CTAGACATGC CAACTCGGGA GCATTCTGCC TGCCTGGGAA CGGGGTGGAC GAGGGAGTGT

CTGTAAGGAC TCAGTGTTGA CTGTAGGCGC CCCTGGGGTG GGTTTAGCAG GCTGCAGCAG GCAGAGGAGG

AGTACCCCCC TGAGAGCATG TGGGGGAAGG CCTTGCTGTC ATGTGAATCC CTAATACCC CTAGTATCTG

GCTGGGTTTT CAGGGGTTTT GGAAGCTCTG TTGCAGGTGT CCGGGGGTCT AGGACTTTAG GGATCTGGGA

TCTGGGAAG GACCAACCCA TGCCCTGCCA AGCCTGGAGC CCCTGTGTTG GGGGCAAGG TGGGGGAGCC

TGGAGCCCCT GTGTGGGAGG GCGAGGCGGG GGAGCCTGGA GCCCCTGTGT GGGAGGGCGA GGCGGGGGAT

CCTGGAGCCC CTGTGTCGGG GGGCGAGGGA GGGGAGGTGG CCGTCGGTTG ACCTTCTGAA CATGAGTGTC

AACTCCAGGA CTTGCTTCCA AGCCCTTCCC TCTGTTGGAA ATTGGGTGTG CCCTGGCTCC CAAGGGAGGC

CCATGTGACT AATAAAAAAC TGTGAACCCT CGCATTTGTG TTTTAATAAA AGAATCTGGA AGATAAATAG

TCTTGAAGAG AGACAAAGGA AGGAAAATTT AAATCCTTAG ATTCAAGCAG AAGAATTCCA TGTGGAAGGT

TTGGGTTGTT GTTGTTGTTG TTTGGTGTGT TTTTTGTTTT TTTGTTTTTT TGTTTTTTTT TGAGATGGAG

TCTCGCTGTG TTACCGGGAG CGACAGAGCC GCACGGCCGA GTCGAGTCCC AGCCAGCTAC CATCCCTCTG

GAGCTTACCG GCCGGCCTTG GAATCCCCAG GAATCCCTGG AGCTAGCGGC TGCTGAAGGC GTCGAGGTGT

GGGGGCACTT GGACAGAACA GTCAGGCAGC CGGGAGCTCT GCCAGCTTTG GTGACCTTGG GTGCTTGCCT

CGTGCCCCTT GGTGCCCGTC TGCTGATGTG CCCAGCCTGT GCCCGCCATG CCGCCCTCCA TCTCAGCTTT

CCAGGCCGCC TACATCGGCA TCGAGGTGCT CATCGCCCTG GTCTCTGTGC CCGGGAACGT GCTGGTGATC

TGGGCGGTGA AGGTGAACCA GGCGCTGCGG GATGCCACCT TCTGCTTCAT CGTGTCGCTG GCGGTGGCTG

ATGTGGCCGT GGGTGCCCTG GTCATCCCCC TCGCCATCCT CATCAACATT GGGCCACAGA CCTACTTCCA

CACCTGCCTC ATGGTTGCCT GTCCGGTCCT CATCCTCACC CAGAGCTCCA TCCTGGCCCT GCTGGCAATT

GCTGTGGACC GCTACCTCCG GGTCAAGATC CCTCTCCGGT ACAAGATGGT GGTGACCCCC CGGAGGGCGG

CGGTGGCCAT AGCCGGCTGC TGGATCCTCT CCTTCGTGGT GGGACTGACC CCTATGTTTG GCTGGAACAA

TCTGAGTGCG GTGGAGCGGG CCTGGGCAGC CAACGGCAGC ATGGGGGAGC CCGTGATCAA GTGCGAGTTC

GAGAAGGTCA TCAGCATGGA GTACATGGTC TACTTCAACT TCTTTGTGTG GGTGCTGCCC CCGCTTCTCC

TCATGGTCCT CATCTACCTG GAGGTCTTCT ACCTAATCCG CAAGCAGCTC AACAAGAAGG TGTCGGCCTC

CTCCGGCGAC CCGCAGAAGT ACTATGGGAA GGAGCTGAAG ATCGCCAAGT CGCTGGCCCT CATCCTCTTC

CTCTTTGCCC TCAGCTGGCT GCCTTTGCAC ATCCTCAACT GCATCACCCT CTTCTGCCCG TCCTGCCACA

AGCCCAGCAT CCTTACCTAC ATTGCCATCT TCCTCACGCA CGGCAACTCG GCCATGAACC CCATTGTCTA

TGCCTTCCGC ATCCAGAAGT TCCGCGTCAC CTTCCTTAAG ATTTGGAATG ACCATTTCCG CTGCCAGCCT

GCACCTCCCA TTGACGAGGA TCTCCCAGAA GAGAGGCCTG ATGACTAGAC CCCGCCTTCC GCTCCCACCG

CCCACATCCA GTGGGTCTC AGTCCAGTCC TCACATGCCC GCTGTCCCAG GGTCTCCCT GAGCCTGCCC

CAGCTGGGCT GTTGGCTGGG GGCATGGGGG AGGCTCTGAA GAGATACCCA CAGAGTGTGG TCCCTCCACT

AGGAGTTAAC TACCCTACAC CTCTGGGCCC TGCAGGAGGC CTGGGAGGGC AAGGGTCCTA CGGAGGGACC

AGGTGTCTAG AGGCAACAGT GTTCTGAGCC CCCACCTGCC TGACCATCCC ATGAGCAGTC CAGAGCTTCA
```

```
GGGCTGGGCA GGTCCTGGGG AGGCTGAGAC TGCAGAGGAG CCACCTGGGC TGGGAGAAGG TGCTTGGGCT
TCGGCGGTGA GGCAGGGGAG TCTGCTTGTC TTAGATGTTG GTGGTGCAGC CCCAGGACCA AGCTTAAGGA
GAGGAGAGCA TCTGCTCTGA GACGGATGGA AGGAGAGAGG TTGAGGATGC ACTGGCCTGT TCTGTAGGAG
AGACTGGCCA GA GAT GGA GGG CGG CAT GGC GGG G CGG GTC GCC GG GGC GGG CBC BGG C GGC GGG
CBC GC GGC CTG G GGB GGG CGG C GBT GGB GGG GG CTG GGC GC GGC CTG GAA AGC TGA GAT GGA GGG
CGG CAT GGC GGG CAC AGG CTG GGC ATGCCGCCCT CCATCTCAGC TTTCCAGGCC GCCTACATCG
GCATCGAGGT GCTCATCGCC CTGGTCTCTG TGCCCGGGAA CGTGCTGGTG ATCTGGGCGG TGAAGGTGAA
CCAGGCGCTG CGGGATGCCA CCTTCTGTT CATCGTCTCG CTGGCGGTGG CTGATGTGGC CGTGGGTGCC
CTGGTCATCC CCCTCGCCAT CCTCATCAAC ATTGGGCCAC AGACCTACTT CCACACCTGC CTCATGGTTG
CCTGTCCGGT CCTCATCCTC ACCCAGAGCT CCATCCTGGC CCTGCTGGCA ATTGCTGTGG ACCGCTACCT
CCGGGTCAAG ATCCCTCTCC GGTACAAGAT GGTGGTGACC CCCCGGAGGG CGGCGGTGGC CATAGCCGGC
TGCTGGATCC TCTCCTTCGT GGTGGGACTG ACCCCTATGT TTGGCTGGAA CAATCTGAGT GCGGTGGAGC
GGGCCTGGGC AGCCAACGGC AGCATGGGGG AGCCCGTGAT CAAGTGCGAG TTCGAGAAGG TCATCAGCAT
GGAGTACATG GTCTACTTCA ACTTCTTTGT GTGGGTGCTG CCCCCGCTTC TCCTCATGGT CCTCATCTAC
CTGGAGGTCT TCTACCTAAT CCGCAAGCAG CTCAACAAGA AGGTGTCGGC CTCCTCCGGC GACCCGCAGA
AGTACTATGG GAAGGAGCTG AAGATCGCCA AGTCGCTGGC CCTCATCCTC TTCCTCTTTG CCCTCAGCTG
GCTGCCTTTG CACATCCTCA ACTGCATCAC CCTCTTCTGC CCGTCCTGCC ACAAGCCCAG CATCCTTACC
TACATTGCCA TCTTCCTCAC GCACGGCAAC TCGGCCATGA ACCCCATTGT CTATGCCTTC CGCATCCAGA
AGTTCCGCGT CACCTTCCTT AAGATTTGGA ATGACCATTT CCGCTGCCAG CCTGCACCTC CCATTGACGA
GGATCTCCCA GAAGAGAGGC CTGATGACTA G ATGAGTGTCA GAAGTGTGAA GGGTGCCTGT TCTGAATCCC
AGAGCCTCCT CTCCCTCTGT GAGGCTGGCA GGTGAGGAAG GGTTTAACCT CACTGGAAGG AATCCCTGGA
GCTAGCGGCT GCTGAAGGCG TCGAGGTGTG GGGGCACTTG GACAGAACAG TCAGGCAGCC GGGAGCTCTG
CCAGCTTTGG TGACCTTGGG CCGGGCTGGG AGCGCTGCGG CGGGAGCCGG AGGACTATGA GCTGCCGCGC
GTTGTCCAGA GCCCAGCCCA GCCCTACGCG CGCGGCCCGG AGCTCTGTTC CCTGGAACTT TGGGCACTGC
CTCTGGGACC CCTGCCGGCC AGCAGGCAGG ATGGTGCTTG CCTCGTGCCC CTTGGTGCCC GTCTGCTGAT
GTGCCCAGCC TGTGCCCGCC ATGCCGCCCT CCATCTCAGC TTTCCAGGCC GCCTACATCG GCATCGAGGT
GCTCATCGCC CTGGTCTCTG TGCCCGGGAA CGTGCTGGTG ATCTGGGCGG TGAAGGTGAA CCAGGCGCTG
CGGGATGCCA CCTTCTGCTT CATCGTGTCG CTGGCGGTGG CTGATGTGGC CGTGGGTGCC CTGGTCATCC
CCCTCGCCAT CCTCATCAAC ATTGGGCCAC AGACCTACTT CCACACCTGC CTCATGGTTG CCTGTCCGGT
CCTCATCCTC ACCCAGAGCT CCATCCTGGC CCTGCTGGCA ATTGCTGTGG ACCGCTACCT CCGGGTCAAG
ATCCCTCTCC GGTACAAGAT GGTGGTGACC CCCCGGAGGG CGGCGGTGGC CATAGCCGGC TGCTGGATCC
TCTCCTTCGT GGTGGGACTG ACCCCTATGT TTGGCTGGAA CAATCTGAGT GCGGTGGAGC GGGCCTGGGC
AGCCAACGGC AGCATGGGGG AGCCCGTGAT CAAGTGCGAG TTCGAGAAGG TCATCAGCAT GGAGTACATG
GTCTACTTCA ACTTCTTTGT GTGGGTGCTG CCCCCGCTTC TCCTCATGGT CCTCATCTAC CTGGAGGTCT
TCTACCTAAT CCGCAAGCAG CTCAACAAGA AGGTGTCGGC CTCCTCCGGC GACCCGCAGA AGTACTATGG
GAAGGAGCTG AAGATCGCCA AGTCGCTGGC CCTCATCCTC TTCCTCTTTG CCCTCAGCTG GCTGCCTTTG
CACATCCTCA ACTGCATCAC CCTCTTCTGC CCGTCCTGCC ACAAGCCCAG CATCCTTACC TACATTGCCA
TCTTCCTCAC GCACGGCAAC TCGGCCATGA ACCCCATTGT CTATGCCTTC CGCATCCAGA AGTTCCGCGT
CACCTTCCTT AAGATTTGGA ATGACCATTT CCGCTGCCAG CCTGCACCTC CCATTGACGA GGATCTCCCA
GAAGAGAGGC CTGATGACTA GACCCCGCCT TCCGCTCCCA CCAGCCCACA TCCAGTGGGG TCTCAGTCCA
```

```
GTCCTCACAT GCCCGCTGTC CCAGGGGTCT CCCTGAGCCT GCCCCAGCTG GGCTGTTGGC TGGGGGCATG

GGGGAGGCTC TGAAGAGATA CCCACAGAGT GTGGTCCCTC CACTAGGAGT TAACTACCCT ACACCTCTGG

GCCCTGCAGG AGGCCTGGGA GGGCAAGGGT CCTACGGAGG GACCAGGTGT CTAGAGGCAA CAGTGTTCTG

AGCCCCCACC TGCCTGACCA TCCCATGAGC AGTCCAGCGC TTCAGGGCTG GGCAGGTCCT GGGGAGGCTG

AGACTGCAGA GGAGCCACCT GGGCTGGGAG AAGGTGCTTG GGCTTCTGCG GTGAGGCAGG GGAGTCTGCT

TGTCTTAGAT GTTGGTGGTG CAGCCCCAGG ACCAAGCTTA AGGAGAGGAG AGCATCTGCT CTGAGACGGA

TGGAAGGAGA GAGGTTGAGG ATGCACTGGC CTGTTCTGTA GGAGAGACTG GCCAGAGGCA GCTAAGGGGC

AGGAATCAAG GAGCCTCCGT TCCCACCTCT GAGGACTCTG GACCCCAGGC CATACCAGGT GCTAGGGTGC

CTGCTCTCCT TGCCCTGGGC CAGCCCAGGA TTGTACGTGG GAGAGGCAGA AAGGGTAGGT TCAGTAATCA

TTTCTGATGA TTTGCTGGAG TGCTGGCTCC ACGCCCTGGG GAGTGAGCTT GGTGCGGTAG GTGCTGGCCT

CAAACAGCCA CGAGGTGGTA GCTCTGAGCC CTCCTTCTTG CCCTGAGCTT TCCGGGGAGG AGCCTGGAGT

GTAATTACCT GTCATCTGGG CCACCAGCTC CACTGGCCCC CGTTGCCGGG CCTGGACTGT CCTAGGTGAC

CCCATCTCTG CTGCTTCTGG GCCTGATGGA GAGGAGAACA CTAGACATGC CAACTCGGGA GCATTCTGCC

TGCCTGGGAA CGGGGTGGAC GAGGGAGTGT CTGTAAGGAC TCAGTGTTGA CTGTAGGCGC CCCTGGGGTG

GGTTTAGCAG GCTGCAGCAG GCAGAGGAGG AGTACCCCCC TGAGAGCATG TGGGGGAAGG CCTTGCTGTC

ATGTGAATCC CTCAATACCC CTAGTATCTG GCTGGGTTTT CAGGGGCTTT GGAAGCTCTG TTGCAGGTGT

CCGGGGGTCT AGGACTTTAG GGATCTGGGA TCTGGGGAAG GACCAACCCA TGCCCTGCCA AGCCTGGAGC

CCCTGTGTTG GGGGGCAAGG TGGGGGAGCC TGGAGCCCCT GTGTGGGAGG GCGAGGCGGG GGAGCCTGGA

GCCCCTGTGT GGGAGGGCGA GGCGGGGGAT CCTGGAGCCC CTGTGTCGGG GGGCGAGGGA GGGGAGGTGG

CCGTCGGTTG ACCTTCTGAA CATGAGTGTC AACTCCAGGA CTTGCTTCCA AGCCCTTCCC TCTGTTGGAA

ATTGGGTGTG CCCTGGCTCC CAAGGGAGGC CCATGTGACT AATAAAAAAC TGTGAACCCT CGCATTTGTG

TTTTAATAAA AGAATCTGGA AGATAAATAG TCTTGAAGAG AGACAAAGGA AGGAAAATTT AAATCCTTAG

ATTCAAGCAG AAGAATTCCA TGTGGAAGGT TTGGGTTGTT GTTGTTGTTG TTTGGTGTGT TTTTTGTTTT

TTTGTTTTTT TGTTTTTTTT TGAGATGGAG TCTCGCTGTG TTACCGGGAG CGACAGAGCC GCACGGCCGA

GTCGAGTCCC AGCCAGCTAC CATCCCTCTG GAGCTTACCG GCCGGCCTTG GCTTCCCCAG GAATCCCTGG

AGCTAGCGGC TGCTGAAGGC GTCGAGGTGT GGGGGCACTT GGACAGAACA GTCAGGCAGC CGGGAGCTCT

GCCAGCTTTG GTGACCTTGG GTGCTTGCCT CGTGCCCCTT GGTGCCCGTC TGCTGATGTG CCCAGCCTGT

GCCCGCCATG CCGCCCTCCA TCTCAGCTTT CCAGGCCGCC TACATCGGCA TCGAGGTGCT CATCGCCCTG

GTCTCTGTGC CCGGGAACGT GCTGGTGATC TGGGCGGTGA AGGTGAACCA GGCGCTGCGG GATGCCACCT

TCTGCTTCAT CGTGTCGCTG GCGGTGGCTG ATGTGGCCGT GGGTGCCCTG GTCATCCCCC TCGCCATCCT

CATCAACATT GGGCCACAGA CCTACTTCCA CACCTGCCTC ATGGGTGCCT GTCCGGTCCT CATCCTCACC

CAGAGCTCCA TCCTGGCCCT GCTGGCAATT GCTGTGGACC GCTACCTCCG GGTCAAGATC CCTCTCCGGT

ACAAGATGGT GGTGACCCCC CGGAGGGCGG CGGTGGCCAT AGCCGGCTGC TGGATCCTCT CCTTCGTGGT

GGGACTGACC CCTATGTTTG GCTGGAACAA TCTGAGTGCG GTGGAGCGGG CCTGGGCAGC CAACGGCAGC

ATGGGGGAGC CCGTGATCAA GTGCGAGTTC GAGAAGGTCA TCAGCATGGA GTACATGGTC TACTTCAACT

TCTTTGTGTG GGTGCTGCCC CCGCTTCTCC TCATGGTCCT CATCTACCTG GAGGTCTTCT ACCTAATCCG

CAAGCAGCTC AACAAGAAGG TGTCGGCCTC CTCCGGCGAC CCGCAGAAGT ACTATGGGAA GGAGCTGAAG

ATCGCCAAGT CGCTGGCCCT CATCCTCTTC CTCTTTGCCC TCAGCTGGCT GCCTTTGCAC ATCCTCAACT

GCATCACCCT CTTCTGCCCG TCCTGCCACA AGCCCAGCAT CCTTACCTAC ATTGCCATCT TCCTCACGCA
```

-continued

```
CGGCAACTCG GCCATGAACC CCATTGTCTA TGCCTTCCGC ATCCAGAAGT TCCGCGTCAC CTTCCTTAAG
ATTTGGAATG ACCATTTCCG CTGCCAGCCT GCACCTCCCA TTGACGAGGA TCTCCCAGAA GAGAGGCCTG
ATGACTAGAC CCCGCCTTCC GCTCCCACCG CCCACATCCA GTGGGGTCTC AGTCCAGTCC TCACATGCCC
GCTGTCCCAG GGGTCTCCCT GAGCCTGCCC CAGCTGGGCT GTTGGCTGGG GGCATGGGGG AGGCTCTGAA
GAGATACCCA CAGAGTGTGG TCCCTCCACT AGGAGTTAAC TACCCTACAC CTCTGGGCCC TGCAGGAGGC
CTGGGAGGGC AAGGGTCCTA CGGAGGGACC AGGTGTCTAG AGGCAACAGT GTTCTGAGCC CCCACCTGCC
TGACCATCCC ATGAGCAGTC CAGAGCTTCA GGGCTGGGCA GGTCCTGGGG AGGCTGAGAC TGCAGAGGAG
CCACCTGGGC TGGGAGAAGG TGCTTGGGCT TCTGCGGTGA GGCAGGGGAG TCTGCTTGTC TTAGATGTTG
GTGGTGCAGC CCCAGGACCA AGCTTAAGGA GAGGAGAGCA TCTGCTCTGA GACGGATGGA AGGAGAGAGG
TTGAGGATGC ACTGGCCTGT TCTGTAGGAG AGACTGGCCA GA-3'(FRAG. NO:___) (SEQ. NO: 3005) [2423)]
5'-CGCATTTGTG TTTTAATAAA AGAATCTGGA AGATAAATAG TCTTGAAGAG AGACAAAGGA AGGAAAATTT
AAATCCTTAG ATTCAAGCAG AAGAATTCCA TGTGGAAGGT TTGGGTTGTT GTTGTTGTTG TTTGGTGTGT
TTTTTGTTTT TTTGTTTTTT TGTTTTTTTT TGAGATGGAG TCTCGCTGTG TTACCGGGAG CGACAGAGCC
GCACGGCCGA GTCGAGTCCC AGCCAGCTAC CATCCCTCTG GAGCTTACCG GCCGGCCTTG GCTTCCCCAG
GAATCCCTGG AGCTAGCGGC TGCTGAAGGC GTCGAGGTGT GGGGGCACTT GGACAGAACA GTCAGGCAGC
CGGGAGCTCT GCCAGCTTTG GTGACCTTGG GTGCTTGCCT CGTGCCCCTT GGTGCCCGTC TGCTGATGTG
CCCAGCCTGT GCCCGCCATG CCGCCCTCCA TCTCAGCTTT CCAGGCCGCC TACATCGGCA TCGAGGTGCT
CATCGCCCTG GTCTCTGTGC CCGGGAACGT GCTGGTGATC TGGGCGGGGA AGGTGAACCA GGCGCTGCGG
GATGCCACCT TCTGCTTCAT CGTGTCGCTG GCGGTGGCTG ATGTGGCCGT GGGTGCCCTG GTCATCCCCC
TCGCCATCCT CATCAACATT GGGCCACAGA CCTACTTCCA CACCTGCCTC ATGGTTGCCT GTCCGGTCCT
CATCCTCACC CAGAGCTCCA TCCTGGCCCT GCTGGCAATT GCTGTGGACC GCTACCTCCG GGTCAAGATC
CCTCTCCGGT ACAAGATGGT GGTGACCCCC CGGAGGGCGG CGGTGGCCAT AGCCGGCTGC TGGATCCTCT
CCTTCGTGGT GGGACTGACC CCTATGTTTG GCTGGAACAA TCTGAGTGCG GTGGAGCGGG CCTGGGCAGC
CAACGGCAGC ATGGGGGAGC CCGTGATCAA GTGCGAGTTC GAGAAGGTCA TCAGCATGGA GTACATGGTC
TACTTCAACT TCTTTGTGTG GGTGCTGCCC CCGCTTCTCC TCATGGTCCT CATCTACCTG GAGGTCTTCT
ACCTAATCCG CAAGCAGCTC AACAAGAAGG TGTCGGCCTC CTCCGGCGAC CCGCAGAAGT ACTATGGGAA
GGAGCTGAAG ATCGCCAAGT CGCTGGCCCT CATCCTCTTC CTCTTTGCCC TCAGCTGGCT GCCTTTGCAC
ATCCTCAACT GCATCACCCT CTTCTGCCCG TCCTGCCACA AGCCCAGCAT CCTTACCTAC ATTGCCATCT
TCCTCACGCA CGGCAACTCG GCCATGAACC CCATTGTCTA TGCCTTCCGC ATCCAGAAGT TCCGCGTCAC
CTTCCTTAAG ATTTGGAATG ACCATTTCCG CTGCCAGCCT GCACCTCCCA TTGACGAGGA TCTCCCAGAA
GAGAGGCCTG ATGACTAGAC CCCGCCTTCC GCTCCCACCG CCCACATCCA GTGGGGTCTC AGTCCAGTCC
TCACATGCCC GCTGTCCCAG GGGTCTCCCT GAGCCTGCCC CAGCTGGGCT GTTGGCTGGG GGCATGGGGG
AGGCTCTGAA GAGATACCCA CAGAGTGTGG TCCCTCCACT AGGAGTTAAC TACCCTACAC CTCTGGGCCC
TGCAGGAGGC CTGGGAGGGC AAGGGTCCTA CGGAGGGACC AGGTGTCTAG AGGCAACAGT GTTCTGAGCC
CCCACCTGCC TGACCATCCC ATGAGCAGTC CAGAGCTTCA GGGCTGGGCA GGTCCTGGGG AGGCTGAGAC
TGCAGAGGAG CCACCTGGGC TGGGAGAAGG TGCTTGGGCT TCTGCGGTGA GGCAGGGGAG TCTGCTTGTC
TTAGATGTTG GTGGTGCAGC CCCAGGACCA AGCTTAAGGA GAGGAGAGCA TCTGCTCTGA GACGGATGGA
AGGAGAGAGG TTGAGGATGC ACTGGCCTGT TCTGTAGGAG AGACTGGCCA GA-3' (FRAG. NO:___) (SEQ. ID NO:
2434)
5'-ATGAGTGTCA GAAGTGTGAA GGGTGCCTGT TCTGAATCCC AGAGCCTCCT CTCCCTCTGT GAGGCTGGCA
```

-continued

```
GGTGAGGAAG GGTTTAACCT CACTGGAAGG AATCCCTGGA GCTAGCGGCT GCTGAAGGCG TCGAGGTGTG

GGGGCACTTG GACAGAACAG TCAGGCAGCC GGGAGCTCTG CCAGCTTTGG TGACCTTGGG CCGGGCTGGG

AGCGCTGCGG CGGGAGCCGG AGGACTATGA GCTGCCGCGC GTTGTCCAGA GCCCAGCCCA GCCCTACGCG

CGCGGCCCGG AGCTCTGTTC CCTGGAACTT TGGGCACTGC CTCTGGGACC CCTGCCGGCC AGCAGGCAGG

ATGGTGCTTG CCTCGTGCCC CTTGGTGCCC GTCTGCTGAT GTGCCCAGCC TGTGCCCGCC ATGCCGCCCT

CCATCTCAGC TTTCCAGGCC GCCTACATCG GCATCGAGGT GCTCATCGCC CTGGTCTCTG TGCCCGGGAA

CGTGCTGGTG ATCTGGGCGG TGAAGGTGAA CCAGGCGCTG CGGGATGCCA CCTTCTGCTT CATCGTGTCG

CTGGCGGTGG CTGATGTGGC CGTGGGTGCC CTGGTCATCC CCCTCGCCAT CCTCATCAAC ATTGGGCCAC

AGACCTACTT CCACACCTGC CTCATGGTTG CCTGTCCGGT CCTCATCCTC ACCCAGAGCT CCATCCTGGC

CCTGCTGGCA ATTGCTGTGG ACCGCTACCT CCGGGTCAAG ATCCCTCTCC GGTACAAGAT GGTGGTGACC

CCCCGGAGGG CGGCGGTGGC CATAGCCGGC TGCTGGATCC TCTCCTTCGT GGTGGGACTG ACCCCTATGT

TTGGCTGGAA CAATCTGAGT GCGGTGGAGC GGGCCTGGGC AGCCAACGGC AGCATGGGGG AGCCCGTGAT

CAAGTGCGAG TTCGAGAAGG TCATCAGCAT GGAGTACATG GTCTACTTCA ACTTCTTTGT GTGGGTGCTG

CCCCCGCTTC TCCTCATGGT CCTCATCTAC CTGGAGGTCT TCTACCTAAT CCGCAAGCAG CTCAACAAGA

AGGTGTCGGC CTCCTCCGGC GACCCGCAGA AGTACTATGG GAAGGAGCTG AAGATCGCCA AGTCGCTGGC

CCTCATCCTC TTCCTCTTTG CCCTCAGCTG GCTGCCTTTG CACATCCTCA ACTGCATCAC CCTCTTCTGC

CCGTCCTGCC ACAAGCCCAG CATCCTTACC TACATTGCCA TCTTCCTCAC GCACGGCAAC TCGGCCATGA

ACCCCATTGT CTATGCCTTC CGCATCCAGA AGTTCCGCGT CACCTTCCTT AAGATTTGGA ATGACCATTT

CCGCTGCCAG CCTGCACCTC CCATTGACGA GGATCTCCCA GAAGAGAGGC CTGATGACTA GACCCCGCCT

TCCGCTCCCA CCAGCCCACA TCCAGTGGGG TCTCAGTCCA GTCCTCACAT GCCCGCTGTC CCAGGGGTCT

CCCTGAGCCT GCCCCAGCTG GGCTGTTGGC TGGGGGCATG GGGGAGGCTC TGAAGAGATA CCCACAGAGT

GTGGTCCCTC CACTAGGAGT TAACTACCCT ACACCTCTGG GCCCTGCAGG AGGCCTGGGA GGGCAAGGGT

CCTACGGAGG GACCAGGTGT CTAGAGACAA CAGTGTTCTG AGCCCCCACC TGCCTGACCA TCCCATGAGC

AGTCCAGCGC TTCAGGGCTG GGCAGGTCCT GGGGAGGCTG AGACTGCAGA GGAGCCACCT GGGCTGGGAG

AAGGTGCTTG GCTTCTGCG GTGAGGCAGG GGAGTCTGCT TGTCTTAGAT GTTGGTGGTG CAGCCCCAGG

ACCAAGCTTA AGGAGAGGAG AGCATCTGCT CTGAGACGGA TGGAAGGAGA GAGGTTGAGG ATGCACTGGC

CTGTTCTGTA GGAGAGACTG GCCAGAGGCA GCTAAGGGGC AGGAATCAAG GAGCCTCCGT TCCCACCTCT

GAGGACTCTG GACCCCAGGC CATACCAGGT GCTAGGGTGC CTGCTCTCCT TGCCCTGGGC CAGCCCAGGA

TTGTACGTGG GAGAGGCAGA AAGGGTAGGT TCAGTAATCA TTTCTGATGA TTTGCTGGAG TGCTGGCTCC

ACGCCCTGGG GAGTGAGCTT GGTGCGGTAG GTGCTGGCCT CAAACAGCCA CGAGGTGGTA GCTCTGAGCC

CTCCTTCTTG CCCTGAGCTT TCCGGGGAGG AGCCTGGAGT GTAATTACCT GTCATCTGGG CCACCAGCTC

CACTGGCCCC CGTTGCCGGG CCTGGACTGT CCTAGGTGAC CCCATCTCTG CTGCTTCTGG GCCTGATGGA

GAGGAGAACA CTAGACATGC CAACTCGGGA GCATTCTGCC TGCCTGGGAA CGGGGTGGAC GAGGGAGTGT

CTGTAAGGAC TCAGTGTTGA CTGTAGGCGC CCCTGGGGTG GGTTTAGCAG GCTGCAGCAG GCAGAGGAGG

AGTACCCCCC TGAGAGCATG TGGGGGAAGG CCTTGCTGTC ATGTGAATCC CTCAATACCC CTAGTATCTG

GCTGGGTTTT CAGGGCTTT GGAAGCTCTG TTGCAGGTGT CCGGGGGTCT AGGACTTTAG GGATCTGGGA

TCTGGGGAAG GACCAACCCA TGCCCTGCCA AGCCTGGAGC CCCTGTGTTG GGGGCAAGG TGGGGGAGCC

TGGAGCCCCT GTGTGGGAGG GCGAGGCGGG GGAGCCTGGA GCCCCTGTGT GGGAGGGCGA GGCGGGGGAT

CCTGGAGCCC CTGTGTCGGG GGGCGAGGGA GGGGAGGTGG CCGTCGGTTG ACCTTCTGAA CATGAGTGTC
```

-continued

AACTCCAGGA CTTGCTTCCA AGCCCTTCCC TCTGTTGGAA ATTGGGTGTG CCCTGGCTCC CAAGGGAGGC

CCATGTGACT AATAAAAAAC TGTGAACCCT-3' (FRAG. NO:___) (SEQ. ID NO: 2433)

5'-ATGCCGCCCT CCATCTCAGC TTTCCAGGCC GCCTACATCG GCATCGAGGT GCTCATCGCC CTGGTCTCTG

TGCCCGGGAA CGTGCTGGTG ATCTGGGCGG TGAAGGTGAA CCAGGCGCTG CGGGATGCCA CCTTCTGCTT

CATCGTCTCG CTGGCGGTGG CTGATGTGGC CGTGGGTGCC CTGGTCATCC CCCTCGCCAT CCTCATCAAC

ATTGGGCCAC AGACCTACTT CCACACCTGC CTCATGGTTG CCTGTCCGGT CCTCATCCTC ACCCAGAGCT

CCATCCTGGC CCTGCTGGCA ATTGCTGTGG ACCGCTACCT CCGGGTCAAG ATCCCTCTCC GGTACAAGAT

GGTGGTGACC CCCCGGAGGG CGGCGGTGGC CATAGCCGGC TGCTGGATCC TCTCCTTCGT GGTGGGACTG

ACCCCTATGT TTGGCTGGAA CAATCTGAGT GCGGTGGAGC GGGCCTGGGC AGCCAACGGC AGCATGGGGG

AGCCCGTGAT CAAGTGCGAG TTCGAGAAGG TCATCAGCAT GGAGTACATG GTCTACTTCA ACTTCTTTGT

GTGGGTGCTG CCCCCGCTTC TCCTCATGGT CCTCATCTAC CTGGAGGTCT TCTACCTAAT CCGCAAGCAG

CTCAACAAGA AGGTGTCGGC CTCCTCCGGC GACCCGCAGA AGTACTATGG GAAGGAGCTG AAGATCGCCA

AGTCGCTGGC CCTCATCCTC TTCCTCTTTG CCCTCAGCTG GCTGCCTTTG CACATCCTCA ACTGCATCAC

CCTCTTCTGC CCGTCCTGCC ACAAGCCCAG CATCCTTACC TACATTGCCA TCTTCCTCAC GCACGGCAAC

TCGGCCATGA ACCCCATTGT CTATGCCTTC CGCATCCAGA AGTTCCGCGT CACCTTCCTT AAGATTTGGA

ATGACCATTT CCGCTGCCAG CCTGCACCTC CCATTGACGA GGATCTCCCA GAAGAGAGGC CTGATGACTA G-3'

(FRAG. NO:___) (SEQ. ID NO: 2432)

5'-CGCATTTGTG TTTTAATAAA AGAATCTGGA AGATAAATAG TCTTGAAGAG AGACAAAGGA AGGAAAATTT

AAATCCTTAG ATTCAAGCAG AAGAATTCCA TGTGGAAGGT TTGGGTTGTT GTTGTTGTTG TTTGGTGTGT

TTTTTGTTTT TTTGTTTTTT TGTTTTTTTT TGAGATGGAG TCTCGCTGTG TTACCGGGAG CGACAGAGCC

GCACGGCCGA GTCGAGTCCC AGCCAGCTAC CATCCCTCTG GAGCTTACCG GCCGGCCTTG GCTTCCCCAG

GAATCCCTGG AGCTAGCGGC TGCTGAAGGC GTCGAGGTGT GGGGGCACTT GGACAGAACA GTCAGGCAGC

CGGGAGCTCT GCCAGCTTTG GTGACCTTGG GTGCTTGCCT CGTGCCCCTT GGTGCCCGTC TGCTGATGTG

CCCAGCCTGT GCCCGCCATG CCGCCCTCCA CTCTCAGCTTT CCAGGCCGCC TACATCGGCA TCGAGGTGCT

CATCGCCCTG GTCTCTGTGC CCGGGAACGT GCTGGTGATC TGGGCGGTGA AGGTGAACCA GGCGCTGCGG

GATGCCACCT TCTGCTTCAT CGTGTCGCTG GCGGTGGCTG ATGTGGCCGT GGGTGCCCTG GTCATCCCCC

TCGCCATCCT CATCAACATT GGGCCACAGA CCTACTTCCA CACCTGCCTC ATGGTTGCCT GTCCGGTCCT

CATCCTCACC CAGAGCTCCA TCCTGGCCCT GCTGGCAATT GCTGTGGACC GCTACCTCCG GGTCAAGATC

CCTCTCCGGT ACAAGATGGT GGTGACCCCC CGGAGGGCGG CGGTGGCCAT AGCCGGCTGC TGGATCCTCT

CCTTCGTGGT GGGACTGACC CCTATGTTTG GCTGGAACAA TCTGAGTGCG GTGGAGCGGG CCTGGGCAGC

CAACGGCAGC ATGGGGGAGC CCGTGATCAA GTGCGAGTTC GAGAAGGTCA TCAGCATGGA GTACATGGTC

TACTTCAACT TCTTTGTGTG GGTGCTGCCC CCGCTTCTCC TCATGGTCCT CATCTACCTG GAGGTCTTCT

ACCTAATCCG CAAGCAGCTC AACAAGAAGG TGTCGGCCTC CTCCGGCGAC CCGCAGAAGT ACTATGGGAA

GGAGCTGAAG ATCGCCAAGT CGCTGGCCCT CATCCTCTTC CTCTTTGCCC TCAGCTGGCT GCCTTTGCAC

ATCCTCAACT GCATCACCCT CTTCTGCCCG TCCTGCCACA AGCCCAGCAT CCTTACCTAC ATTGCCATCT

TCCTCACGCA CGGCAACTCG GCCATGAACC CCATTGTCTA TGCCTTCCGC ATCCAGAAGT TCCGCGTCAC

CTTCCTTAAG ATTTGGAATG ACCATTTCCG CTGCCAGCCT GCACCTCCCA TTGACGAGGA TCTCCCAGAA

GAGAGGCCTG ATGACTAGAC CCCGCCTTCC GCTCCCACCG CCCACATCCA GTGGGGTCTC AGTCCAGTCC

TCACATGCCC GCTGTCCCAG GGGTCTCCCT GAGCCTGCCC CAGCTGGGCT GTTGGCTGGG GCATGGGGG

AGGCTCTGAA GAGATACCCA CAGAGTGTGG TCCCTCCACT AGGAGTTAAC TACCCTACAC CTCTGGGCCC

-continued

```
TGCAGGAGGC CTGGGAGGGC AAGGGTCCTA CGGAGGGACC AGGTGTCTAG AGGCAACAGT GTTCTGAGCC
CCCACCTGCC TGACCATCCC ATGAGCAGTC CAGAGCCTCA GGGCTGGGCA GGTCCTGGGG AGGCTGAGAC
TGCAGAGGAG CCACCTGGGC TGGGAGAAGG TGCTTGGGCT TCTGCGGTGA GGCAGGGGAG TCTGCTTGTC
TTAGATGTTG GTGGTGCAGC CCCAGGACCA AGCTTAAGGA GAGGAGAGCA TCTGCTCTGA GACGGATGGA
AGGAGAGAGG TTGAGGATGC ACTGGCCTGT TCTGTAGGAG AGACTGGCCA GA-3'
```

(FRAG. NO:___) (SEQ. ID NO: 2422)

```
5'-ATGAGTGTCA GAAGTGTGAA GGGTGCCTGT TCTGAATCCC AGAGCCTCCT CTCCCTCTGT GAGGCTGCA
GGTGAGGAAG GGTTTAACCT CACTGGAAGG AATCCCTGGA GCTAGCGGCT GCTGAAGGCG TCGAGGTGTG
GGGGCACTTG GACAGAACAG TCAGGCAGCC GGGAGCTCTG CCAGCTTTGG TGACCTTGGG CCGGGCTGGG
AGCGCTGCGG CGGGAGCCGG AGGACTATGA GCTGCCGCGC GTTGTCCAGA GCCCAGCCCA GCCCTACGCG
CGCGGCCCGG AGCTCTGTTC CCTGGAACTT TGGGCACTGC CTCTGGGACC CTGCCGGCC AGCAGGCAGG
ATGGTGCTTG CCTCGTGCCC CTTGGTGCCC GTCTGCTGAT GTGCCCAGCC TGTGCCCGCC ATGCCGCCCT
CCATCTCAGC TTTCCAGGCC GCCTACATCG GCATCGAGGT GCTCATCGCC CTGGTCTCTG TGCCCGGGAA
CGTGCTGGTG ATCTGGGCGG TGAAGGTGAA CCAGGCGCTG CGGGATGCCA CCTTCTGCTT CATCGTGTCG
CTGGCGGTGG CTGATGTGGC CGTGGGTGCC CTGGTCATCC CCTCGCCAT CCTCATCAAC ATTGGGCCAC
AGACCTACTT CCACACCTGC CTCATGGTTG CCTGTCCGGT CCTCATCCTC ACCCAGAGCT CCATCCTGGC
CCTGCTGGCA ATTGCTGTGG ACCGCTACCT CCGGGTCAAG ATCCCTCTCC GGTACAAGAT GGTGGTGACC
CCCCGGAGGG CGGCGGTGGC CATAGCCGGC TGCTGGATCC TCTCCTTCGT GGTGGGACTG ACCCCTATGT
TTGGCTGGAA CAATCTGAGT GCGGTGGAGC GGGCCTGGGC AGCCAACGGC AGCATGGGGG AGCCCGTGAT
CAAGTGCGAG TTCGAGAAGG TCATCAGCAT GGAGTACATG GTCTACTTCA ACTTCTTTGT GTGGGTGCTG
CCCCCGCTTC TCCTCATGGT CCTCATCTAC CTGGAGGTCT TCTACCTAAT CCGCAAGCAG CTCAACAAGA
AGGTGTCGGC CTCCTCCGGC GACCCGCAGA AGTACTATGG GAAGGAGCTG AAGATCGCCA AGTCGCTGGC
CCTCATCCTC TTCCTCTTTG CCCTCAGCTG GCTGCCTTTG CACATCCTCA ACTGCATCAC CCTCTTCTGC
CCGTCCTGCC ACAAGCCCAG CATCCTTACC TACATTGCCA TCTTCCTCAC GCACGGCAAC TCGGCCATGA
ACCCCATTGT CTATGCCTTC CGCATCCAGA AGTTCCGCGT CACCTTCCTT AAGATTTGGA ATGACCATTT
CCGCTGCCAG CCTGCACCTC CCATTGACGA GGATCTCCCA GAAGAGAGGC CTGATGACTA GACCCCGCCT
TCCGCTCCCA CCAGCCCACA TCCAGTGGGG TCTCAGTCCA GTCCTCACAT GCCCGCTGTC CAGGGGTCT
CCCTGAGCCT GCCCCAGCTG GCTGTTGGC TGGGGGCATG GGGGAGGCTC TGAAGAGATA CCCACAGAGT
GTGGTCCCTC CACTAGGAGT TAACTACCCT ACACCTCTGG GCCCTGCAGG AGGCCTGGGA GGGCAAGGGT
CCTACGGAGG GACCAGGTGT CTAGAGGCAA CAGTGTTCTG AGCCCCCACC TGCCTGACCA TCCCATGAGC
AGTCCAGCGC TTCAGGGCTG GCAGGTCCT GGGGAGGCTG AGACTGCAGA GGAGCCACCT GGGCTGGGAG
AAGGTGCTTG GCTTCTGCG GTGAGGCAGG GGAGTCTGCT TGTCTTAGAT GTTGGTGGTG CAGCCCCAGG
ACCAAGCTTA AGGAGAGGAG AGCATCTGCT CTGAGACGGA TGGAAGGAGA GAGGTTGAGG ATGCACTGGC
CTGTTCTGTA GGAGAGACTG GCCAGAGGCA GCTAAGGGGC AGGAATCAAG GAGCCTCCGT TCCCACCTCT
GAGGACTCTG GACCCCAGGC CATACCAGGT GCTAGGGTGC CTGCTCTCCT TGCCCTGGGC CAGCCCAGGA
TTGTACGTGG GAGAGGCAGA AAGGGTAGGT TCAGTAATCA TTTCTGATGA TTTGCTGGAG TGCTGGCTCC
ACGCCCTGGG GAGTGAGCTT GGTGCGGTAG GTGCTGGCCT CAAACAGCCA CGAGGTGGTA GCTCTGAGCC
CTCCTTCTTG CCCTGAGCTT TCCGGGGAGG AGCCTGGAGT GTAATTACCT GTCATCTGGG CCACCAGCTC
CACTGGCCCC CGTTGCCGGG CCTGGACTGT CCTAGGTGAC CCCATCTCTG CTGCTTCTGG GCCTGATGGA
```

```
GAGGAGAACA CTAGACATGC CAACTCGGGA GCATTCTGCC TGCCTGGGAA CGGGGTGGAC GAGGGAGTGT

CTGTAAGGAC TCAGTGTTGA CTGTAGGCGC CCCTGGGGTG GGTTTAGCAG GCTGCAGCAG GCAGAGGAGG

AGTACCCCCC TGAGAGCATG TGGGGGAAGG CCTTGCTGTC ATGTGAATCC CTCAATACCC CTAGTATCTG

GCTGGGTTTT CAGGGGCTTT GGAAGCTCTG TTGCAGGTGT CCGGGGGTCT AGGACTTTAG GGATCTGGGA

TCTGGGGAAG GACCAACCCA TGCCCTGCCA AGCCTGGAGC CCCTGTGTTG GGGGCAAGG TGGGGGAGCC

TGGAGCCCCT GTGTGGGAGG GCGAGGCGGG GGAGCCTGGA GCCCCTGTGT GGGAGGGCGA GGCGGGGGAT

CCTGGAGCCC CTGTGTCGGG GGGCGAGGGA GGGGAGGTGG CCGTCGGTTG ACCTTCTGAA CATGAGTGTC

AACTCCAGGA CTTGCTTCCA AGCCCTTCCC TCTGTTGGAA ATTGGGTGTG CCCTGGCTCC CAAGGGAGGC

CCATGTGACT AATAAAAAAC TGTGAACCCT-3' (FRAG. NO:__) (SEQ. ID NO: 2421)

5'-ATGCCGCCCT CCATCTCAGC TTTCCAGGCC GCCTACATCG GCATCGAGGT GCTCATCGCC CTGGTCTCTG

TGCCCGGGAA CGTGCTGGTG ATCTGGGCGG TGAAGGTGAA CCAGGCGCTG CGGGATGCCA CCTTCTGCTT

CATCGTCTCG CTGGCGGTGG CTGATGTGGC CGTGGGTGCC CTGGTCATCC CCCTCGCCAT CCTCATCAAC

ATTGGGCCAC AGACCTACTT CCACACCTGC CTCATGGTTG CCTGTCCGGT CCTCATCCTC ACCCAGAGCT

CCATCCTGGC CCTGCTGGCA ATTGCTGTGG ACCGCTACCT CCGGGTCAAG ATCCCTCTCC GGTACAAGAT

GGTGGTGACC CCCCGGAGGG CGGCGGTGGC CATAGCCGGC TGCTGGATCC TCTCCTTCGT GGTGGGACTG

CCCCTATGT TTGGCTGGAA CAATCTGAGT GCGGTGGAGC GGGCCTGGGC AGCCAACGGC AGCATGGGGG

AGCCCGTGAT CAAGTGCGAG TTCGAGAAGG TCATCAGCAT GGAGTACATG GTCTACTTCA ACTTCTTTGT

GTGGGTGCTG CCCCCGCTTC TCCTCATGGT CCTCATCTAC CTGGAGGTCT TCTACCTAAT CCGCAAGCAG

CTCAACAAGA AGGTGTCGGC CTCCTCCGGC GACCCGCAGA AGTACTATGG GAAGGAGCTG AAGATCGCCA

AGTCGCTGGC CCTCATCCTC TTCCTCTTTG CCCTCAGCTG GCTGCCTTTG CACATCCTCA ACTGCATCAC

CCTCTTCTGC CCGTCCTGCC ACAAGCCCAG CATCCTTACC TACATTGCCA TCTTCCTCAC GCACGGCAAC

TCGGCCATGA ACCCCATTGT CTATGCCTTC CGCATCCAGA AGTTCCGCGT CACCTTCCTT AAGATTTGGA

ATGACCATTT CCGCTGCCAG CCTGCACCTC CCATTGACGA GGATCTCCCA GAAGAGAGGC CTGATGACTA G (FRAG NO:__) (SEQ. ID NO: 2420)

5'-GAT GGA GGG CGG CAT GGC GGG-3' (FRAG. NO: 1657) (SEQ ID NO: 2412)

5'-G CGG GTC GCC GG-3' (FRAG. NO: 1658) (SEQ ID NO: 2413)

5'-GGC GGG CBC BGG C-3' (FRAG. NO: 1659) (SEQ ID NO: 2414)

5'-GGC GGG CBC-3' (FRAG. NO: 1660) (SEQ ID NO: 2415)

5'-GC GGC CTG G-3' (FRAG. NO: 1661) (SEQ ID NO: 2416)

5'-GB GGG CGG C-3' (FRAG. NO: 1662) (SEQ ID NO: 2417)

5'-GBT GGB GGG-3' (FRAG. NO: 1663) (SEQ ID NO: 2418)

5'-GG CTG GGC-3' (FRAG. NO: 1664) (SEQ ID NO: 2419)

5'-GC GGC CTG GAA AGC TGA GAT GGA GGG CGG CAT GGC GGG CAC AGG CTG GGC-3' (FRAG. 1) (SEQ. ID NO: 11)

5'-C GGC CTG GAA AGC TGA GAT GGA GGG CGG CAT GGC GGG CAC AGG CTG GGC-3' (FRAG 2) (SEQ. ID NO: 12)

5'-GGC CTG GAA AGC TGA GAT GGA GGG CGG CAT GGC GGG CAC AGG CTG GGC-3' (FRAG 3) (SEQ.ID NO: 13)

5'-GC CTG GAA AGC TGA GAT GGA GGG CGG CAT GGC GGG CAC AGG CTG GGC-3' (FRAG 4) (SEQ. ID NO: 14)

5'-C CTG GAA AGC TGA GAT GGA GGG CGG CAT GGC GGG CAC AGG CTG GGC-3' (FRAG 5) (SEQ. ID NO: 15)

5'-CTG GAA AGC TGA GAT GGA GGG CGG CAT GGC GGG CAC AGG CTG GGC-3' (FRAG 6) (SEQ. ID NO: 16)

5'-TG OAA AGC TGA GAT GGA GGG CGG CAT GGC GGG CAC AGG CTG GGC-3' (FRAG 7) (SEQ. ID NO: 17)
```

-continued

5'-G GAA AGC TGA GAT GGA GGG CGG CAT GGC GGG CAC AGG CTG GGC-3' (FRAG 8) (SEQ. ID NO: 18)

5'-GAA AGC TGA GAT GGA GGG CGG CAT GGC GGG CAC AGG CTG GGC-3' (FRAG 9) (SEQ. ID NO: 19)

5'-AA AGC TGA GAT GGA GGG CGG CAT GGC GGG CAC AGG CTG GGC-3' (FRAG 10) (SEQ. ID NO: 20)

5'-A AGC TGA GAT GGA GGG CGG CAT GGC GGG CAC AGG CTG GGC-3' (FRAG 11) (SEQ. ID NO: 21)

5'-AGC TGA GAT GGA GGG CGG CAT GGC GGG CAC AGG.CTG GGC-3' (FRAG 12) (SEQ. ID NO: 22)

5'-GC TGA GAT GGA GGG CGG CAT GGC GGG CAC AGG CTG GGC-3' (FRAG 13) (SEQ. ID NO: 23)

5'-C TGA GAT GGA GGG CGG CAT GGC GGG CAC AGG CTG GGC-3' (FRAG 14) (SEQ. ID NO: 24)

5'-TGA GAT GGA GGG CGG CAT GGC GGG CAC AGG CTG GGC-3' (FRAG 15) (SEQ. ID NO: 25)

5'-GA GAT GGA GGG CGG CAT GGC GGG CAC AGG CTG GGC-3' (FRAG 16) (SEQ. ID NO: 26)

5'-A GAT GGA GGG CGG CAT GGC GGG CAC AGG CTG GGC-3' (FRAG 17) (SEQ. ID NO: 27)

5'-GAT GGA GGG CGG CAT GGC GGG CAC AGG CTG GGC-3' (FRAG 1B) (SEQ. ID NO: 28)

5'-AT GGA GGG CGG CAT GGC GGG CAC AGG CTG GGC-3' (FRAG 19) (SEQ. ID NO: 29)

5'-T GGA GGG CGG CAT GGC GGG CAC AGG CTG GGC-3' (FRAG 20) (SEQ. ID NO: 30)

5'-GGA GGG CGG CAT GGC GGG CAC AGG CTG GGC-3' (FRAG 21) (SEQ. ID NO: 31)

5'-GA GGG CGG CAT GGC GGG CAC AGG CTG GGC-3' (FRAG 22) (SEQ. ID NO: 32)

5'-A GGG CGG CAT GGC GGG CAC AGG CTG GGC-3' (FRAG 23) (SEQ. ID NO: 33)

5'-GGG CGG CAT GGC GGG CAC AGG CTG GGC-3' (FRAG 24) (SEQ. ID NO: 34)

5'-GG CGG CAT GGC GGG CAC AGG CTG GGC-3' (FRAG 25) (SEQ. ID NO: 35)

5'-G CGG CAT GGC GGG CAC AGG CTG GGC-3' (FRAG 26) (SEQ. ID NO: 36)

5'-CGG CAT GGC GGG CAC AGG CTG GGC-3' (FRAG 27) (SEQ. ID NO: 37)

5'-GG CAT GGC GGG CAC AGG CTG GGC-3' (FRAG 28) (SEQ. ID NO: 38)

5'-G CAT GGC GGG CAC AGG CTG GGC-3' (FRAG 29) (SEQ. ID NO: 39)

5'-CAT GGC GGG CAC AGG CTG GGC-3' (FRAG 30) (SEQ. ID NO: 4))

5'-AT GGC GGG CAC AGG CTG GGC-3' (FRAG 31) (SEQ. ID NO: 41)

5'-T GGC GGG CAC AGG CTG GGC-3' (FRAG 32) (SEQ. ID NO: 42)

5'-GGC GGG CAC AGG CTG GGC-3' (FRAG 33) (SEQ. ID NO: 43)

5'-GC GGG CAC AGG CTG GGC-3' (FRAG 34) (SEQ. ID NO: 44)

5'-C GGG CAC AGG CTG GGC-3' (FRAG 35) (SEQ. ID NO: 45)

5'-GGG CAC AGG CTG GGC-3' (FRAG 36) (SEQ. ID NO: 46)

5'-GG CAC AGG CTG GGC-3' (FRAG 37) (SEQ. ID NO: 47)

5'-G CAC AGG CTG GGC-3' (FRAG 38) (SEQ. ID NO: 48)

5'-CAC AGG CTG GGC-3' (FRAG 39) (SEQ. ID NO: 49)

5'-AC AGG CTG GGC-3' (FRAG 4)) (SEQ. ID NO: 50)

5'-C AGG CTG GGC-3' (FRAG 41) (SEQ. ID NO: 51)

5'-AGG CTG GGC-3' (FRAG 42) (SEQ. ID NO: 52)

5'-GGC GGC CTG GAA AGC TGA GAT GGA GGG CGG CAT GGC GGG CAC AGG CTG GGC-3' (FRAG 43) (SEQ. ID NO: 53)

5'-GGC GGC CTG GAA AGC TGA GAT GGA GGG CGG CAT GGC GGG CAC AGG CTG GG-3' (FRAG 44) (SEQ. ID NO: 54)

5'-GGC GGC CTG GAA AGC TGA GAT GGA GGG CGG CAT GGC GGG CAC AGG CTG G-3' (FRAG 45) (SEQ. ID NO: 55)

-continued

5'-GGC GGC CTG GAA AGC TGA GAT GGA GGG CGG CAT GGC GGG CAC AGG CTG-3' (FRAG 46) (SEQ. ID NO: 56)

5'-GGC GGC CTG GAA AGC TGA GAT GGA GGG CGG CAT GGC GGG CAC AGG CT-3' (FRAG 47) (SEQ. ID NO: 57)

5'-GGC GGC CTG GAA AGC TGA GAT GGA GGG CGG CAT GGC GGG CAC AGG C-3' (FRAG 48) (SEQ. ID NO: 58)

5'-GGC GGC CTG GAA AGC TGA GAT GGA GGG CGG CAT GGC GGG CAC AGG-3' (FRAG 49) (SEQ. ID NO: 59)

5'-GGC GGC CTG GAA AGC TGA GAT GGA GGG CGG CAT GGC GGG CAC AG-3' (FRAG 50) (SEQ. ID NO: 60)

5'-GGC GGC CTG GAA AGC TGA GAT GGA GGG CGG CAT GGC GGG CAC A-3' (FRAG 51) (SEQ. ID NO: 61)

5'-GGC GGC CTG GAA AGC TGA GAT GGA GGG CGG CAT GGC GGG CAC-3' (FRAG 52) (SEQ. ID NO: 62)

5'-GGC GGC CTG GAA AGC TGA GAT GGA GGG CGG CAT GGC GGG CA-3' (FRAG 53) (SEQ. ID NO: 63)

5'-GGC GGC CTG GAA AGC TGA GAT GGA GGG CGG CAT GGC GGG C-3' (FRAG 54) (SEQ. ID NO: 64)

5'-GGC GGC CTG GAA AGC TGA GAT GGA GGG CGG CAT GGC GGG-3' (FRAG 55) (SEQ. ID NO: 65)

5'-GGC GGC CTG GAA AGC TGA GAT GGA GGG CGG CAT GGC GG-3' (FRAG 56) (SEQ. ID NO: 66)

5'-GGC GGC CTG GAA AGC TGA GAT GGA GGG CGG CAT GGC G-3' (FRAG 57) (SEQ. ID NO: 67)

5'-GGC GGC CTG GAA AGC TGA GAT GGA GGG CGG CAT GGC-3' (FRAG 58) (SEQ. ID NO: 68)

5'-GGC GGC CTG GAA AGC TGA GAT GGA GGG CGG CAT GG-3' (FRAG 59) (SEQ. ID NO: 69)

5'-GGC GGC CTG GAA AGC TGA GAT GGA GGG CGG CAT G-3' (FRAG 60) (SEQ. ID NO: 70)

5'-GGC GGC CTG GAA AGC TGA GAT GGA GGG CGG CAT-3' (FRAG 61) (SEQ. ID NO: 71)

5'-GGC GGC CTG GAA AGC TGA GAT GGA GGG CGG CA-3' (FRAG 62) (SEQ. ID NO: 72)

5'-GGC GGC CTG GAA AGC TGA GAT GGA GGG CGG C-3' (FRAG 63) (SEQ. ID NO: 73)

5'-GGC GGC CTG GAA AGC TGA GAT GGA GGG CGG-3' (FRAG 64) (SEQ. ID NO: 74)

5'-GGC GGC CTG GAA AGC TGA GAT GGA GGG CG-3' (FRAG 65) (SEQ. ID NO: 75)

5'-GGC GGC CTG GAA AGC TGA GAT GGA GGG C-3' (FRAG 66) (SEQ. ID NO: 76)

5'-GGC GGC CTG GAA AGC TGA GAT GGA GGG-3' (FRAG 67) (SEQ. ID NO: 77)

5'-GGC GGC CTG GAA AGC TGA GAT GGA GG-3' (FRAG 68) (SEQ. ID NO: 78)

5'-GGC GGC CTG GAA AGC TGA GAT GGA G-3' (FRAG 69) (SEQ.ID NO: 79)

5'-GGC GGC CTG GAA AGC TGA GAT GGA-3' (FRAG 70) (SEQ. ID NO: 80)

5'-GGC GGC CTG GAA AGC TGA GAT GG-3' (FRAG 71) (SEQ. ID NO: 81)

5'-GGC GGC CTG GAA AGC TGA GAT G-3' (FRAG 72) (SEQ. ID NO: 82)

5'-GGC GGC CTG GAA AGC TGA GAT-3' (FRAG 73) (SEQ. ID NO: 83)

5'-GGC GGC CTG GAA AGC TGA GA-3' (FRAG 74) (SEQ. ID NO: 84)

5'-GGC GGC CTG GAA AGC TGA G-3' (FRAG 75) (SEQ. ID NO: 85)

5'-GGC GGC CTG GAA AGC TGA-3' (FRAG 76) (SEQ.ID NO: 86)

5'-GGC GGC CTG GAA AGC TG-3' (FRAG 77) (SEQ. ID NO: 87)

5'-GGC GGC CTG GAA AGC T-3' (FRAG 78) (SEQ. ID NO: S8)

5'-GGC GGC CTG GAA AGC-3' (FRAG 79) (SEQ. ID NO: 89)

5'-GGC GGC CTG GAA AG-3' (FRAG 80) (SEQ. ID NO: 90)

5'-GGC GGC CTG GAA A-3' (FRAG 81) (SEQ. ID NO: 91)

5'-GGC GGC CTG GAA-3' (FRAG 82) (SEQ. ID NO: 92)

5'-GGC GGC CTG GA-3' (FRAG 83) (SEQ. ID NO: 93)

5'-GGC GGC CTG G-3' (FRAG 84) (SEQ. ID NO: 94)

-continued

5'-GGC GGC CTG GAA AGC TGA GAT GGA GGG CGG CAT GGC GGG CAC AGG CTG GGC-3' (FRAG 85) (SEQ. ID NO: 95)

5'-GC GGC CTG GAA AGC TGA GAT GGA GGG CGG CAT GGC GGG CAC AGG CTG GG-3' (FRAG 86) (SEQ. ID NO: 96)

5'-GC GGC CTG GAA AGC TGA GAT GGA GGG CGG CAT GGC GGG CAC AGG CTG G-3' (FRAG 87) (SEQ. ID NO: 97)

5'-GC GGC CTG GAA AGC TGA GAT GGA GGG CGG CAT GGC GGG CAC AGG CTG-3' (FRAG 88) (SEQ. ID NO: 98)

5'-GC GGC CTG GAA AGC TGA GAT GGA GGG CGG CAT GGC GGG CAC AGG CT-3' (FRAG 89) (SEQ. ID NO: 99)

5'-GC GGC CTG GAA AGC TGA GAT GGA GGG CGG CAT GGC GGG CAC AGG C-3' (FRAG 90) (SEQ. ID NO: 100)

5'-GC GGC CTG GAA AGC TGA GAT GGA GGG CGG CAT GGC GGG CAC AGG-3' (FRAG 91) (SEQ. ID NO: 101)

5'-GC GGC CTG GAA AGC TGA GAT GGA GGG CGG CAT GGC GGG CAC AG-3' (FRAG 92) (SEQ. ID NO: 102)

5'-GC GGC CTG GAA AGC TGA GAT GGA GGG CGG CAT GGC GGG CAC A-3' (FRAG 93) (SEQ. ID NO: 103)

5'-GC GGC CTG GAA AGC TGA GAT GGA GGG CGG CAT GGC GGG CAC-3' (FRAG 94) (SEQ. ID NO: 104)

5'-GC GGC CTG GAA AGC TGA GAT GGA GGG CGG CAT GGC GGG CA-3' (FRAG 95) (SEQ. ID NO: 105)

5'-GC GGC CTG GAA AGC TGA GAT GGA GGG CGG CAT GGC GGG C-3' (FRAG 96) (SEQ. ID NO: 106)

5'-GC GGC CTG GAA AGC TGA GAT GGA GGG CGG CAT GGC GGG-3' (FRAG 97) (SEQ. ID NO: 107)

5'-GC GGC CTG GAA AGC TGA GAT GGA GGG CGG CAT GGC GG-3' (FRAG 98) (SEQ. ID NO: 108)

5'-GC GGC CTG GAA AGC TGA GAT GGA GGG CGG CAT GGC G-3' (FRAG 99) (SEQ. ID NO: 109)

5'-GC GGC CTG GAA AGC TGA GAT GGA GGG CGG CAT GGC-3' (FRAG 100) (SEQ. ID NO: 110)

5'-GC GGC CTG GAA AGC TGA GAT GGA GGG CGG CAT GG-3' (FRAG 101) (SEQ. ID NO: 111)

5'-GC GGC CTG GAA AGC TGA GAT GGA GGG CGG CAT G-3' (FRAG 102) (SEQ. ID NO: 112)

5'-GC GGC CTG GAA AGC TGA GAT GGA GGG CGG CAT-3' (FRAG 103) (SEQ. ID NO: 113)

5'-GC GGC CTG GAA AGC TGA GAT GGA GGG CGG CA-3' (FRAG 104) (SEQ. ID NO: 114)

5'-GC GGC CTG GAA AGC TGA GAT GGA GGG CGG C-3' (FRAG 105) (SEQ. ID NO: 115)

5'-GC GGC CTG GAA AGC TGA GAT GGA GGG CGG-3' (FRAG 106) (SEQ. ID NO: 116)

5'-GC GGC CTG GAA AGC TGA GAT GGA GGG CG-3' (FRAG 107) (SEQ. ID NO: 117)

5'-GC GGC CTG GAA AGC TGA GAT GGA GGG C-3' (FRAG 108) (SEQ. ID NO: 118)

5'-GC GGC CTG GAA AGC TGA GAT GGA GGG-3' (FRAG 109) (SEQ. ID NO: 119)

5'-GC GGC CTG GAA AGC TGA GAT GGA GG-3' (FRAG 110) (SEQ. ID NO: 120)

5'-GC GGC CTG GAA AGC TGA GAT GGA G-3' (FRAG 111) (SEQ. ID NO: 121)

5'-GC GGC CTG GAA AGC TGA GAT GGA-3' (FRAG 112) (SEQ. ID NO: 122)

5'-GC GGC CTG GAA AGC TGA GAT GG-3' (FRAG 113) (SEQ. ID NO: 123)

5'-GC GGC CTG GAA AGC TGA GAT G-3' (FRAG 114) (SEQ. ID NO: 124)

5'-GC GGC CTG GAA AGC TGA GAT-3' (FRAG 115) (SEQ. ID NO: 125)

5'-GC GGC CTG GAA AGC TGA GA-3' (FRAG 116) (SEQ. ID NO: 126)

5'-GC GGC CTG GAA AGC TGA G-3' (FRAG 117) (SEQ. ID NO: 127)

5'-GC GGC CTG GAA AGC TGA-3' (FRAG 118) (SEQ. ID NO: 128)

5'-GC GGC CTG GAA AGC TG-3' (FRAG 119) (SEQ. ID NO: 129)

5'-GC GGC CTG GAA AGC T-3' (FRAG 120) (SEQ. ID NO: 130)

5'-GC GGC CTG GAA AGC-3' (FRAG 121) (SEQ. ID NO: 131)

-continued

5'-GC GGC CTG GAA AG-3' (FRAG 122) (SEQ. ID NO: 132)

5'-GC GGC CTG GAA A-3' (FRAG 123) (SEQ. ID NO: 133)

5'-GC GGC CTG GAA-3' (FRAG 124) (SEQ. ID NO: 134)

5'-GC GGC CTG GA-3' (FRAG 125) (SEQ. ID NO: 135)

5'-C GGC CTG GAA AGC TGA GAT GGA GGG CGG CAT GGC GGG CAC AGG CTG GGC-3' (FRAG 126) (SEQ. ID NO: 136)

5'-C GGC CTG GAA AGC TGA GAT GGA GGG CGG CAT GGC GGG CAC AGG CTG GG-3' (FRAG 127) (SEQ. ID NO: 137)

5'-C GGC CTG GAA AGC TGA GAT GGA GGG CGG CAT GGC GGG CAC AGG CTG G-3' (FRAG 128) (SEQ. ID NO: 138)

5'-C GGC CTG GAA AGC TGA GAT GGA GGG CGG CAT GGC GGG CAC AGG CTG-3' (FRAG 129) (SEQ. ID NO: 139)

5'-C GGC CTG GAA AGC TGA GAT GGA GGG CGG CAT GGC GGG CAC AGG CT-3' (FRAG 130) (SEQ. ID NO: 140)

5'-C GGC CTG GAA AGC TGA GAT GGA GGG CGG CAT GGC GGG CAC AGG C-3' (FRAG 131) (SEQ. ID NO: 141)

5'-C GGC CTG GAA AGC TGA GAT GGA GGG CGG CAT GGC GGG CAC AGG-3' (FRAG 132) (SEQ. ID NO: 142)

5'-C GGC CTG GAA AGC TGA GAT GGA GGG CGG CAT GGC GGG CAC AG-3' (FRAG 133) (SEQ. ID NO: 143)

5'-C GGC CTG GAA AGC TGA GAT GGA GGG CGG CAT GGC GGG CAC A-3' (FRAG 134) (SEQ. ID NO: 144)

5'-C GGC CTG GAA AGC TGA GAT GGA GGG CGG CAT GGC GGG CAC-3' (FRAG 135) (SEQ. ID NO: 145)

5'-C GGC CTG GAA AGC TGA GAT GGA GGG CGG CAT GGC GGG CA-3' (FRAG 136) (SEQ. ID NO: 146)

5'-C GGC CTG GAA AGC TGA GAT GGA GGG CGG CAT GGC GGG C-3' (FRAG 137) (SEQ. ID NO: 147)

5'-C GGC CTG GAA AGC TGA GAT GGA GGG CGG CAT GGC GGG-3' (FRAG 138) (SEQ. ID NO: 148)

5'-C GGC CTG GAA AGC TGA GAT GGA GGG CGG CAT GGC GG-3' (FRAG 139) (SEQ. ID NO: 149)

5'-C GGC CTG GAA AGC TGA GAT GGA GGG CGG CAT GGC G-3' (FRAG 14)) (SEQ. ID NO: 150)

5'-C GGC CTG GAA AGC TGA GAT GGA GGG CGG CAT GGC-3' (FRAG 141) (SEQ. ID NO: 151)

5'-C GGC CTG GAA AGC TGA GAT GGA GGG CGG CAT GG-3' (FRAG 142) (SEQ. ID NO: 152)

5'-C GGC CTG GAA AGC TGA GAT GGA GGG CGG CAT G-3' (FRAG 143) (SEQ. ID NO: 153)

5'-C GGC CTG GAA AGC TGA GAT GGA GGG CGG CAT-3' (FRAG 144) (SEQ. ID NO: 154)

5'-C GGC CTG GAA AGC TGA GAT GGA GGG CGG CA-3' (FRAG 145) (SEQ. ID NO: 155)

5'-C GGC CTG GAA AGC TGA GAT GGA GGG CGG C-3' (FRAG 146) (SEQ. ID NO: 156)

5'-C GGC CTG GAA AGC TGA GAT GGA GGG CGG-3' (FRAG 147) (SEQ. ID NO: 157)

5'-C GGC CTG GAA AGC TGA GAT GGA GGG CG-3' (FRAG 148) (SEQ. ID NO: 158)

5'-C GGC CTG GAA AGC TGA GAT GGA GGG C-3' (FRAG 148) (SEQ. ID NO: 159)

5'-C GGC CTG GAA AGC TGA GAT GGA GGG-3' (FRAG 150) (SEQ. ID NO: 160)

5'-C GGC CTG GAA AGC TGA GAT GGA GG-3' (FRAG 151) (SEQ. ID NO: 161)

5'-C GGC CTG GAA AGC TGA GAT GGA G-3' (FRAG 152) (SEQ. ID NO: 162)

5'-C GGC CTG GAA AGC TGA GAT GGA-3' (FRAG 153) (SEQ. ID NO: 163)

5'-C GGC CTG GAA AGC TGA GAT GG-3' (FRAG 154) (SEQ. ID NO: 164)

5'-C GGC CTG GAA AGC TGA GAT G-3' (FRAG 155) (SEQ. ID NO: 165)

5'-C GGC CTG GAA AGC TGA GAT-3' (FRAG 156) (SEQ. ID NO: 166)

5'-C GGC CTG GAA AGC TGA GA-3' (FRAG 157) (SEQ. ID NO: 167)

-continued

5'-C GGC CTG GAA AGC TGA G-3' (FRAG 158) (SEQ. ID NO: 168)

5'-C GGC CTG GAA AGC TGA-3' (FRAG 159) (SEQ. ID NO: 169)

5'-C GGC CTG GAA AGC TG-3' (FRAG 160) (SEQ. ID NO: 170)

5'-C GGC CTG GAA AGC T-3' (FRAG 161) (SEQ. ID NO: 171)

5'-C GGC CTG GAA AGC-3' (FRAG 162) (SEQ. ID NO: 172)

5'-C GGC CTG GAA AG-3' (FRAG 163) (SEQ. ID NO: 173)

5'-C GGC CTG GAA A-3' (FRAG 164) (SEQ. ID NO: 174)

5'-C GGC CTG GAA-3' (FRAG 165) (SEQ. ID NO: 175)

5'-C GGC CTG GAA AGC TGA GAT GGA GGG CGG CAT GGC GGG CAC AGG CTG GGC-3' (FRAG 166) (SEQ. ID NO: 176)

5'-GGC CTG GAA AGC TGA GAT GGA GGG CGG CAT GGC GGG CAC AGG CTG GG-3' (FRAG 167) (SEQ. ID NO: 177)

5'-GGC CTG GAA AGC TGA GAT GGA GGG CGG CAT GGC GGG CAC AGG CTG G-3' (FRAG 168) (SEQ. ID NO: 178)

5'-GGC CTG GAA AGC TGA GAT GGA GGG CGG CAT GGC GGG CAC AGG CTG-3' (FRAG 169) (SEQ. ID NO: 179)

5'-GGC CTG GAA AGC TGA GAT GGA GGG CGG CAT GGC GGG CAC AGG CT-3' (FRAG 170) (SEQ. ID NO: 180)

5'-GGC CTG GAA AGC TGA GAT GGA GGG CGG CAT GGC GGG CAC AGG C-3' (FRAG 171) (SEQ. ID NO: 181)

5'-GGC CTG GAA AGC TGA GAT GGA GGG CGG CAT GGC GGG CAC AGG-3' (FRAG 172) (SEQ. ID NO: 182)

5'-GGC CTG GAA AGC TGA GAT GGA GGG CGG CAT GGC GGG CAC AG-3' (FRAG 173) (SEQ. ID NO: 183)

5'-GGC CTG GAA AGC TGA GAT GGA GGG CGG CAT GGC GGG CAC A-3' (FRAG 174) (SEQ. ID NO: 184)

5'-GGC CTG GAA AGC TGA GAT GGA GGG CGG CAT GGC GGG CAC-3' (FRAG 175) (SEQ. ID NO: 185)

5'-GGC CTG GAA AGC TGA GAT GGA GGG CGG CAT GGC GGG CA-3' (FRAG 176) (SEQ. ID NO: 186)

5'-GGC CTG GAA AGC TGA GAT GGA GGG CGG CAT GGC GGG C-3' (FRAG 177) (SEQ. ID NO: 187)

5'-GGC CTG GAA AGC TGA GAT GGA GGG CGG CAT GGC GGG-3' (FRAG 178) (SEQ. ID NO: 188)

5'-GGC CTG GAA AGC TGA GAT GGA GGG CGG CAT GGC GG-3' (FRAG 179) (SEQ. ID NO: 189)

5'-GGC CTG GAA AGC TGA GAT GGA GGG CGG CAT GGC G-3' (FRAG 180) (SEQ. ID NO: 190)

5'-GGC CTG GAA AGC TGA GAT GGA GGG CGG CAT GGC-3' (FRAG 181) (SEQ. ID NO: 191)

5'-GGC CTG GAA AGC TGA GAT GGA GGG CGG CAT GG-3' (FRAG 182) (SEQ. ID NO: 192)

5'-GGC CTG GAA AGC TGA GAT GGA GGG CGG CAT G-3' (FRAG 183) (SEQ. ID NO: 193)

5'-GGC CTG GAA AGC TGA GAT GGA GGG CGG CAT-3' (FRAG 184) (SEQ. ID NO: 194)

5'-GGC CTG GAA AGC TGA GAT GGA GGG CGG CA-3' (FRAG 185) (SEQ. ID NO: 195)

5'-GGC CTG GAA AGC TGA GAT GGA GGG CGG C-3' (FRAG 186) (SEQ. ID NO: 196)

5'-GGC CTG GAA AGC TGA GAT GGA GGG CGG-3' (FRAG 187) (SEQ. ID NO: 197)

5'-GGC CTG GAA AGC TGA GAT GGA GGG CG-3' (FRAG 188) (SEQ. ID NO: 198)

5'-GGC CTG GAA AGC TGA GAT GGA GGG C-3' (FRAG 189) (SEQ. ID NO: 199)

5'-GGC CTG GAA AGC TGA GAT GGA GGG-3' (FRAG 190) (SEQ. ID NO: 200)

5'-GGC CTG GAA AGC TGA GAT GGA GG-3' (FRAG 191) (SEQ. ID NO: 201)

5'-GGC CTG GAA AGC TGA GAT GGA G-3' (FRAG 192) (SEQ. ID NO: 202)

5'-GGC CTG GAA AGC TGA GAT GGA-3' (FRAG 193) (SEQ. ID NO: 203)

5'-GGC CTG GAA AGC TGA GAT GG-3' (FRAG 194) (SEQ. ID NO: 204)

5'-GGC CTG GAA AGC TGA GAT G-3' (FRAG 195) (SEQ. ID NO: 205)

-continued

5'-GGC CTG GAA AGC TGA GAT-3' (FRAG 196) (SEQ. ID NO: 206)

5'-GGC CTG GAA AGC TGA GA-3' (FRAG 197) (SEQ. ID NO: 207)

5'-GGC CTG GAA AGC TGA G-3' (FRAG 198) (SEQ. ID NO: 208)

5'-GGC CTG GAA AGC TGA-3' (FRAG 199) (SEQ. ID NO: 209)

5'-GGC CTG GAA AGC TG-3' (FRAG 200) (SEQ. ID NO: 210)

5'-GGC CTG GAA AGC T-3' (FRAG 201) (SEQ. ID NO: 211)

5'-GGC CTG GAA AGC-3' (FRAG 202) (SEQ. ID NO: 212)

5'-GGC CTG GAA AG-3' (FRAG 203) (SEQ. ID NO: 213)

5'-GGC CTG GAA A-3' (FRAG 204) (SEQ. ID NO: 214)

5'-GC CTG GAA AGC TGA GAT GGA GGG CGG CAT GGC GGG CAC AGG CTG GGC-3' (FRAG 205) (SEQ. ID NO: 215)

5'-GC CTG GAA AGC TGA GAT GGA GGG CGG CAT GGC GGG CAC AGG CTG GG-3' (FRAG 206) (SEQ. ID NO: 216)

5'-GC CTG GAA AGC TGA GAT GGA GGG CGG CAT GGC GGG CAC AGG CTG G-3' (FRAG 207) (SEQ. ID NO: 217)

5'-GC CTG GAA AGC TGA GAT GGA GGG CGG CAT GGC GGG CAC AGG CTG-3' (FRAG 208) (SEQ. ID NO: 218)

5'-GC CTG GAA AGC TGA GAT GGA GGG CGG CAT GGC GGG CAC AGG CT-3' (FRAG 209) (SEQ. ID NO: 219)

5'-GC CTG GAA AGC TGA GAT GGA GGG CGG CAT GGC GGG CAC AGG C-3' (FRAG 210) (SEQ. ID NO: 220)

5'-GC CTG GAA AGC TGA GAT GGA GGG CGG CAT GGC GGG CAC AGG-3' (FRAG 211) (SEQ. ID NO: 221)

5'-GC CTG GAA AGC TGA GAT GGA GGG CGG CAT GGC GGG CAC AG-3' (FRAG 212) (SEQ. ID NO: 222)

5'-GC CTG GAA AGC TGA GAT GGA GGG CGG CAT GGC GGG CAC A-3' (FRAG 213) (SEQ. ID NO: 223)

5'-GC CTG GAA AGC TGA GAT GGA GGG CGG CAT GGC GGG CAC-3' (FRAG 214) (SEQ. ID NO: 224)

5'-GC CTG GAA AGC TGA GAT GGA GGG CGG CAT GGC GGG CA-3' (FRAG 215) (SEQ. ID NO: 225)

5'-GC CTG GAA AGC TGA GAT GGA GGG CGG CAT GGC GGG C-3' (FRAG 216) (SEQ. ID NO: 226)

5'-GC CTG GAA AGC TGA GAT GGA GGG CGG CAT GGC GGG-3' (FRAG 217) (SEQ. ID NO: 227)

5'-GC CTG GAA AGC TGA GAT GGA GGG CGG CAT GGC GG-3' (FRAG 218) (SEQ. ID NO: 228)

5'-GC CTG GAA AGC TGA GAT GGA GGG CGG CAT GGC G-3' (FRAG 219) (SEQ. ID NO: 229)

5'-GC CTG GAA AGC TGA GAT GGA GGG CGG CAT GGC-3' (FRAG 220) (SEQ. ID NO: 230)

5'-GC CTG GAA AGC TGA GAT GGA GGG CGG CAT GG-3' (FRAG 221) (SEQ. ID NO: 231)

5'-GC CTG GAA AGC TGA GAT GGA GGG CGG CAT G-3' (FRAG 222) (SEQ. ID NO: 232)

5'-GC CTG GAA AGC TGA GAT GGA GGG CGG CAT-3' (FRAG 223) (SEQ. ID NO: 233)

5'-GC CTG GAA AGC TGA GAT GGA GGG CGG CA-3' (FRAG 224) (SEQ. ID NO: 234)

5'-GC CTG GAA AGC TGA GAT GGA GGG CGG C-3' (FRAG 225) (SEQ. ID NO: 235)

5'-GC CTG GAA AGC TGA GAT GGA GGG CGG-3' (FRAG 226) (SEQ. ID NO: 236)

5'-GC CTG GAA AGC TGA GAT GGA GGG CG-3' (FRAG 227) (SEQ. ID NO: 237)

5'-GC CTG GAA AGC TGA GAT GGA GGG C-3' (FRAG 228) (SEQ. ID NO: 238)

5'-GC CTG GAA AGC TGA GAT GGA GGG-3' (FRAG 229) (SEQ. ID NO: 239)

5'-GC CTG GAA AGC TGA GAT GGA GG-3' (FRAG 230) (SEQ. ID NO: 240)

5'-GC CTG GAA AGC TGA GAT GGA G-3' (FRAG 231) (SEQ. ID NO: 241)

5'-GC CTG GAA AGC TGA GAT GGA-3' (FRAG 232) (SEQ. ID NO: 242)

5'-GC CTG GAA AGC TGA GAT GG-3' (FRAG 233) (SEQ. ID NO: 243)

-continued

5'-GC CTG GAA AGC TGA GAT G-3' (FRAG 234) (SEQ. ID NO: 244)

5'-GC CTG GAA AGC TGA GAT-3' (FRAG 235) (SEQ. ID NO: 245)

5'-GC CTG GAA AGC TGA GA-3' (FRAG 236) (SEQ. ID NO: 246)

5'-GC CTG GAA AGC TGA G-3' (FRAG 237) (SEQ. ID NO: 247)

5'-GC CTG GAA AGC TGA-3' (FRAG 238) (SEQ. ID NO: 248)

5'-GC CTG GAA AGC TG-3' (FRAG 239) (SEQ. ID NO: 249)

5'-GC CTG GAA AGC T-3' (FRAG 240) (SEQ. ID NO: 250)

5'-GC CTG GAA AGC-3' (FRAG 241) (SEQ. ID NO: 251)

5'-GC CTG GAA AG-3' (FRAG 242) (SEQ. ID NO: 252)

5'-C CTG GAA AGC TGA GAT GGA GGG CGG CAT GGC GGG CAC AGG CTG GGC-3' (FRAG 243) (SEQ. ID NO: 253)

5'-C CTG GAA AGC TGA GAT GGA GGG CGG CAT GGC GGG CAC AGG CTG GG-3' (FRAG 244) (SEQ. ID NO: 254)

5'-C CTG GAA AGC TGA GAT GGA GGG CGG CAT GGC GGG CAC AGG CTG G-3' (FRAG 245) (SEQ. ID NO: 255)

5'-C CTG GAA AGC TGA GAT GGA GGG CGG CAT GGC GGG CAC AGG CTG-3' (FRAG 246) (SEQ. ID NO: 256)

5'-C CTG GAA AGC TGA GAT GGA GGG CGG CAT GGC GGG CAC AGG CT-3' (FRAG 247) (SEQ. ID NO: 257)

5'-C CTG GAA AGC TGA GAT GGA GGG CGG CAT GGC GGG CAC AGG C-3' (FRAG 248) (SEQ. ID NO: 258)

5'-C CTG GAA AGC TGA GAT GGA GGG CGG CAT GGC GGG CAC AGG-3' (FRAG 249) (SEQ. ID NO: 259)

5'-C CTG GAA AGC TGA GAT GGA GGG CGG CAT GGC GGG CAC AG-3' (FRAG 250) (SEQ. ID NO: 260)

5'-C CTG GAA AGC TGA GAT GGA GGG CGG CAT GGC GGG CAC A-3' (FRAG 251) (SEQ. ID NO: 261)

5'-C CTG GAA AGC TGA GAT GGA GGG CGG CAT GGC GGG CAC-3' (FRAG 252) (SEQ. ID NO: 262)

5'-C CTG GAA AGC TGA GAT GGA GGG CGG CAT GGC GGG CA-3' (FRAG 253) (SEQ. ID NO: 263)

5'-C CTG GAA AGC TGA GAT GGA GGG CGG CAT GGC GGG C-3' (FRAG 254) (SEQ. ID NO: 264)

5'-C CTG GAA AGC TGA GAT GGA GGG CGG CAT GGC GGG-3' (FRAG 255) (SEQ. ID NO: 265)

5'-C CTG GAA AGC TGA GAT GGA GGG CGG CAT GGC GG-3' (FRAG 256) (SEQ. ID NO: 266)

5'-C CTG GAA AGC TGA GAT GGA GGG CGG CAT GGC G-3' (FRAG 257) (SEQ. ID NO: 267)

5'-C CTG GAA AGC TGA GAT GGA GGG CGG CAT GGC-3' (FRAG 258) (SEQ. ID NO: 268)

5'-C CTG GAA AGC TGA GAT GGA GGG CGG CAT GG-3' (FRAG 259) (SEQ. ID NO: 269)

5'-C CTG GAA AGC TGA GAT GGA GGG CGG CAT G-3' (FRAG 260) (SEQ. ID NO: 270)

5'-C CTG GAA AGC TGA GAT GGA GGG CGG CAT-3' (FRAG 261) (SEQ. ID NO: 271)

5'-C CTG GAA AGC TGA GAT GGA GGG CGG CA-3' (FRAG 262) (SEQ. ID NO: 272)

5'-C CTG GAA AGC TGA GAT GGA GGG CGG C-3' (FRAG 263) (SEQ. ID NO: 273)

5'-C CTG GAA AGC TGA GAT GGA GGG CGG-3' (FRAG 264) (SEQ. ID NO: 274)

5'-C CTG GAA AGC TGA GAT GGA GGG CG-3' (FRAG 265) (SEQ. ID NO: 275)

5'-C CTG GAA AGC TGA GAT GGA GGG C-3' (FRAG 266) (SEQ. ID NO: 276)

5'-C CTG GAA AGC TGA GAT GGA GGG-3' (FRAG 267) (SEQ. ID NO: 277)

5'-C CTG GAA AGC TGA GAT GGA GG-3' (FRAG 268) (SEQ. ID NO: 278)

5'-C CTG GAA AGC TGA GAT GGA G-3' (FRAG 269) (SEQ. ID NO: 279)

5'-C CTG GAA AGC TGA GAT GGA-3' (FRAG 270) (SEQ. ID NO: 280)

5'-C CTG GAA AGC TGA GAT GG-3' (FRAG 271) (SEQ. ID NO: 281)

5'-C CTG GAA AGC TGA GAT G-3' (FRAG 272) (SEQ. ID NO: 282)

5'-C CTG GAA AGC TGA GAT-3' (FRAG 273) (SEQ. ID NO: 283)

5'-C CTG GAA AGC TGA GA-3' (FRAG 274) (SEQ. ID NO: 284)

5'-C CTG GAA AGC TGA G-3' (FRAG 275) (SEQ. ID NO: 285)

5'-C CTG GAA AGC TGA-3' (FRAG 276) (SEQ. ID NO: 286)

5'-C CTG GAA AGC TG-3' (FRAG 277) (SEQ. ID NO: 287)

5'-C CTG GAA AGC T-3' (FRAG 278) (SEQ. ID NO: 288)

5'-C CTG GAA AGC-3' (FRAG 279) (SEQ. ID NO: 289)

5'-CTG GAA AGC TGA GAT GGA GGG CGG CAT GGC GGG CAC AGG CTG GGC-3' (FRAG 280) (SEQ. ID NO: 290)

5'-CTG GAA AGC TGA GAT GGA GGG CGG CAT GGC GGG CAC AGG CTG GG-3' (FRAG 281) (SEQ. ID NO: 291)

5'-CTG GAA AGC TGA GAT GGA GGG CGG CAT GGC GGG CAC AGG CTG G-3' (FRAG 282) (SEQ. ID NO: 292)

5'-CTG GAA AGC TGA GAT GGA GGG CGG CAT GGC GGG CAC AGG CTG-3' (FRAG 283) (SEQ. ID NO: 293)

5'-CTG GAA AGC TGA GAT GGA GGG CGG CAT GGC GGG CAC AGG CT-3' (FRAG 284) (SEQ. ID NO: 294)

5'-CTG GAA AGC TGA GAT GGA GGG CGG CAT GGC GGG CAC AGG C-3' (FRAG 285) (SEQ. ID NO: 295)

5'-CTG GAA AGC TGA GAT GGA GGG CGG CAT GGC GGG CAC AGG-3' (FRAG 286) (SEQ. ID NO: 296)

5'-CTG GAA AGC TGA GAT GGA GGG CGG CAT GGC GGG CAC AG-3' (FRAG 287) (SEQ. ID NO: 297)

5'-CTG GAA AGC TGA GAT GGA GGG CGG CAT GGC GGG CAC A-3' (FRAG 288) (SEQ. ID NO: 298)

5'-CTG GAA AGC TGA GAT GGA GGG CGG CAT GGC GGG CAC-3' (FRAG 289) (SEQ. ID NO: 299)

5'-CTG GAA AGC TGA GAT GGA GGG CGG CAT GGC GGG CA-3' (FRAG 290) (SEQ. ID NO: 300)

5'-CTG GAA AGC TGA GAT GGA GGG CGG CAT GGC GGG C-3' (FRAG 291) (SEQ. ID NO: 301)

5'-CTG GAA AGC TGA GAT GGA GGG CGG CAT GGC GGG-3' (FRAG 292) (SEQ. ID NO: 302)

5'-CTG GAA AGC TGA GAT GGA GGG CGG CAT GGC GG-3' (FRAG 293) (SEQ. ID NO: 303)

5'-CTG GAA AGC TGA GAT GGA GGG CGG CAT GGC G-3' (FRAG 294) (SEQ. ID NO: 304)

5'-CTG GAA AGC TGA GAT GGA GGG CGG CAT GGC-3' (FRAG 295) (SEQ. ID NO: 305)

5'-CTG GAA AGC TGA GAT GGA GGG CGG CAT GG-3' (FRAG 296) (SEQ. ID NO: 306)

5'-CTG GAA AGC TGA GAT GGA GGG CGG CAT G-3' (FRAG 297) (SEQ. ID NO: 307)

5'-CTG GAA AGC TGA GAT GGA GGG CGG CAT-3' (FRAG 298) (SEQ. ID NO: 308)

5'-CTG GAA AGC TGA GAT GGA GGG CGG CA-3' (FRAG 299) (SEQ. ID NO: 309)

5'-CTG GAA AGC TGA GAT GGA GGG CGG C-3' (FRAG 300) (SEQ. ID NO: 310)

5'-CTG GAA AGC TGA GAT GGA GGG CGG-3' (FRAG 301) (SEQ. ID NO: 311)

5'-CTG GAA AGC TGA GAT GGA GGG CG-3' (FRAG 302) (SEQ. ID NO: 312)

5'-CTG GAA AGC TGA GAT GGA GGG C-3' (FRAG 303) (SEQ. ID NO: 313)

5'-CTG GAA AGC TGA GAT GGA GGG-3' (FRAG 304) (SEQ. ID NO: 314)

5'-CTG GAA AGC TGA GAT GGA GG-3' (FRAG 305) (SEQ. ID NO: 315)

5'-CTG GAA AGC TGA GAT GGA G-3' (FRAG 306) (SEQ. ID NO: 316)

5'-CTG GAA AGC TGA GAT GGA-3' (FRAG 307) (SEQ. ID NO: 317)

5'-CTG GAA AGC TGA GAT GG-3' (FRAG 308) (SEQ. ID NO: 318)

5'-CTG GAA AGC TGA GAT G-3' (FRAG 309) (SEQ. ID NO: 319)

5'-CTG GAA AGC TGA GAT-3' (FRAG 310) (SEQ. ID NO: 320)

5'-CTG GAA AGC TGA GA-3' (FRAG 311) (SEQ. ID NO: 321)

-continued

5'-CTG GAA AGC TGA G-3' (FRAG 312) (SEQ. ID NO: 322)

5'-CTG GAA AGC TGA-3' (FRAG 313) (SEQ. ID NO: 323)

5'-CTG GAA AGC TG-3' (FRAG 314) (SEQ. ID NO: 324)

5'-CTG GAA AGC T-3' (FRAG 315) (SEQ. ID NO: 325)

5'-TG GAA AGC TGA GAT GGA GGG CGG CAT GGC GGG CAC AGG CTG GGC-3' (FRAG 316) (SEQ. ID NO: 326)

5'-TG GAA AGC TGA GAT GGA GGG CGG CAT GGC GGG CAC AGG CTG GG-3' (FRAG 317) (SEQ. ID NO: 327)

5'-TG GAA AGC TGA GAT GGA GGG CGG CAT GGC GGG CAC AGG CTG G-3' (FRAG 318) (SEQ. ID NO: 328)

5'-TG GAA AGC TGA GAT GGA GGG CGG CAT GGC GGG CAC AGG CTG-3' (FRAG 319) (SEQ. ID NO: 329)

5'-TG GAA AGC TGA GAT GGA GGG CGG CAT GGC GGG CAC AGG CT-3' (FRAG 320) (SEQ. ID NO: 330)

5'-TG GAA AGC TGA GAT GGA GGG CGG CAT GGC GGG CAC AGG C-3' (FRAG 321) (SEQ. ID NO: 331)

5'-TG GAA AGC TGA GAT GGA GGG CGG CAT GGC GGG CAC AGG-3' (FRAG 322) (SEQ. ID NO: 332)

5'-TG GAA AGC TGA GAT GGA GGG CGG CAT GGC GGG CAC AG-3' (FRAG 323) (SEQ. ID NO: 333)

5'-TG GAA AGC TGA GAT GGA GGG CGG CAT GGC GGG CAC A-3' (FRAG 324) (SEQ. ID NO: 334)

5'-TG GAA AGC TGA GAT GGA GGG CGG CAT GGC GGG CAC-3' (FRAG 325) (SEQ. ID NO: 335)

5'-TG GAA AGC TGA GAT GGA GGG CGG CAT GGC GGG CA-3' (FRAG 326) (SEQ. ID NO: 336)

5'-TG GAA AGC TGA GAT GGA GGG CGG CAT GGC GGG C-3' (FRAG 327) (SEQ. ID NO: 337)

5'-TG GAA AGC TGA GAT GGA GGG CGG CAT GGC GGG-3' (FRAG 328) (SEQ. ID NO: 338)

5'-TG GAA AGC TGA GAT GGA GGG CGG CAT GGC GG-3' (FRAG 329) (SEQ. ID NO: 339)

5'-TG GAA AGC TGA GAT GGA GGG CGG CAT GGC G-3' (FRAG 330) (SEQ. ID NO: 340)

5'-TG GAA AGC TGA GAT GGA GGG CGG CAT GGC-3' (FRAG 331) (SEQ. ID NO: 341)

5'-TG GAA AGC TGA GAT GGA GGG CGG CAT GG-3' (FRAG 332) (SEQ. ID NO: 342)

5'-TG GAA AGC TGA GAT GGA GGG CGG CAT G-3' (FRAG 333) (SEQ. ID NO: 343)

5'-TG GAA AGC TGA GAT GGA GGG CGG CAT-3' (FRAG 334) (SEQ. ID NO: 344)

5'-TG GAA AGC TGA GAT GGA GGG CGG CA-3' (FRAG 335) (SEQ. ID NO: 345)

5'-TG GAA AGC TGA GAT GGA GGG CGG C-3' (FRAG 336) (SEQ. ID NO: 346)

5'-TG GAA AGC TGA GAT GGA GGG CGG-3' (FRAG 337) (SEQ. ID NO: 347)

5'-TG GAA AGC TGA GAT GGA GGG CG-3' (FRAG 338) (SEQ. ID NO: 348)

5'-TG GAA AGC TGA GAT GGA GGG C-3' (FRAG 339) (SEQ. ID NO: 349)

5'-TG GAA AGC TGA GAT GGA GGG-3' (FRAG 340) (SEQ. ID NO: 350)

5'-TG GAA AGC TGA GAT GGA GG-3' (FRAG 341) (SEQ. ID NO: 351)

5'-TG GAA AGC TGA GAT GGA G-3' (FRAG 342) (SEQ. ID NO: 352)

5'-TG GAA AGC TGA GAT GGA-3' (FRAG 343) (SEQ. ID NO: 353)

5'-TG GAA AGC TGA GAT GG-3' (FRAG 344) (SEQ. ID NO: 354)

5'-TG GAA AGC TGA GAT G-3' (FRAG 345) (SEQ. ID NO: 355)

5'-TG GAA AGC TGA GAT-3' (FRAG 346) (SEQ. ID NO: 356)

5'-TG GAA AGC TGA GA-3' (FRAG 347) (SEQ. ID NO: 357)

5'-TG GAA AGC TGA G-3' (FRAG 348) (SEQ. ID NO: 358)

5'-TG GAA AGC TGA-3' (FRAG 349) (SEQ. ID NO: 359)

5'-TG GAA AGC TG-3' (FRAG 350) (SEQ. ID NO: 360)

5'-G GAA AGC TGA GAT GGA GGG CGG CAT GGC GGG CAC AGG CTG GGC-3' (FRAG 351) (SEQ. ID NO: 361)

```
5'-G GAA AGC TGA GAT GGA GGG CGG CAT GGC GGG CAC AGG CTG GG-3'  (FRAG 352)  (SEQ. ID NO: 362)

5'-G GAA AGC TGA GAT GGA GGG CGG CAT GGC GGG CAC AGG CTG G-3'  (FRAG 353)  (SEQ. ID NO: 363)

5'-G GAA AGC TGA GAT GGA GGG CGG CAT GGC GGG CAC AGG CTG-3'  (FRAG 354)  (SEQ. ID NO: 364)

5'-G GAA AGC TGA GAT GGA GGG CGG CAT GGC GGG CAC AGG CT-3'  (FRAG 355)  (SEQ. ID NO: 365)

5'-G GAA AGC TGA GAT GGA GGG CGG CAT GGC GGG CAC AGG C-3'  (FRAG 356)  (SEQ. ID NO: 366)

5'-G GAA AGC TGA GAT GGA GGG CGG CAT GGC GGG CAC AGG-3'  (FRAG 357)  (SEQ. ID NO: 367)

5'-G GAA AGC TGA GAT GGA GGG CGG CAT GGC GGG CAC AG-3'  (FRAG 358)  (SEQ. ID NO: 368)

5'-G GAA AGC TGA GAT GGA GGG CGG CAT GGC GGG CAC A-3'  (FRAG 359)  (SEQ. ID NO: 369)

5'-G GAA AGC TGA GAT GGA GGG CGG CAT GGC GGG CAC-3'  (FRAG 360)  (SEQ. ID NO: 370)

5'-G GAA AGC TGA GAT GGA GGG CGG CAT GGC GGG CA-3'  (FRAG 361)  (SEQ. ID NO: 371)

5'-G GAA AGC TGA GAT GGA GGG CGG CAT GGC GGG C-3'  (FRAG 362)  (SEQ. ID NO: 372)

5'-G GAA AGC TGA GAT GGA GGG CGG CAT GGC GGG-3'  (FRAG 363)  (SEQ. ID NO: 373)

5'-G GAA AGC TGA GAT GGA GGG CGG CAT GGC GG-3'  (FRAG 364)  (SEQ. ID NO: 374)

5'-G GAA AGC TGA GAT GGA GGG CGG CAT GGC G-3'  (FRAG 365)  (SEQ. ID NO: 375)

5'-G GAA AGC TGA GAT GGA GGG CGG CAT GGC-3'  (FRAG 366)  (SEQ. ID NO: 376)

5'-G GAA AGC TGA GAT GGA GGG CGG CAT GG-3'  (FRAG 367)  (SEQ. ID NO: 377)

5'-G GAA AGC TGA GAT GGA GGG CGG CAT G-3'  (FRAG 368)  (SEQ. ID NO: 378)

5'-G GAA AGC TGA GAT GGA GGG CGG CAT-3'  (FRAG 369)  (SEQ. ID NO: 379)

5'-G GAA AGC TGA GAT GGA GGG CGG CA-3'  (FRAG 370)  (SEQ. ID N0: 380)

5'-G GAA AGC TGA GAT GGA GGG CGG C-3'  (FRAG 371)  (SEQ. ID NO: 381)

5'-G GAA AGC TGA GAT GGA GGG CGG-3'  (FRAG 372)  (SEQ. ID NO: 382)

5'-G GAA AGC TGA GAT GGA GGG CG-3'  (FRAG 373)  (SEQ. ID NO: 383)

5'-G GAA AGC TGA GAT GGA GGG C-3'  (FRAG 374)  (SEQ. ID NO: 384)

5'-G GAA AGC TGA GAT GGA GGG-3'  (FRAG 375)  (SEQ. ID NO: 385)

5'-G GAA AGC TGA GAT GGA GG-3'  (FRAG 376)  (SEQ. ID NO: 386)

5'-G GAA AGC TGA GAT GGA G-3'  (FRAG 377)  (SEQ. ID NO: 387)

5'-G GAA AGC TGA GAT GGA-3'  (FRAG 378)  (SEQ. ID NO: 388)

5'-G GAA AGC TGA GAT GG-3'  (FRAG 379)  (SEQ. ID NO: 389)

5'-G GAA AGC TGA GAT G-3'  (FRAG 380)  (SEQ. ID NO: 390)

5'-G GAA AGC TGA GAT-3'  (FRAG 381)  (SEQ. ID NO: 391)

5'-G GAA AGC TGA GA-3'  (FRAG 382)  (SEQ. ID NO: 392)

5'-G GAA AGC TGA G-3'  (FRAG 383)  (SEQ. ID NO: 393)

5'-G GAA AGC TGA-3'  (FRAG 384)  (SEQ. ID NO: 394)

5'-GAA AGC TGA GAT GGA GGG CGG CAT GGC GGG CAC AGG CTG GGC-3'  (FRAG 385)  (SEQ. ID NO: 395)

5'-GAA AGC TGA GAT GGA GGG CGG CAT GGC GGG CAC AGG CTG GG-3'  (FRAG 386)  (SEQ. ID NO: 396)

5'-GAA AGC TGA GAT GGA GGG CGG CAT GGC GGG CAC AGG CTG G-3'  (FRAG 387)  (SEQ. ID NO: 397)

5'-GAA AGC TGA GAT GGA GGG CGG CAT GGC GGG CAC AGG CTG-3'  (FRAG 388)  (SEQ. ID NO: 398)

5'-GAA AGC TGA GAT GGA GGG CGG CAT GGC GGG CAC AGG CT-3'  (FRAG 389)  (SEQ. ID NO: 399)

5'-GAA AGC TGA GAT GGA GGG CGG CAT GGC GGG CAC AGG C-3'  (FRAG 390)  (SEQ. ID NO: 400)
```

-continued

5'-GAA AGC TGA GAT GGA GGG CGG CAT GGC GGG CAC AGG-3' (FRAG 391) (SEQ. ID NO: 401)

5'-GAA AGC TGA GAT GGA GGG CGG CAT GGC GGG CAC AG-3' (FRAG 392) (SEQ. ID NO: 402)

5'-GAA AGC TGA GAT GGA GGG CGG CAT GGC GGG CAC A-3' (FRAG 393) (SEQ. ID NO: 403)

5'-GAA AGC TGA GAT GGA GGG CGG CAT GGC GGG CAC-3' (FRAG 394) (SEQ. ID NO: 404)

5'-GAA AGC TGA GAT GGA GGG CGG CAT GGC GGG CA-3' (FRAG 395) (SEQ. ID NG: 405)

5'-GAA AGC TGA GAT GGA GGG CGG CAT GGC GGG C-3' (FRAG 396) (SEQ. ID NO: 406)

5'-GAA AGC TGA GAT GGA GGG CGG CAT GGC GGG-3' (FRAG 397) (SEQ. ID NO: 407)

5'-GAA AGC TGA GAT GGA GGG CGG CAT GGC GG-3' (FRAG 398) (SEQ. ID NO: 408)

5'-GAA AGC TGA GAT GGA GGG CGG CAT GGC G-3' (FRAG 399) (SEQ. ID NO: 409)

5'-GAA AGC TGA GAT GGA GGG CGG CAT GGC-3' (FRAG 400) (SEQ. ID NO: 410)

5'-GAA AGC TGA GAT GGA GGG CGG CAT GG-3' (FRAG 401) (SEQ. ID NO: 411)

5'-GAA AGC TGA GAT GGA GGG CGG CAT G-3' (FRAG 402) (SEQ. ID NO: 412)

5'-GAA AGC TGA GAT GGA GGG CGG CAT-3' (FRAG 403) (SEQ. ID NO: 413)

5'-GAA AGC TGA GAT GGA GGG CGG CA-3' (FRAG 404) (SEQ. ID NO: 414)

5'-GAA AGC TGA GAT GGA GGG CGG C-3' (FRAG 405) (SEQ. ID NO: 415)

5'-GAA AGC TGA GAT GGA GGG CGG-3' (FRAG 406) (SEQ. ID NO: 416)

5'-GAA AGC TGA GAT GGA GGG CG-3' (FRAG 407) (SEQ. ID NO: 417)

5'-GAA AGC TGA GAT GGA GGG C-3' (FRAG 408) (SEQ. ID NO: 418)

5'-GAA AGC TGA GAT GGA GGG-3' (FRAG 409) (SEQ. ID NO: 419)

5'-GAA AGC TGA GAT GGA GG-3' (FRAG 410) (SEQ. ID NO: 420)

5'-GAA AGC TGA GAT GGA G-3' (FRAG 411) (SEQ. ID NO: 421)

5'-GAA AGC TGA GAT GGA-3' (FRAG 412) (SEQ. ID NO: 422)

5'-GAA AGC TGA GAT GG-3' (FRAG 413) (SEQ. ID NO: 423)

5'-GAA AGC TGA GAT G-3' (FRAG 414) (SEQ. ID NO: 424)

5'-GAA AGC TGA GAT-3' (FRAG 415) (SEQ. ID NO: 425)

5'-GAA AGC TGA GA-3' (FRAG 416) (SEQ. ID NO: 426)

5'-GAA AGC TGA G-3' (FRAG 417) (SEQ. ID NO: 427)

5'-AA AGC TGA GAT GGA GGG CGG CAT GGC GGG CAC AGG CTG GGC-3' (FRAG 418) (SEQ. ID NO: 428)

5'-AA AGC TGA GAT GGA GGG CGG CAT GGC GGG CAC AGG CTG GG-3' (FRAG 419) (SEQ. ID NO: 429)

5'-AA AGC TGA GAT GGA GGG CGG CAT GGC GGG CAC AGG CTG G-3' (FRAG 420) (SEQ. ID NO: 430)

5'-AA AGC TGA GAT GGA GGG CGG CAT GGC GGG CAC AGG CTG-3' (FRAG 421) (SEQ. ID NO: 431)

5'-AA AGC TGA GAT GGA GGG CGG CAT GGC GGG CAC AGG CT-3' (FRAG 422) (SEQ. ID NO: 432)

5'-AA AGC TGA GAT GGA GGG CGG CAT GGC GGG CAC AGG C-3' (FRAG 423) (SEQ. ID NO: 433)

5'-AA AGC TGA GAT GGA GGG CGG CAT GGC GGG CAC AGG-3' (FRAG 424) (SEQ. ID NO: 434)

5'-AA AGC TGA GAT GGA GGG CGG CAT GGC GGG CAC AG-3' (FRAG 425) (SEQ. ID NO: 435)

5'-AA AGC TGA GAT GGA GGG CGG CAT GGC GGG CAC A-3' (FRAG 426) (SEQ. ID NO: 436)

5'-AA AGC TGA GAT GGA GGG CGG CAT GGC GGG CAC-3' (FRAG 427) (SEQ. ID NO: 437)

5'-AA AGC TGA GAT GGA GGG CGG CAT GGC GGG CA-3' (FRAG 428) (SEQ. ID NO: 438)

5'-AA AGC TGA GAT GGA GGG CGG CAT GGC GGG C-3' (FRAG 429) (SEQ. ID NO: 439)

5'-AA AGC TGA GAT GGA GGG CGG CAT GGC GGG-3' (FRAG 430) (SEQ. ID NO: 440)

```
5'-AA AGC TGA GAT GGA GGG CGG CAT GGC GG-3' (FRAG 431) (SEQ. ID NO: 441)

5'-AA AGC TGA GAT GGA GGG CGG CAT GGC G-3' (FRAG 432) (SEQ. ID NO: 442)

5'-AA AGC TGA GAT GGA GGG CGG CAT GGC-3' (FRAG 433) (SEQ. ID NO: 443)

5'-AA AGC TGA GAT GGA GGG CGG CAT GG-3' (FRAG 434) (SEQ. ID NO: 444)

5'-AA AGC TGA GAT GGA GGG CGG CAT G-3' (FRAG 435) (SEQ. ID NO: 445)

5'-AA AGC TGA GAT GGA GGG CGG CAT-3' (FRAG 436) (SEQ. ID NO: 446)

5'-AA AGC TGA GAT GGA GGG CGG CA-3' (FRAG 437) (SEQ. ID NO: 447)

5'-AA AGC TGA GAT GGA GGG CGG C-3' (FRAG 438) (SEQ. ID NO: 448)

5'-AA AGC TGA GAT GGA GGG CGG-3' (FRAG 439) (SEQ. ID NO: 449)

5'-AA AGC TGA GAT GGA GGG CG-3' (FRAG 440) (SEQ. ID NO; 450)

5'-AA AGC TGA GAT GGA GGG C-3' (FRAG 441) (SEQ. ID NO: 451)

5'-AA AGC TGA GAT GGA GGG-3' (FRAG 442) (SEQ. ID NO: 452)

5'-AA AGC TGA GAT GGA GG-3' (FRAG 443) (SEQ. ID NO: 453)

5'-AA AGC TGA GAT GGA G-3' (FRAG 444) (SEQ. ID NO: 454)

5'-AA AGC TGA GAT GGA-3' (FRAG 445) (SEQ. ID NO: 455)

5'-AA AGC TGA GAT GG-3' (FRAG 446) (SEQ. ID NO: 456)

5'-AA AGC TGA GAT G-3' (FRAG 447) (SEQ. ID NO: 457)

5'-AA AGC TGA GAT-3' (FRAG 448) (SEQ. ID NO: 458)

5'-AA AGC TGA GA-3' (FRAG 449) (SEQ. ID NO: 459)

5'-A AGC TGA GAT GGA GGG CG G CAT GGC GGG CAC AGG CTG GGC-3' (FRAG 450) (SEQ. ID NO: 460)

5'-A AGC TGA GAT GGA GGG CGG CAT GGC GGG CAC AGG CTG GG-3' (FRAG 451) (SEQ. ID NO: 461)

5'-A AGC TGA GAT GGA GGG CGG CAT GGC GGG CAC AGG CTG G-3' (FRAG 452) (SEQ. ID NO: 462)

5'-A AGC TGA GAT GGA GGG CGG CAT GGC GGG CAC AGG CTG-3' (FRAG 453) (SEQ. ID NO: 463)

5'-A AGC TGA GAT GGA GGG CGG CAT GGC GGG CAC AGG CT-3' (FRAG 454) (SEQ. ID NO: 464)

5'-A AGC TGA GAT GGA GGG CGG CAT GGC GGG CAC AGG C-3' (FRAG 455) (SEQ. ID NO: 465)

5'-A AGC TGA GAT GGA GGG CGG CAT GGC GGG CAC AGG-3' (FRAG 456) (SEQ. ID NO: 466)

5'-A AGC TGA GAT GGA GGG CGG CAT GGC GGG CAC AG-3' (FRAO 457) (SEQ. ID NO: 467)

5'-A AGC TGA GAT GGA GGG CGG CAT GGC GGG CAC A-3' (FRAG 458) (SEQ. ID NO: 468)

5'-A AGC TGA GAT GGA GGG CGG CAT GGC GGG CAC-3' (FRAG 459) (SEQ. ID NO: 469)

5'-A AGC TGA GAT GGA GGG GGG CAT GGC GGG CA-3' (FRAG 460) (SEQ. ID NO: 470)

5'-A AGC TGA GAT GGA GGG CGG CAT GGC GGG C-3' (FRAG 461) (SEQ. ID NO: 471)

5'-A AGC TGA GAT GGA GGG CGG CAT GGC GGG-3' (FRAG 462) (SEQ. ID NO: 472)

5'-A AGC TGA GAT GGA GGG CGG CAT GGC GG-3' (FRAG 463) (SEQ. ID NO: 473)

5'-A AGC TGA GAT GGA GGG CGG CAT GGC G-3' (FRAG 464) (SEQ. ID NO: 474)

5'-A AGC TGA GAT GGA GGG CGG CAT GGC-3' (FRAG 465) (SEQ. ID NO: 475)

5'-A AGC TGA GAT GGA GGG CGG CAT GG-3' (FRAG 466) (SEQ. ID NO: 476)

5'-A AGC TGA GAT GGA GGG CGG CAT G-3' (FRAG 467) (SEQ. ID NO: 477)

5'-A AGC TGA GAT GGA GGG CGG CAT-3' (FRAG 468) (SEQ. ID NO: 478)

5'-A AGC TGA GAT GGA GGG CGG CA-3' (FRAG 469) (SEQ. ID NO: 479)
```

-continued

5'-A AGC TGA GAT GGA GGG CGG C-3' (FRAG 470) (SEQ. ID NO: 480)

5'-A AGC TGA GAT GGA GGG CGG-3' (FRAG 471) (SEQ. ID NO: 481)

5'-A AGC TGA GAT GGA GGG CG-3' (FRAG 472) (SEQ. ID NO: 482)

5'-A AGC TGA GAT GGA GGG C-3' (FRAG 473) (SEQ. ID NO: 483)

5'-A AGC TGA GAT GGA GGG-3' (FRAG 474) (SEQ. ID NO: 484)

5'-A AGC TGA GAT GGA GG-3' (FRAG 475) (SEQ. ID NO: 485)

5'-A AGC TGA GAT GGA G-3' (FRAG 476) (SEQ. ID NO: 486)

5'-A AGC TGA GAT GGA-3' (FRAG 477) (SEQ. ID NO: 487)

5'-A AGC TGA GAT GG-3' (FRAG 478) (SEQ. ID NO: 488)

5'-A AGC TGA GAT G-3' (FRAG 479) (SEQ. ID NO: 489)

5'-A AGC TGA GAT-3' (FRAG 480) (SEQ. ID NO: 490)

5'-AGC TGA GAT GGA GGG CGG CAT GGC GGG CAC AGG CTG GGC-3' (FRAG 481) (SEQ. ID NO: 491)

5'-AGC TGA GAT GGA GGG CGG CAT GGC GGG CAC AGG CTG GG-3' (FRAG 482) (SEQ. ID NO: 492)

5'-AGC TGA GAT GGA GGG CGG CAT GGC GGG CAC AGG CTG G-3' (FRAG 483) (SEQ. ID NO: 493)

5'-AGC TGA GAT GGA GGG CGG CAT GGC GGG CAC AGG CTG-3' (FRAG 484) (SEQ. ID NO: 494)

5'-AGC TGA GAT GGA GGG CGG CAT GGC GGG CAC AGG CT-3' (FRAG 485) (SEQ. ID NO: 495)

5'-AGC TGA GAT GGA GGG CGG CAT GGC GGG CAC AGG C-3' (FRAG 486) (SEQ. ID NO: 496)

5'-AGC TGA GAT GGA GGG CGG CAT GGC GGG CAC AGG-3' (FRAG 487) (SEQ. ID NO: 497)

5'-AGC TGA GAT GGA GGG CGG CAT GGC GGG CAC AG-3' (FRAG 488) (SEQ. ID NO: 498)

5'-AGC TGA GAT GGA GGG CGG CAT GGC GGG CAC A-3' (FRAG 489) (SEQ. ID NO: 499)

5'-AGC TGA GAT GGA GGG CGG CAT GGC GGG CAC-3' (FRAG 490) (SEQ. ID NO: 500)

5'-AGC TGA GAT GGA GGG CGG CAT GGC GGG CA-3' (FRAG 491) (SEQ. ID NO: 501)

5'-AGC TGA GAT GGA GGG CGG CAT GGC GGG C-3' (FRAG 492) (SEQ. ID NO: 502)

5'-AGC TGA GAT GGA GGG CGG CAT GGC GGG-3' (FRAG 493) (SEQ. ID NO: 503)

5'-AGC TGA GAT GGA GGG CGG CAT GGC GG-3' (FRAG 494) (SEQ. ID NO: 504)

5'-AGC TGA GAT GGA GGG CGG CAT GGC G-3' (FRAG 495) (SEQ. ID NO: 505)

5'-AGC TGA GAT GGA GGG CGG CAT GGC-3' (FRAG 496) (SEQ. ID NO: 506)

5'-AGC TGA GAT GGA GGG CGG CAT GG-3' (FRAG 497) (SEQ. ID NO: 507)

5'-AGC TGA GAT GGA GGG CGG CAT G-3' (FRAG 498) (SEQ. ID NO: 508)

5'-AGC TGA GAT GGA GGG CGG CAT-3' (FRAG 499) (SEQ. ID NO: 509)

5'-AGC TGA GAT GGA GGG CGG CA-3' (FRAG 500) (SEQ. ID NO: 510)

5'-AGC TGA GAT GGA GGG CGG C-3' (FRAG 501) (SEQ. ID NO: 511)

5'-AGC TGA GAT GGA GGG CGG-3' (FRAG 502) (SEQ. ID NO: 512)

5'-AGC TGA GAT GGA GGG CG-3' (FRAG 503) (SEQ. ID NO: 513)

5'-AGC TGA GAT GGA GGG C-3' (FRAG 504) (SEQ. ID NO: 514)

5'-AGC TGA GAT GGA GGG-3' (FRAG 505) (SEQ. ID NO: 515)

5'-AGC TGA GAT GGA GG-3' (FRAG 506) (SEQ. ID NO: 516)

5'-AGC TGA GAT GGA G-3' (FRAG 507) (SEQ. ID NO: 517)

5'-AGC TGA GAT GGA-3' (FRAG 508) (SEQ. ID NO: 518)

5'-AGC TGA GAT GG-3' (FRAG 509) (SEQ. ID NO: 519)

5'-AGC TGA GAT G-3' (FRAG 510) (SEQ. ID NO: 520)

5'-GC TGA GAT GGA GGG CGG CAT GGC GGG CAC AGG CTG GGC-3' (FRAG 511) (SEQ. ID NO: 521)

5'-GC TGA GAT GGA GGG CGG CAT GGC GGG CAC AGG CTG GG-3' (FRAG 512) (SEQ. ID NO: 522)

5'-GC TGA GAT GGA GGG CGG CAT GGC GGG CAC AGG CTG G-3' (FRAG 513) (SEQ. ID NO: 523)

5'-GC TGA GAT GGA GGG CGG CAT GGC GGG CAC AGG CTG-3' (FRAG 514) (SEQ. ID NO: 524)

5'-GC TGA GAT GGA GGG CGG CAT GGC GGG CAC AGG CT-3' (FRAG 515) (SEQ. ID NO: 525)

5'-GC TGA GAT GGA GGG CGG CAT GGC GGG CAC AGG C-3' (FRAG 516) (SEQ. ID NO: 526)

5'-GC TGA GAT GGA GGG CGG CAT GGC GGG CAC AGG-3' (FRAG 517) (SEQ. ID NO: 527)

5'-GC TGA GAT GGA GGG CGG CAT GGC GGG CAC AG-3' (FRAG 518) (SEQ. ID NO: 528)

5'-GC TGA GAT GGA GGG CGG CAT GGC GGG CAC A-3' (FRAG 519) (SEQ. ID NO: 529)

5'-GC TGA GAT GGA GGG CGG CAT GGC GGG CAC-3' (FRAG 520) (SEQ. ID NO: 530)

5'-GC TGA GAT GGA GGG CGG CAT GGC GGG CA-3' (FRAG 521) (SEQ. ID NO: 531)

5'-GC TGA GAT GGA GGG CGG CAT GGC GGG C-3' (FRAG 522) (SEQ. ID NO: 532)

5'-GC TGA GAT GGA GGG CGG CAT GGC GGG-3' (FRAG 523) (SEQ. ID NO: 533)

5'-GC TGA GAT GGA GGG CGG CAT GGC GG-3' (FRAG 524) (SEQ. ID NO: 534)

5'-GC TGA GAT GGA GGG CGG CAT GGC G-3' (FRAG 525) (SEQ. ID NO: 535)

5'-GC TGA GAT GGA GGG CGG CAT GGC-3' (FRAG 526) (SEQ. ID NO: 536)

5'-GC TGA GAT GGA GGG CGG CAT GG-3' (FRAG 527) (SEQ. ID NO: 537)

5'-GC TGA GAT GGA GGG CGG CAT G-3' (FRAG 528) (SEQ. ID NO: 538)

5'-GC TGA GAT GGA GGG CGG CAT-3' (FRAG 529) (SEQ. ID NO: 539)

5'-GC TGA GAT GGA GGG CGG CA-3' (FRAG 530) (SEQ. ID NO: 540)

5'-GC TGA GAT GGA GGG CGG C-3' (FRAG 531) (SEQ. ID NO: 541)

5'-GC TGA GAT GGA GGG CGG-3' (FRAG 532) (SEQ. ID NO: 542)

5'-GC TGA GAT GGA GGG CG-3' (FRAG 533) (SEQ. ID NO: 543)

5'-GC TGA GAT GGA GGG C-3' (FRAG 534) (SEQ. ID NO: 544)

5'-GC TGA GAT GGA GGG-3' (FRAG 535) (SEQ. ID NO: 545)

5'-GC TGA GAT GGA GG-3' (FRAG 536) (SEQ. ID NO: 546)

5'-GC TGA GAT GGA G-3' (FRAG 537) (SEQ. ID NO: 547)

5'-GC TGA GAT GGA-3' (FRAG 535) (SEQ. ID NO: 548)

5'-GC TGA GAT GG-3' (FRAG 539) (SEQ. ID NO: 549)

5'-C TGA GAT GGA GGG CGG CAT GGC GGG CAC AGG CTG GGC-3' (FRAG 540) (SEQ. ID NO: 550)

5'-C TGA GAT GGA GGG CGG CAT GGC GGG CAC AGG CTG GG-3' (FRAG 541) (SEQ. ID NO: 551)

5'-C TGA GAT GGA GGG CGG CAT GGC GGG CAC AGG CTG G-3' (FRAG 542) (SEQ. ID NO: 552)

5'-C TGA GAT GGA GGG CGG CAT GGC GGG CAC AGG CTG-3' (FRAG 543) (SEQ. ID NO: 553)

5'-C TGA GAT GGA GGG CGG CAT GGC GGG CAC AGG CT-3' (FRAG 544) (SEQ. ID NO: 554)

5'-C TGA GAT GGA GGG CGG CAT GGC GGG CAC AGG C-3' (FRAG 545) (SEQ. ID NO: 555)

5'-C TGA GAT GGA GGG CGG CAT GGC GGG CAC AGG-3' (FRAG 546) (SEQ. ID NO: 556)

5'-C TGA GAT GGA GGG CGG CAT GGC GGG CAC AG-3' (FRAG 547) (SEQ. ID NO: 557)

5'-C TGA GAT GGA GGG CGG CAT GGC GGG CAC A-3' (FRAG 548) (SEQ. ID NO: 558)

-continued

5'-C TGA GAT GGA GGG CGG CAT GGC GGG CAC-3' (FRAG 549) (SEQ. ID NO: 559)

5'-C TGA GAT GGA GGG CGG CAT GGC GGG CA-3' (FRAG 550) (SEQ. ID NO: 560)

5'-C TGA GAT GGA GGG CGG CAT GGC GGG C-3' (FRAG 551) (SEQ. ID NO: 561)

5'-C TGA GAT GGA GGG CGG CAT GGC GGG-3' (FRAG 552) (SEQ. ID NO: 562)

5'-C TGA GAT GGA GGG CGG CAT GGC GG-3' (FRAG 553) (SEQ. ID NO: 563)

5'-C TGA GAT GGA GGG CGG CAT GGC G-3' (FRAG 554) (SEQ. ID NO: 564)

5'-C TGA GAT GGA GGG CGG CAT GGC-3' (FRAG 555) (SEQ. ID NO: 565)

5'-C TGA GAT GGA GGG CGG CAT GG-3' (FRAG 556) (SEQ. ID NO: 566)

5'-C TGA GAT GGA GGG CGG CAT G-3' (FRAG 557) (SEQ. ID NO: 567)

5'-C TGA GAT GGA GGG CGG CAT-3' (FRAG 558) (SEQ. ID NO: 568)

5'-C TGA GAT GGA GGG CGG CA-3' (FRAG 559) (SEQ. ID NO: 569)

5'-C TGA GAT GGA GGG CGG C-3' (FRAG 560) (SEQ. ID NO: 570)

5'-C TGA GAT GGA GGG CGG-3' (FRAG 561) (SEQ. ID NO: 571)

5'-C TGA GAT GGA GGG CG-3' (FRAG 562) (SEQ. ID NO: 572)

5'-C TGA GAT GGA GGG C-3' (FRAG 563) (SEQ. ID NO: 573)

5'-C TGA GAT GGA GGG-3' (FRAG 564) (SEQ. ID NO: 574)

5'-C TGA GAT GGA GG-3' (FRAG 565) (SEQ. ID NO: 575)

5'-C TGA GAT GGA G-3' (FRAG 566) (SEQ. ID NO: 576)

5'-C TGA GAT GGA-3' (FRAG 567) (SEQ. ID NO: 577)

5'-TGA GAT GGA GGG CGG CAT GGC GGG CAC AGG CTG GGC-3' (FRAG 568) (SEQ. ID NO: 578)

5'-TGA GAT GGA GGG CGG CAT GGC GGG CAC AGG CTG GG-3' (FRAG 569) (SEQ. ID NO: 579)

5'-TGA GAT GGA GGG CGG CAT GGC GGG CAC AGG CTG G-3' (FRAG 570) (SEQ. ID NO: 580)

5'-TGA GAT GGA GGG CGG CAT GGC GGG CAC AGG CTG-3' (FRAG 571) (SFQ. ID NO: 581)

5'-TGA GAT GGA GGG CGG CAT GGC GGG CAC AGG CT-3' (FRAG 572) (SEQ. ID NO: 582)

5'-TGA GAT GGA GGG CGG CAT GGC GGG CAC AGG C-3' (FRAG 573) (SEQ. ID NO: 583)

5'-TGA GAT GGA GGG CGG CAT GGC GGG CAC AGG-3' (FRAG 574) (SEQ. ID NQ: 584)

5'-TGA GAT GGA GGG CGG CAT GGC GGG CAC AG-3' (FRAG 575) (SEQ. ID NO: 585)

5'-TGA GAT GGA GGG CGG CAT GGC GGG CAC A-3' (FRAG 576) (SEQ. ID NO: 586)

5'-TGA GAT GGA GGG CGG CAT GGC GGG CAC-3' (FRAG 577) (SEQ. TD NO: 587)

5'-TGA GAT GGA GGG CGG CAT GGC GGG CA-3' (FRAG 578) (SEQ. ID NO: 588)

5'-TGA GAT GGA GGG CGG CAT GGC GGG C-3' (FRAG 579) (SEQ. ID NO: 589)

5'-TGA GAT GGA GGG CGG CAT GGC GGG-3' (FRAG 580) (SEQ. ID NO: 590)

5'-TGA GAT GGA GGG CGG CAT GGC GG-3' (FRAG 581) (SEQ. ID NO: 591)

5'-TGA GAT GGA GGG CGG CAT GGC G-3' (FRAG 582) (SEQ. ID NO: 592)

5'-TGA GAT GGA GGG CGG CAT GGC-3' (FRAG 583) (SEQ. ID NO: 593)

5'-TGA GAT GGA GGG CGG CAT GG-3' (FRAG 584) (SEQ. ID NO: 594)

5'-TGA GAT GGA GGG CGG CAT G-3' (FRAG 585) (SEQ. ID NO: 595)

5'-TGA GAT GGA GGG CGG CAT-3' (FRAG 586) (SEQ. ID NO: 596)

5'-TGA GAT GGA GGG CGG CA-3' (FRAG 587) (SEQ. ID NO: 597)

5'-TGA GAT GGA GGG CGG C-3' (FRAG 588) (SEQ. ID NO: 598)

5'-TGA GAT GGA GGG CGG-3' (FRAG 589) (SEQ. ID NO: 599)

5'-TGA GAT GGA GGG CG-3' (FRAG 590) (SEQ. ID NO: 600)

5'-TGA GAT GGA GGG C-3' (FRAG 591) (SEQ. ID NO: 601)

5'-TGA GAT GGA GGG-3' (FRAG 592) (SEQ. ID NO: 602)

5'-TGA GAT GGA GG-3' (FRAG 593) (SEQ. ID NO: 603)

5'-TGA GAT GGA G-3' (FRAG 594) (SEQ. ID NO: 604)

5'-GA GAT GGA GGG CGG CAT GGC GGG CAC AGG CTG GGC-3' (FRAG 595) (SEQ. ID NO: 605)

5'-GA GAT GGA GGG CGG CAT GGC GGG CAC AGG CTG GG-3' (FRAG 596) (SEQ. ID NO: 606)

5'-GA GAT GGA GGG CGG CAT GGC GGG CAC AGG CTG G-3' (FRAG 597) (SEQ. ID NO: 607)

5'-GA GAT GGA GGG CGG CAT GGC GGG CAC AGG CTG-3' (FRAG 598) (SEQ. ID NO: 608)

5'-GA GAT GGA GGG CGG CAT GGC GGG CAC AGG CT-3' (FRAG 599) (SEQ. ID NO: 609)

5'-GA GAT GGA GGG CGG CAT GGC GGG CAC AGG C-3' (FRAG 600) (SEQ. ID NO: 610)

5'-GA GAT GGA GGG CGG CAT GGC GGG CAC AGG-3' (FRAG 601) (SEQ. ID NO: 611)

5'-GA GAT GGA GGG CGG CAT GGC GGG CAC AG-3' (FRAG 602) (SEQ. ID NO: 612)

5'-GA GAT GGA GGG CGG CAT GGC GGG CAC A-3' (FRAG 603) (SEQ. ID NO: 613)

5'-GA GAT GGA GGG CGG CAT GGC GGG CAC-3' (FRAG 604) (SEQ. ID NO: 614)

5'-GA GAT GGA GGG CGG CAT GGC GGG CA-3' (FRAG 605) (SEQ. ID NO: 615)

5'-GA GAT GGA GGG CGG CAT GGC GGG C-3' (FRAG 606) (SEQ. ID NO: 616)

5'-GA GAT GGA GGG CGG CAT GGC GGG-3' (FRAG 607) (SEQ. ID NO: 617)

5'-GA GAT GGA GGG CGG CAT GGC GG-3' (FRAG 608) (SEQ. ID NO: 618)

5'-GA GAT GGA GGG CGG CAT GGC G-3' (FRAG 609) (SEQ. ID NO: 619)

5'-GA GAT GGA GGG CGG CAT GGC-3' (FRAG 610) (SEQ. ID NO: 620)

5'-GA GAT GGA GGG CGG CAT GG-3' (FRAG 611) (SEQ. ID NO: 621)

5'-GA GAT GGA GGG CGG CAT G-3' (FRAG 612) (SEQ. ID NO: 622)

5'-GA GAT GGA GGG CGG CAT-3' (FRAG 613) (SEQ. ID NO: 623)

5'-GA GAT GGA GGG CGG CA-3' (FRAG 614) (SEQ. ID NO: 624)

5'-GA GAT GGA GGG CGG C-3' (FRAG 615) (SEQ. ID NO: 625)

5'-GA GAT GGA GGG CGG-3' (FRAG 616) (SEQ. ID NO: 626)

5'-GA GAT GGA GGG CG-3' (FRAG 617) (SEQ. ID NO: 627)

5'-GA GAT GGA GGG C-3' (FRAG 618) (SEQ. ID NO: 628)

5'-GA GAT GGA GGG-3' (FRAG 619) (SEQ. ID NO: 629)

5'-GA GAT GGA GG-3' (FRAG 620) (SEQ. ID NO: 630)

5'-A GAT GGA GGG CGG CAT GGC GGG CAC AGG CTG GGC-3' (FRAG 621) (SEQ. ID NO: 631)

5'-A GAT GGA GGG CGG CAT GGC GGG CAC AGG CTG GG-3' (FRAG 622) (SEQ. ID NO: 632)

5'-A GAT GGA GGG CGG CAT GGC GGG CAC AGG CTG G-3' (FRAG 623) (SEQ. ID NO: 633)

5'-A GAT GGA GGG CGG CAT GGC GGG CAC AGG CTG-3' (FRAG 624) (SEQ. ID NO: 634)

5'-A GAT GGA GGG CGG CAT GGC GGG CAC AGG CT-3' (FRAG 625) (SEQ. ID NO: 635)

5'-A GAT GGA GGG CGG CAT GGC GGG CAC AGG C-3' (FRAG 626) (SEQ. ID NO: 636)

5'-A GAT GGA GGG CGG CAT GGC GGG CAC AGG-3' (FRAG 627) (SEQ. ID NO: 637)

-continued

5'-A GAT GGA GGG CGG CAT GGC GGG CAC AG-3' (FRAG 628) (SEQ. ID NO: 638)

5'-A GAT GGA GGG CGG CAT GGC GGG CAC A-3' (FRAG 629) (SEQ. ID NO: 639)

5'-A GAT GGA GGG CGG CAT GGC GGG CAC-3' (FRAG 630) (SEQ. ID NO: 640)

5'-A GAT GGA GGG CGG CAT GGC GGG CA-3' (FRAG 631) (SEQ. ID NO: 641)

5'-A GAT GGA GGG CGG CAT GGC GGG C-3' (FRAG 632) (SEQ. ID NO: 642)

5'-A GAT GGA GGG CGG CAT GGC GGG-3' (FRAG 633) (SEQ. ID NO: 643)

5'-A GAT GGA GGG CGG CAT GGC GG-3' (FRAG 634) (SEQ. ID NO: 644)

5'-A GAT GGA GGG CGG CAT GGC G-3' (FRAG 635) (SEQ. ID NO: 645)

5'-A GAT GGA GGG CGG CAT GGC-3' (FRAG 636) (SEQ. ID NO: 646)

5'-A GAT GGA GGG CGG CAT GG-3' (FRAG 637) (SEQ. ID NO: 647)

5'-A GAT GGA GGG CGG CAT G-3' (FRAG 638) (SEQ. ID NO: 648)

5'-A GAT GGA GGG CGG CAT-3' (FRAG 639) (SEQ. ID NO: 649)

5'-A GAT GGA GGG CGG CA-3' (FRAG 640) (SEQ. ID NO: 650)

5'-A GAT GGA GGG CGG C-3' (FRAG 641) (SEQ. ID NO: 651)

5'-A GAT GGA GGG CGG-3' (FRAG 642) (SEQ. ID NO: 652)

5'-A GAT GGA GGG CG-3' (FRAG 643) (SEQ. ID NO: 653)

5'-A GAT GGA GGG C-3' (FRAG 644) (SEQ. ID NO: 654)

5'-A GAT GGA GGG-3' (FRAG 645) (SEQ. ID NO: 655)

5'-GAT GGA GGG CGG CAT GGC GGG CAC AGG CTG GGC-3' (FRAG 646) (SEQ. ID NO: 656)

5'-GAT GGA GGG CGG CAT GGC GGG CAC AGG CTG GG-3' (FRAG 647) (SEQ. ID NO: 657)

5'-GAT GGA GGG CGG CAT GGC GGG CAC AGG CTG G-3' (FRAG 648) (SEQ. ID NO: 658)

5'-GAT GGA GGG CGG CAT GGC GGG CAC AGG CTG-3' (FRAG 6) (SEQ. ID NO: 659)

5'-GAT GGA GGG CGG CAT GGC GGG CAC AGG CT-3' (FRAG 650) (SEQ. ID NO: 660)

5'-GAT GGA GGG CGG CAT GGC GGG CAC AGG C-3' (FRAG 651) (SEQ. ID NO: 661)

5'-GAT GGA GGG CGG CAT GGC GGG CAC AGG-3' (FRAG 652) (SEQ. ID NO: 662)

5'-GAT GGA GGG CGG CAT GGC GGG CAC AG-3' (FRAG 653) (SEQ. ID NO: 663)

5'-GAT GGA GGG CGG CAT GGC GGG CAC A-3' (FRAG 654) (SEQ. ID NO: 664)

5'-GAT GGA GGG CGG CAT GGC GGG CAC-3' (FRAG 655) (SEQ. ID NO: 665)

5'-GAT GGA GGG CGG CAT GGC GGG CA-3' (FRAG 656) (SEQ. ID NO: 666)

5'-GAT GGA GGG CGG CAT GGC GGG C-3' (FRAG 657) (SEQ. ID NO: 667)

5'-GAT GGA GGG CGG CAT GGC GGG-3' (FRAG 658) (SEQ. ID NO: 668)

5'-GAT GGA GGG CGG CAT GGC GG-3' (FRAG 659) (SEQ. ID NO: 669)

5'-GAT GGA GGG CGG CAT GGC G-3' (FRAG 660) (SEQ. ID NO: 670)

5'-GAT GGA GGG CGG CAT GGC-3' (FRAG 661) (SEQ. ID NO: 671)

5'-GAT GGA GGG CGG CAT GG-3' (FRAG 662) (SEQ. ID NO: 672)

5'-GAT GGA GGG CGG CAT G-3' (FRAG 663) (SEQ. ID NO: 673)

5'-GAT GGA GGG CGG CAT-3' (FRAG 664) (SEQ. ID NO: 674)

5'-GAT GGA GGG CGG CA-3' (FRAG 665) (SEQ. ID NO: 675)

5'-GAT GGA GGG CGG C-3' (FRAG 666) (SEQ. ID NO: 676)

5'-GAT GGA GGG CGG-3' (FRAG 667) (SEQ. ID NO: 677)

-continued

5'-GAT GGA GGG CG-3' (FRAG 668) (SEQ. ID NO: 678)

5'-GAT GGA GGG C-3' (FRAG 669) (SEQ. ID NO: 679)

5'-AT GGA GGG CGG CAT GGC GGG CAC AGG CTG GGC-3' (FRAG 670) (SEQ. ID NO: 680)

5'-AT GGA GGG CGG CAT GGC GGG CAC AGG CTG GG-3' (FRAG 671) (SEQ. ID NO: 681)

5'-AT GGA GGG CGG CAT GGC GGG CAC AGG CTG G-3' (FRAG 672) (SEQ. ID NO: 682)

5'-AT GGA GGG CGG CAT GGC GGG CAC AGG CTG-3' (FRAG 673) (SEQ. ID NO: 683)

5'-AT GGA GGG CGG CAT GGC GGG CAC AGG CT-3' (FRAG 674) (SEQ. ID NO: 684)

5'-AT GGA GGG CGG CAT GGC GGG CAC AGG C-3' (FRAG 675) (SEQ. ID NO: 685)

5'-AT GGA GGG CGG CAT GGC GGG CAC AGG-3' (FRAG 676) (SEQ. ID NO: 686)

5'-AT GGA GGG CGG CAT GGC GGG CAC AG-3' (FRAG 677) (SEQ. ID NO: 687)

5'-AT GGA GGG CGG CAT GGC GGG CAC A-3' (FRAG 678) (SEQ. ID NO: 688)

5'-AT GGA GGG CGG CAT GGC GGG CAC-3' (FRAG 679) (SEQ. ID NO: 689)

5'-AT GGA GGG CGG CAT GGC GGG CA-3' (FRAG 680) (SEQ. ID NO: 690)

5'-AT GGA GGG CGG CAT GGC GGG C-3' (FRAG 681) (SEQ. ID NO: 691)

5'-AT GGA GGG CGG CAT GGC GGG-3' (FRAG 682) (SEQ. ID NO: 692)

5'-AT GGA GGG CGG CAT GGC GG-3' (FRAG 683) (SEQ. ID NO: 693)

5'-AT GGA GGG CGG CAT GGC G-3' (FRAG 684) (SEQ. ID NO: 694)

5'-AT GGA GGG CGG CAT GGC-3' (FRAG 685) (SEQ. ID NO: 695)

5'-AT GGA GGG CGG CAT GG-3' (FRAG 686) (SEQ. ID NO: 696)

5'-AT GGA GGG CGG CAT G-3' (FRAG 687) (SEQ. ID NO: 697)

5'-AT GGA GGG CGG CAT-3' (FRAG 688) (SEQ. ID NO: 698)

5'-AT GGA GGG CGG CA-3' (FRAG 689) (SEQ. ID NO: 699)

5'-AT GGA GGG CGG C-3' (FRAG 690) (SEQ. ID NO: 700)

5'-AT GGA GGG CGG-3' (FRAG 691) (SEQ. ID NO: 701)

5'-AT GGA GGG CG-3' (FRAG 692) (SEQ. ID NO: 702)

5'-T GGA GGG CGG CAT GGC GGG CAC AGG CTG GGC-3' (FRAG 693) (SEQ. ID NO: 703)

5'-T GGA GGG CGG CAT GGC GGG CAC AGG CTG GG-3' (FRAG 694) (SEQ. ID NO: 704)

5'-T GGA GGG CGG CAT GGC GGG CAC AGG CTG G-3' (FRAG 695) (SEQ. ID NO: 705)

5'-T GGA GGG CGG CAT GGC GGG CAC AGG CTG-3' (FRAG 696) (SEQ. ID NO: 706)

5'-T GGA GGG CGG CAT GGC GGG CAC AGG CT-3' (FRAG 697) (SEQ. IP NO: 707)

5'-T GGA GGG CGG CAT GGC GGG CAC AGG C-3' (FRAG 698) (SEQ. ID NO: 708)

5'-T GGA GGG CGG CAT GGC GGG CAC AGG-3' (FRAG 699) (SEQ. ID NO: 709)

5'-T GGA GGG CGG CAT GGC GGG CAC AG-3' (FRAG 700) (SEQ. ID NO: 710)

5'-T GGA GGG CGG CAT GGC GGG CAC A-3' (FRAG 701) (SEQ. ID NO: 711)

5'-T GGA GGG CGG CAT GGC GGG CAC-3' (FRAG 702) (SEQ. ID NO: 712)

5'-T GGA GGG CGG CAT GGC GGG CA-3' (FRAG 703) (SEQ. ID NO: 713)

5'-T GGA GGG CGG CAT GGC GGG C-3' (FRAG 704) (SEQ. ID NO: 714)

5'-T GGA GGG CGG CAT GGC GGG-3' (FRAG 705) (SEQ. ID NO: 715)

5'-T GGA GGG CGG CAT GGC GG-3' (FRAG 706) (SEQ. ID NO: 716)

-continued

5'-T GGA GGG CGG CAT GGC G-3' (FRAG 707) (SEQ. ID NO: 717)

5'-T GGA GGG CGG CAT GGC-3' (FRAG 708) (SEQ. ID NO: 718)

5'-T GGA GGG CGG CAT GG-3' (FRAG 709) (SEQ. ID NO: 719)

5'-T GGA GGG CGG CAT G-3' (FRAG 710) (SEQ. ID NO: 720)

5'-T GGA GGG CGG CAT-3' (FRAG 711) (SEQ. ID NO: 721)

5'-T GGA GGG CGG CA-3' (FRAG 712) (SEQ. ID NO: 722)

5'-T GGA GGG CGG C-3' (FRAG 713) (SEQ. ID NO: 713)

5'-T GGA GGG CGG-3' (FRAG 714) (SEQ. ID NO: 724)

5'-GGA GGG CGG CAT GGC GGG CAC AGG CTG GGC-3' (FRAG 715) (SEQ. ID NO: 725)

5'-GGA GGG CGG CAT GGC GGG CAC AGG CTG GG-3' (FRAG 716) (SEQ. ID NO: 726)

5'-GGA GGG CGG CAT GGC GGG CAC AGG CTG G-3' (FRAG 717) (SEQ. ID NO: 727)

5'-GGA GGG CGG CAT GGC GGG CAC AGG CTG-3' (FRAG 718) (SEQ. ID NO: 728)

5'-GGA GGG CGG CAT GGC GGG CAC AGG CT-3' (FRAG 719) (SEQ. ID NO: 729)

5'-GGA GGG CGG CAT GGC GGG CAC AGG C-3' (FRAG 720) (SEQ. ID NO: 730)

5'-GGA GGG CGG CAT GGC GGG CAC AGG-3' (FRAG 721) (SEQ. ID NO: 731)

5'-GGA GGG CGG CAT GGC GGG CAC AG-3' (FRAG 722) (SEQ. ID NQ: 732)

5'-GGA GGG CGG CAT GGC GGG CAC A-3' (FRAG 723) (SEQ. ID NO: 733)

5'-GGA GGG CGG CAT GGC GGG CAC-3' (FRAG 724) (SEQ. ID NO: 734)

5'-GGA GGG CGG CAT GGC GGG CA-3' (FRAG 725) (SEQ. ID NO: 735)

5'-GGA GGG CGG CAT GGC GGG C-3' (FRAG 726) (SEQ. ID NO: 736)

5'-GGA GGG CGG CAT GGC GGG-3' (FRAG 727) (SEQ. ID NO: 737)

5'-GGA GGG CGG CAT GGC GG-3' (FRAG 728) (SEQ. ID NO: 738)

5'- GGA GGG CGG CAT GGC G-3' (FRAG 729) (SEQ. ID NO: 739)

5'-GGA GGG CGG CAT GGC-3' (FRAG 730) (SEQ. ID NO: 740)

5'-GGA GGG CGG CAT GG-3' (FRAG 731) (SEQ. ID NO: 741)

5'-GGA GGG CGG CAT G-3' (FRAG 732) (SEQ. ID NO: 742)

5'-GGA GGG CGG CAT-3' (FRAG 733) (SEQ. ID NO: 743)

5'-GGA GGG CGG CA-3' (FRAG 734) (SEQ. ID NO: 744)

5'-GGA GGG CGG C-3' (FRAG 735) (SEQ. ID NO: 745)

5'-GA GGG CGG CAT GGC GGG CAC AGG CTG GGC-3' (FRAG 736) (SEQ. ID NO: 746)

5'-GA GGG CGG CAT GGC GGG CAC AGG CTG GG-3' (FRAG 737) (SEQ. ID NO: 747)

5'-GA GGG CGG CAT GGC GGG CAC AGG CTG G-3' (FRAG 738) (SEQ. ID NO: 748)

5'-GA GGG CGG CAT GGC GGG CAC AGG CTG-3' (FRAG 739) (SEQ. ID NO: 749)

5'-GA GGG CGG CAT GGC GGG CAC AGG CT-3' (FRAG 740) (SEQ. ID NO: 750)

5'-GA GGG CGG CAT GGC GGG CAC AGG C-3' (FRAG 741) (SEQ. ID NO: 751)

5'-GA GGG CGG CAT GGC GGG CAC AGG-3' (FRAG 742) (SEQ. ID NO: 752)

5'-GA GGG CGG CAT GGC GGG CAC AG-3' (FRAG 743) (SEQ. ID NO: 753)

5'-GA GGG CGG CAT GGC GGG CAC A-3' (FRAG 744) (SEQ. ID NO: 754)

5'-GA GGG CGG CAT GGC GGG CAC-3' (FRAG 745) (SEQ. ID NO: 755)

5'-GA GGG CGG CAT GGC GGG CA-3' (FRAG 746) (SEQ. ID NO: 756)

```
5'-GA GGG CGG CAT GGC GGG C-3' (FRAG 747) (SEQ. ID NO: 757)

5'-GA GGG CGG CAT GGC GGG-3' (FRAG 748) (SEQ. ID NO: 758)

5'-GA GGG CGG CAT GGC GG-3' (FRAG 749) (SEQ. ID NO: 759)

5'-GA GGG CGG CAT GGC G-3' (FRAG 750) (SEQ. ID NO: 760)

5'-GA GGG CGG CAT GGC-3' (FRAG 751) (SEQ. ID NO: 761)

5'-GA GGG CGG CAT GG-3' (FRAG 752) (SEQ. ID NO: 762)

5'-GA GGG CGG CAT G-3' (FRAG 753) (SEQ. ID NO: 763)

5'-GA GGG CGG CAT-3' (FRAG 754) (SEQ. ID NO: 764)

5'-GA GGG CGG CA-3' (FRAG 755) (SEQ. ID NO: 765)

5'-A GGG CGG CAT GGC GGG CAC AGG CTG GGC-3' (FRAG 756) (SEQ. ID NO: 766)

5'-A GGG CGG CAT GGC GGG CAC AGG CTG GG-3' (FRAG 757) (SEQ. ID NO: 767)

5'-A GGG CGG CAT GGC GGG CAC AGG CTG G-3' (FRAG 758) (SEQ. ID NO: 768)

5'-A GGG CGG CAT GGC GGG CAC AGG CTG-3' (FRAG 759) (SEQ. ID NO: 769)

5'-A GGG CGG CAT GGC GGG CAC AGG CT-3' (FRAG 760) (SEQ. ID NO: 770)

5'-A GGG CGG CAT GGC GGG CAC AGG C-3' (FRAG 761) (SEQ. ID NO: 771)

5'-A GGG CGG CAT GGC GGG CAC AGG-3' (FRAG 762) (SEQ. ID NO: 772)

5'-A GGG CGG CAT GGC GGG CAC AG-3' (FRAG 763) (SEQ. ID NO: 773)

5'-A GGG CGG CAT GGC GGG CAC A-3' (FRAG 764) (SEQ. ID NO: 774)

5'-A GGG CGG CAT GGC GGG CAC-3' (FRAG 765) (SEQ. ID NO: 775)

5'-A GGG CGG CAT GGC GGG CA-3' (FRAG 766) (SEQ. ID NO: 776)

5'-A GGG CGG CAT GGC GGG C-3' (FRAG 767) (SEQ. ID NO: 777)

5'-A GGG CGG CAT GGC GGG-3' (FRAG 768) (SEQ. ID NO: 778)

5'-A GGG CGG CAT GGC GG-3' (FRAG 769) (SEQ. ID NO: 779)

5'-A GGG CGG CAT GGC G-3' (FRAG 770) (SEQ. ID NO: 780)

5'-A GGG CGG CAT GGC-3' (FRAG 771) (SEQ. ID NO: 781)

5'-A GGG CGG CAT GG-3' (FRAG 772) (SEQ. ID NO: 782)

5'-A GGG CGG CAT G-3' (FRAG 773) (SEQ. ID NO: 783)

5'-A GGG CGG CAT-3' (FRAG 774) (SEQ. ID NO: 784)

5'-GGG CGG CAT GGC GGG CAC AGG CTG GGC-3' (FRAG 775) (SEQ. ID NO: 785)

5'-GGG CGG CAT GGC GGG CAC AGG CTG GG-3' (FRAG 776) (SEQ. ID NO: 786)

5'-GGG CGG CAT GGC GGG CAC AGG CTG G-3' (FRAG 777) (SEQ. ID NO: 787)

5'-GGG CGG CAT GGC GGG CAC AGG CTG-3' (FRAG 778) (SEQ. ID NO: 788)

5'-GGG CGG CAT GGC GGG CAC AGG CT-3' (FRAG 779) (SEQ. ID NO: 789)

5'-GGG CGG CAT GGC GGG CAC AGG C-3' (FRAG 780) (SEQ. ID NO: 790)

5'-GGG CGG CAT GGC GGG CAC AGG-3' (FRAG 781) (SEQ. ID NO: 791)

5'-GGG CGG CAT GGC GGG CAC AG-3' (FRAG 782) (SEQ. ID NO: 792)

5'-GGG CGG CAT GGC GGG CAC A-3' (FRAG 783) (SEQ. ID NO: 793)

5'-GGG CGG CAT GGC GGG CAC-3' (FRAG 784) (SEQ. ID NO: 794)

5'-GGG CGG CAT GGC GGG CA-3' (FRAG 785) (SEQ. ID NO: 795)
```

-continued

5'-GGG CGG CAT GGC GGG C-3' (FRAG 786) (SEQ. ID NO: 796)

5'-GGG CGG CAT GGC GGG-3' (FRAG 787) (SEQ. ID NO: 797)

5'-GGG CGG CAT GGC GG-3' (FRAG 788) (SEQ. ID NO: 798)

5'-GGG CGG CAT GGC G-3' (FRAG 789) (SEQ. ID NO: 799)

5'-GGG CGG CAT GGC-3' (FRAG 790) (SEQ. ID NO: 800)

5'-GGG CGG CAT GG-3' (FRAG 791) (SEQ. ID NO: 801)

5'-GGG CGG CAT G-3' (FRAG 792) (SEQ. ID NO: 802)

5'-GG CGG CAT GGC GGG CAC AG G CTG GGC-3' (FRAG 793) (SEQ. ID NO: 803)

5'-GG CGG CAT GGC GGG CAC AGG CTG GG-3' (FRAG 794) (SEQ. ID NO: 804)

5'-GG CGG CAT GGC GGG CAC AGG CTG G-3' (FRAG 795) (SEQ. ID NO: 805)

5'-GG CGG CAT GGC GGG CAC AGG CTG-3' (FRAG 796) (SEQ. ID NO: 806)

5'-GG CGG CAT GGC GGG CAC AGG CT-3' (FRAG 797) (SEQ. ID NO: 807)

5'-GG CGG CAT GGC GGG CAC AGG C-3' (FRAG 798) (SEQ. ID NO: 808)

5'-GG CGG CAT GGC GGG CAC AGG-3' (FRAG 799) (SEQ. ID NO: 809)

5'-GG CGG CAT GGC GGG CAC AG-3' (FRAG 800) (SEQ. ID NO: 810)

5'-GG CGG CAT GGC GGG CAC A-3' (FRAG 801) (SEQ. ID NO: 811)

5'-GG CGG CAT GGC GGG CAC-3' (FRAG 802) (SEQ. ID NO: 812)

5'-GG CGG CAT GGC GGG CA-3' (FRAG 803) (SEQ. ID NO: 813)

5'-GG CGG CAT GGC GGG C-3' (FRAG 804) (SEQ. ID NO: 814)

5'-GG CGG CAT GGC GGG-3' (FRAG 805) (SEQ. ID NO: 815)

5'-GG CGG CAT GGC GG-3' (FRAG 806) (SEQ. ID NO: 816)

5'-GG CGG CAT GGC G-3' (FRAG 807) (SEQ. ID NO: 817)

5'-GG CGG CAT GGC-3' (FRAG 808) (SEQ. ID NO: 818)

5'-GG CGG CAT GG-3' (FRAG 809) (SEQ. ID NO: 819)

5'-G CGG CAT GGC GGG CAC AGG CTG GGC-3' (FRAG 810) (SEQ. ID NO: 820)

5'-G CGG CAT GGC GGG CAC AGG CTG GG-3' (FRAG 811) (SEQ. ID NO: 821)

5'-G CGG CAT GGC GGG CAC AGG CTG G-3' (FRAG 812) (SEQ. ID NO: 822)

5'-G CGG CAT GGC GGG CAC AGG CTG-3' (FRAG 813) (SEQ. ID NO: 823)

5'-G CGG CAT GGC GGG CAC AGG CT-3' (FRAG 814) (SEQ. ID NO: 824)

5'-G CGG CAT GGC GGG CAC AGG C-3' (FRAG 815) (SEQ. ID NO: 825)

5'-G CGG CAT GGC GGG CAC AGG-3' (FRAG 816) (SEQ. ID NO: 826)

5'-G CGG CAT GGC GGG CAC AG-3' (FRAG 817) (SEQ. ID NO: 827)

5'-G CGG CAT GGC GGG CAC A-3' (FRAG 818) (SEQ. ID NO: 828)

5'-G CGG CAT GGC GGG CAC-3' (FRAG 819) (SEQ. ID NO: 829)

5'-G CGG CAT GGC GGG CA-3' (FRAG 820) (SEQ. ID NO: 830)

5'-G CGG CAT GGC GGG C-3' (FRAG 821) (SEQ. ID NO: 831)

5'-G CGG CAT GGC GGG-3' (FRAG 822) (SEQ. ID NO: 832)

5'-G CGG CAT GGC GG-3' (FRAG 823) (SEQ. ID NO: 833)

5'-G CGG CAT GGC G-3' (FRAG 824) (SEQ. ID NO: 834)

5'-G CGG CAT GGC-3' (FRAG 825) (SEQ. ID NO: 835)

-continued

5'-CGG CAT GGC GGG CAC AGG CTG GGC-3' (FRAG 826) (SEQ. ID NO: 836)

5'-CGG CAT GGC GGG CAC AGG CTG GG-3' (FRAG 827) (SEQ. ID NO: 837)

5'-CGG CAT GGC GGG CAC AGG CTG G-3' (FRAG 828) (SEQ. ID NO: 838)

5'-CGG CAT GGC GGG CAC AGG CTG-3' (FRAG 829) (SEQ. ID NO: 839)

5'-CGG CAT GGC GGG CAC AGG CT-3' (FRAG 830) (SEQ. ID NO: 840)

5'-CGG CAT GGC GGG CAC AGG C-3' (FRAG 831) (SEQ. ID NO: 841)

5'-CGG CAT GGC GGG CAC AGG-3' (FRAG 832) (SEQ. ID NO: 842)

5'-CGG CAT GGC GGG CAC AG-3' (FRAG 833) (SEQ. ID NO: 843)

5'-CGG CAT GGC GGG CAC A-3' (FRAG 834) (SEQ. ID NO: 844)

5'-CGG CAT GGC GGG CAC-3' (FRAG 835) (SEQ. ID NO: 845)

5'-CGG CAT GGC GGG CA-3' (FRAG 836) (SEQ. ID NO: 846)

5'-CGG CAT GGC GGG C-3' (FRAG 837) (SEQ. ID NO: 847)

5'-CGG CAT GGC GGG-3' (FRAG 838) (SEQ. ID NO: 848)

5'-CGG CAT GGC GG-3' (FRAG 839) (SEQ. ID NO: 849)

5'-CGG CAT GGC G-3' (FRAG 840) (SEQ. ID NO: 850)

5'-GG CAT GGC GGG CAC AGG C TG GGC-3' (FRAG 841) (SEQ. ID NO: 851)

5'-GG CAT GGC GGG CAC AGG CTG GG-3' (FRAG 842) (SEQ. ID NO: 852)

5'-GG CAT GGC GGG CAC AGG CTG G-3' (FRAG 843) (SEQ. ID NO: 853)

5'-GG CAT GGC GGG CAC AGG CTG-3' (FRAG 844) (SEQ. ID NO: 854)

5'-GG CAT GGC GGG CAC AGG CT-3' (FRAG 845) (SEQ. ID NO: 855)

5'-GG CAT GGC GGG CAC AGG C-3' (FRAG 846) (SEQ. ID NO: 856)

5'-GG CAT GGC GGG CAC AGG-3' (FRAG 847) (SEQ. ID NO: 857)

5'-GG CAT GGC GGG CAC AG-3' (FRAG 848) (SEQ. ID NO: 858)

5'-GG CAT GGC GGG CAC A-3' (FRAG 849) (SEQ. ID NO: 859)

5'-GG CAT GGC GGG CAC-3' (FRAG 850) (SEQ. ID NO: 860)

5'-GG CAT GGC GGG CA-3' (FRAG 851) (SEQ. ID NO: 861)

5'-GG CAT GGC GGG C-3' (FRAG 852) (SEQ. ID NO: 862)

5'-GG CAT GGC GGG-3' (FRAG 853) (SEQ. ID NO: 863)

5'-GG CAT GGC GG-3' (FRAG 854) (SEQ. ID NO: 864)

5'-G CAT GGC GGG CAC AGG CTG GGC-3' (FRAG 855) (SEQ. ID NO: 865)

5'-G CAT GGC GGG CAC AGG CTG GG-3' (FRAG 856) (SEQ. ID NO: 866)

5'-G CAT GGC GGG CAC AGG CTG G-3' (FRAG 857) (SEQ. ID NO: 867)

5'-G CAT GGC GGG CAC AGG CTG-3' (FRAG 858) (SEQ. ID NO: 868)

5'-G CAT GGC GGG CAC AGG CT-3' (FRAG 859) (SEQ. ID NO: 869)

5'-G CAT GGC GGG CAC AGG C-3' (FRAG 860) (SEQ. ID NO: 870)

5'-G CAT GGC GGG CAC AGG-3' (FRAG 861) (SEQ. ID NO: 871)

5'-G CAT GGC GGG CAC AG-3' (FRAG 862) (SEQ. ID NO: 872)

5'-G CAT GGC GGG CAC A-3' (FRAG 863) (SEQ. ID NO: 873)

5'-G CAT GGC GGG CAC-3' (FRAG 864) (SEQ. ID NO: 874)

```
-continued

5'-G CAT GGC GGG CA-3' (FRAG 865) (SEQ. ID NO: 875)

5'-G CAT GGC GGG C 3' (FRAG 866) (SEQ. ID NO: 876)

5'-G CAT GGC GGG-3' (FRAG 867) (SEQ. ID NO: 877)

5'-CAT GGC GGG CAC AGG CTG GGC-3' (FRAG 868) (SEQ. ID NO: 878)

5'-CAT GGC GGG CAC AGG CTG GG-3' (FRAG 869) (SEQ. ID NO: 879)

5'-CAT GGC GGG CAC AGG CTG G-3' (FRAG 870) (SEQ. ID NO: 880)

5'-CAT GGC GGG CAC AGG CTG-3' (FRAG 871) (SEQ. ID NO: 881)

5'-CAT GGC GGG CAC AGG CT-3' (FRAG 872) (SEQ. ID NO: 882)

5'-CAT GGC GGG CAC AGG C-3' (FRAG 873) (SEQ. ID NO: 883)

5'-CAT GGC GGG CAC AGG-3' (FRAG 874) (SEQ. ID NO: 884)

5'-CAT GGC GGG CAC AG-3' (FRAG 875) (SEQ. ID NO: 885)

5'-CAT GGC GGG CAC A-3' (FRAG 876) (SEQ. ID NO: 886)

5'-CAT GGC GGG CAC-3' (FRAG 877) (SEQ. ID NO: 887)

5'-CAT GGC GGG CA-3' (FRAG 878) (SEQ. ID NO: 888)

5'-CAT GGC GGG C-3' (FRAG 879) (SEQ. ID NO: 889)

5'-AT GGC GGG CAC AGG CTG GGC-3' (FRAG 880) (SEQ. ID NO: 890)

5'-AT GGC GGG CAC AGG CTG GG-3' (FRAG 881) (SEQ. ID NO: 891)

5'-AT GGC GGG CAC AGG CTG G-3' (FRAG 882) (SEQ. ID NO: 892)

5'-AT GGC GGG CAC AGG CTG-3' (FRAG 883) (SEQ. ID NO: 893)

5'-AT GGC GGG CAC AGG CT-3' (FRAG 884) (SEQ. ID NO: 894)

5'-AT GGC GGG CAC AGG C-3' (FRAG 885) (SEQ. ID NO: 895)

5'-AT GGC GGG CAC AGG-3' (FRAG 886) (SEQ. ID NO: 896)

5'-AT GGC GGG CAC AG-3' (FRAG 887) (SEQ. ID NO: 897)

5'-AT GGC GGG CAC A-3' (FRAG 888) (SEQ. ID NO: 898)

5'-AT GGC GGG CAC-3' (FRAG 889) (SEQ. ID NO: 899)

5'-AT GGC GGG CA-3' (FRAG 890) (SEQ. ID NO: 900)

5'-T GGC GGG CAC AGG CTG GGC-3' (FRAG 891) (SEQ. ID NO: 901)

5'-T GGC GGG CAC AGG CTG GG-3' (FRAG 892) (SEQ. ID NO: 902)

5'-T GGC GGG CAC AGG CTG G-3' (FRAG 893) (SEQ. ID NO: 903)

5'-T GGC GGG CAC AGG CTG-3' (FRAG 894) (SEQ. ID NO: 904)

5'-T GGC GGG CAC AGG CT-3' (FRAG 895) (SEQ. ID NO: 905)

5'-T GGC GGG CAC AGG C-3' (FRAG 896) (SEQ. ID NO: 906)

5'-T GGC GGG CAC AGG-3' (FRAG 897) (SEQ. ID NO: 907)

5'-T GGC GGG CAC AG-3' (FRAG 898) (SEQ. ID NO: 908)

5'-T GGC GGG CAC A-3' (FRAG 899) (SEQ. ID NO: 909)

5'-T GGC GGG CAC-3' (FRAG 900) (SEQ. ID NO: 910)

5'-GGC GGG CAC AGG CTG GGC-3' (FRAG 901) (SEQ. ID NO: 911)

5'-GGC GGG CAC AGG CTG GG-3' (FRAG 902) (SEQ. ID NO: 912)

5'-GGC GGG CAC AGG CTG G-3' (FRAG 903) (SEQ. ID NO: 913)

5'-GGC GGG CAC AGG CTG-3' (FRAG 904) (SEQ. ID NO: 914)
```

-continued

5'-GGC GGG CAC AGG CT-3' (FRAG 905) (SEQ. ID NO: 915)

5'-GGC GGG CAC AGG C-3' (FRAG 906) (SEQ- ID NO: 916)

5'-GGC GGG CAC AGG-3' (FRAG 907) (SEQ. ID NO: 917)

5'-GGC GGG CAC AG-3' (FRAG 908) (SEQ. ID NO: 918)

5'-GGC GGG CAC A-3' (FRAG 909) (SEQ. ID NO: 919)

5'-GC GGG CAC AGG CTG GGC-3' (FRAG 910) (SEQ. ID NO: 920)

5'-GC GGG CAC AGG CTG GG-3' (FRAG 911) (SEQ. ID NO: 921)

5'-GC GGG CAC AGG CTG G-3' (FRAG 912) (SEQ. ID NO: 922)

5'-GC GGG CAC AGG CTG-3' (FRAG 913) (SEQ. ID NO: 923)

5'-GC GGG CAC AGG CT-3' (FRAG 914) (SEQ. ID NO: 924)

5'-GC GGG CAC AGG C-3' (FRAG 915) (SEQ. ID NO: 925)

5'-GC GGG CAC AGG-3' (FRAG 916) (SEQ. ID NO: 926)

5'-GC GGG CAC AG-3' (FRAG 917) (SEQ. ID NO: 927)

5'-C GGG CAC AGG CTG GGC-3' (FRAG 918) (SEQ. ID NO: 928)

5'-GGG CAC AGG CTG GG-3' (FRAG 919) (SEQ. ID NO: 929)

5'-C GGG CAC AGG CTG G-3' (FRAG 920) (SEQ. ID NO: 930)

5'-C GGG CAC AGG CTG-3' (FRAC 921) (SEQ. ID NO: 931)

5'-C GGG CAC AGG CT-3' (FRAG 922) (SEQ. ID NO: 932)

5'-C GGG CAC AGG C-3' (FRAG 923) (SEQ. ID NO: 933)

5'-C GGG CAC AGG-3' (FRAG 924) (SEQ. ID NO: 934)

5'-GGG CAC AGG CTG GGC-3' (FRAG 925) (SEQ. ID NO: 935)

5'-GGG CAC AGG CTG GG-3' (FRAC 926) (SEQ. ID NO: 936)

5'-GGG CAC AGG CTG G-3' (FRAG 927) (SEQ. ID NO: 937)

5'-GGG CAC AGG CTG-3' (FRAG 928) (SEQ. ID NO: 938)

5'-GGG CAC AGG CT-3' (FRAG 929) (SEQ. ID NO: 939)

5'-GGG CAC AGG C-3' (FRAG 930) (SEQ. ID NO: 940)

5'-GG CAC AGG CTG GGC-3' (FRAG 931) (SEQ. ID NO: 941)

5'-GG CAC AGG CTG GG-3' (FRAG 932) (SEQ. ID NO: 942)

5'-GG CAC AGG CTG G-3' (FRAG 933) (SEQ. ID NO: 943)

5'-GG CAC AGG CTG-3' (FRAG 934) (SEQ. ID NO: 944)

5'-GG CAC AGG CT-3' (FRAG 935) (SEQ. ID NO: 945)

5'-G CAC AGG CTG GCC-3' (FRAG 936) (SEQ. ID NO: 946)

5'-G CAC AGG CTG GC-3' (FRAG 937) (SEQ. ID NO: 947)

5'-G CAC AGG CTG G-3' (FRAG 938) (SEQ. ID NO: 948)

5'-G CAC AGG CTG-3' (FRAG 939) (SEQ. ID NO: 949)

5'-CAC AGG CTG GGC 3' (FRAG 940) (SEQ. ID NO: 950)

5'-CAC AGG CTG GG-3' (FRAG 941) (SEQ. ID NO: 951)

5'-CAC AGG CTG G-3' (FRAG 942) (SEQ. ID NO: 952)

5'-AC AGG CTG GGC-3' (FRAG 943) (SEQ. ID NO: 953)

5'-AC AGG CTG GG-3' (FRAG 944) (SEQ. ID NO: 954)

5'-C AGG CTG GGC-3' (FRAG 945) (SEQ. ID NO: 955)

5'-TTT TCC TTC CTT TGT CTC TCT TC (FRAG 946) (SEQ. ID NO: 956)

5'-GCT CCC GGC TGC CTG (FRAG 947) (SEQ. ID NO: 957)

5'-CTC GGC CGT GCG GCT CTG TCG CTC CCG GT (FRAG 948) (SEQ. ID NO: 958)

5'-CCG CCG CCC TCC GGG GGG TC (FRAG 949) (SEQ. ID NO: 959)

5'-TGC TGC CGT TGG CTG CCC (FRAG 950) (SEQ. ID NO: 960)

5'-CTT CTG CGG GTC GCC GG (FRAG 951) (SEQ. ID NO: 961)

5'-TGC TGG GCT TGT GGC (FRAG 952) (SEQ. ID NO: 962)

5'-GGC CTC TCT TCT GGG (FRAG 953) (SEQ. ID NO: 963)

5'-CCT GGT CCC TCC GT (FRAG 954) (SEQ. ID NO: 964)

5'-GGT GGC TCC TCT GC (FRAG 955) (SEQ. ID NO: 965)

5'-GCT TGG TCC TGG GGC TGC (FRAG 956) (SEQ. ID NO: 966)

5'-TGC TCT CCT CTC CTT (FRAG 957) (SEQ. ID NO: 967)

Human Adenosine A2a Receptor Nucleic Acid and Antisense Oligonucleotide Fragments 5'-TGC TTT TCT TTT CTG GGC CTC TGT GGT CTG TTT TTT TCT G GCC CTG CTG GGG CGC TCT CC GCC GCC CGC CTG GCT CCC GGB GCC CBT GBT GGG CBT GCC GTG GTT CTT GCC CTC CTT TGG CTG CCG TGC CCG CTC CCC GGC CTC CTG GCG GGT GGC CGT TG GGC CCG TGT TCC CCT GGG GCC TGG GGC TCC CTT CTC TC GCC CTT CTT GCT GGG CCT C TGC TGC TGC TGG TGC TGT GGC CCC C GTA CAC CGA GGA GCC CAT GAT GGG CAT GCC ACA GAC GAC AGG C GTB CBC CGB GGB GCC CBT GBT GGG CBT GCC BCB GBC GBC GBB C-3' (FRAG. NO. 1665) (SEQ. ID NO: 1680)

5'-CTG GGC CTC-3' (FRAG 1666) (SEQ. ID NO: 1681)

5'-TGC TTT TCT TTT CTG GGC CTC-3' (FRAG 958) (SEQ. ID NO: 968)

5'-TGT GGT CTG TTT TTT TCT G-3' (FRAG 959) (SEQ. ID NO: 969)

5'-GCC CTG CTG GGG CGC TCT CC-3' (FRAG 960) (SEQ. ID NO: 970)

5'-GCC GCC CGC CTG GCT CCC-3' (FRAG 961) (SEQ. ID NO: 971)

5'-GGB GCC CBT GBT GGG CBT GCC-3' (FRAG 962) (SEQ. ID NO: 972)

5'-GTG GTT CTT GCC CTC CTT TGG CTG-3' (FRAG 963) (SEQ. ID NO: 973)

5'-CCG TGC CCG CTC CCC GGC-3' (FRAG 964) (SEQ. ID NO: 974)

5'-CTC CTG GCG GGT GGC CGT TG-3' (FRAG 965) (SEQ. ID NO: 975)

5'-GGC CCG TGT TCC CCT GGG-3' (FRAG 966) (SEQ. ID NO: 976)

5'-GCC TGG GGC TCC CTT CTC TC-3' (FRAG 967) (SEQ. ID NO: 977)

5'-GCC CTT CTT GCT GGG CCT C-3' (FRAG 968) (SEQ. ID NO: 978)

5'-TGC TGC TGC TGG TGC TGT GGC CCC C-3' (FRAG 969) (SEQ. ID NO: 979)

5'-GTACACCGAGGAGCCCATGATGGGCATGCCACAGACGACAGGC-3' (FRAG 970) (SEQ. ID NO: 980)

5'-GTBCBCCGBGGBGCCCBTGBTGGGCBTGCCBCBGBCGBCBGGC-3' (FRAG 971) (SEQ. ID NO: 981)

Human Adenosine A2b Receptor Nucleic Acid & Antisense Oligonucleotide Fragments

5-GGC GCC GTG CCG CGT CTT GGT GGC GGC GG GTT CGC GCC CGC GCG GGG CCC CTC CGG TCC GTT CGC GCC CGC GCG GGG CCC CTC CGG TCC CGG GTC GGG GCC CCC CGC GGC C GCC TCG GGC TGG GGG CGC TGG TGG CCG GG CCG CGC CTC CGC CTG CCG CTT CTG GCT GGG CCC CGG GCG CCC CCT CCC CTC TTG CTC GGG

-continued

TCC CCG TG ACA GCG CGT CCT GTG TCT CCA GCA GCA TGG CCG GGC CAG CTG GGC CCC BCB GCG CGT CCT
GTG TCT CCB GCB GCB TGG CCG GGC CBG CTG GGC CCC CCCAGCCCCG AGGCTCAGAA GCGGCAGGCG
GAGGCGCGGT CCGGGCGCTA TGGCCATGCC CGGCGGGTCT CACGCGGCTG CCCCTCGCCC GGCGCGCCTT
CGGTAGGGGG CGCCCGGGGC CCAGCTGGCC CGGCCATGCT GCTGGAGACA CAGGACGCGC TGTACGTGGC
GCTGGAGCTG GTCATCGCCG CGCTTTCGGT GGCGGGCAAC GTGCTGGTGT GCGCCGCGGT GGGCACGGCG

AACACTCTGC AGACGCCCAC CAACTACTTC CTGGTGTCCC TGGCTGCGGC CGACGTGGCC GTGGGGCTCT

TCGCCATCCC CTTTGCCATC ACCATCAGCC TGGGCTTCTG CACTGACTTC TACGGCTGCC TCTTCCTCGC
CTGCTTCGTG CTGGTGCTCA CGCAGAGCTC CATCTTCAGC CTTCTGGCCG TGGCAGTCGA CAGATACCTG
GCCATCTGTG TCCCGCTCAG GTATAAAAGT TTGGTCACGG GGACCCGAGC AAGAGGGGTC ATTGCTGTCC
TCTGGGTCCT TGCCTTTGGC ATCGGATTGA CTCCATTCCT GGGGTGGAAC AGTAAAGACA GTGCCACCAA
CAACTGCACA GAACCCTGGG ATGGAACCAC GAATGAAAGC TGCTGCCTTG TGAAGTGTCT CTTTGAGAAT
GTGGTCCCCA TGAGCTACAT GGTATATTTC AATTTCTTTG GGTGTGTTCT GCCCCCACTG CTTATAATGC
TGGTGATCTA CATTAAGATC TTCCTGGTGG CCTGCAGGCA GCTTCAGCGC ACTGAGCTGA TGGACCACTC
GAGGACCACC CTCCAGCGGG AGATCCATGC AGCCAAGTCA CTGGCCATGA TTGTGGGGAT TTTTGCCCTG
TGCTGGTTAC CTGTGCATGC TGTTAACTGT GTCACTCTTT TCCAGCCAGC TCAGGGTAAA AATAAGCCCA
AGTGGGCAAT GAATATGGCC ATTCTTCTGT CACATGCCAA TTCAGTTGTC AATCCCATTG TCTATGCTTA
CCGGAACCGA GACTTCCGCT ACACTTTTCA CAAAATTATC TCCAGGTATC TTCTCTGCCA AGCAGATGTC
AAGAGTGGGA ATGGTCAGGC TGGGGTACAG CCTGCTCTCG GTGTGGGCCT ATGATCTAGG CTCTCGCCTC

TTCCAGGAGA AGATACAAAT CCACAAGAAA CAAAGAGGAC ACGGCTGGTT TTCATTGTGA AAGATAGCTA

CACCTCACAA GGAAATGGAC TGCCTCTCTT GAGCACTTCC CTGGAGCTAC CACGTATCTA GCTAATATGT

ATGTGTCAGT AGTAGCACCA AGGATTGACA AATATATTTA TGATCTATTC AGCTGCTTTT ACTGTGTGGA

TTATGCCAAC AGCTTGAATG GATTCTAACA GACTCTTTTG TTTTTAAAAG TCTGCCTTGT TTATGGTGGA

AAATTACTGA AACTATTTTA CTGTGAAACA GTGTGAACTA TTATAATGCA AATACTTTTT AACTTAGAGG

CAATGGAAAA ATAAAAGTTG ACTGTACTAA AAATGTATAC TTGTTGCCAG GAAGGTGACC TCAAAAATTA

AAAGTATAAT TATTCGGCCG GGCATGGTGG CTCACACCTG TAATTCCAGC ACTTTGGGAG GCCAAGGCAG

GCGGATCACG AGGTCAGGAG TTCAAAACCA GCCTGTCCAA TATAGTG GGGCAATTTG TTAGTTATCC

GCCGCCACCA AGACGCGGCA CGGCGCCTGG ACCGGAGGGG CCCCGCGCGG GCGCGAACTT TGGGCTCGGG

CGAGTGGGTG GTGCTCCGCC CAGCCCGAGA CGGGCGGGCG CGCGGGCCAA TGGGTGCCGC CTCTTGGCCG

CGGGGGGCCC CGACCCGTGG GTCCCGGCCA CCAGCGCCCC AGCCCCGAGG CTCAGAAGCG GCAGGCGGAG

GCGCGGTCCG GGCGCTATGG CCATGCCCGG CGGGTCTCAC GCGGCTGCCC CTCGCCCGGC GCGCCTTCGG

TAGGGGGCGC CCGGGGCCCA GCTGGCCCGG CCATGCTGCT GGAGACACAG GACGCGCTGT ACGTGGCGCT

GGAGCTGGTC ATCGCCGCGC TTTCGGTGGC GGGCAACGTG CTGGTGTGCG CCGCGGTGGG CACGGCGAAC

ACTCTGCAGA CGCCCACCAA CTACTTCCTG GTGTCCCTGG CTGCGGCCGA CGTGGCCGTG GGGCTCTTCG

CCATCCCCTT TGCCATCACC ATCAGCCTGG GCTTCTGCAC TGACTTCTAC GGCTGCCTCT TCCTCGCCTG

CTTCGTGCTG GTGCTCACGC AGAGCTCCAT CTTCAGCCTT CTGGCCGTGG CAGTCGACAG ATACCTGGCC

ATCTGTGTCC CGCTCAGGTA TAAAAGTTTG GTCACGGGGA CCCGAGCAAG AGGGGTCATT GCTGTCCTCT

GGGTCCTTGC CTTTGGCATC GGATTGACTC CATTCCTGGG GTGGAACAGT AAAGACAGTG CCACCAACAA

CTGCACAGAA CCCTGGGATG GAACCACGAA TGAAAGCTGC TGCCTTGTGA AGTGTCTCTT TGAGAATGTG

GTCCCCATGA GCTACATGGT ATATTTCAAT TTCTTTGGGT GTGTTCTGCC CCCACTGCTT ATAATGCTGG

-continued

```
TGATCTACAT TAAGATCTTC CTGGTGGCCT GCAGGCAGCT TCAGCGCACT GAGCTGATGG ACCACTCGAG

GACCACCCTC CAGCGGGAGA TCCATGCAGC CAAGTCACTG GCCATGATTG TGGGGATTTT TGCCCTGTGC

TGGTTACCTG TGCATGCTGT TAACTGTGTC ACTCTTTTCC AGCCAGCTCA GGTAAAAAT AAGCCCAAGT

GGGCAATGAA TATGCCATT CTTCTGTCAC ATGCCAATTC AGTTGTCAAT CCCATTGTCT ATGCTTACCG

GAACCGAGAC TTCCGCTACA CTTTTCACAA AATTATCTCC AGGTATCTTC TCTGCCAAGC AGATGTCAAG

AGTGGGAATG GTCAGGCTGG GGTACAGCCT GCTCTCGGTG TGGGCCTATG ATCTAGGCTC TCGCCTCTTC

CAGGAGAAGA TACAAATCCA CAAGAAACAA AGAGGACACG GCTGGTTTTC ATTGTGAAAA ATAGCTACAC

CTCACAAGGA AATGGACTGC CTCTCTTGAG CACTTCCCTG GAGCTACCAC GTATCTAGCT AATATGTATG

TGTCAGTAGT AGGCTCCAAG GATTGACAAA TATATTTATG ATCTATTCAG CTGCTTTTAC TGTGTGGATT

ATGCCAACAG CTTGAATGGA TTCTAACAGA CTCTTTTGTT TTTAAAAGTC TGCCTTGTTT ATGGTGGAAA

ATTACTGAAA CTATTTTACT GTGAAACAGT GTGAACTATT ATAATGCAAA TACTTTTTAA CTTAGAGGCA

ATGGAAAAAT AAAAGTTGAC TGTACTAAAA ATG CCCAGCCCCG AGGCTCAGAA GCGGCAGGCG GAGGCGCGGT

CCGGGCGCTA TGGCCATGCC CGGCGGGTCT CACGCGGCTG CCCCTCGCCC GGCGCGCCTT CGGTAGGGGG

CGCCCGGGGC CCAGCTGGCC CGGCCATGCT GCTGGAGACA CAGGACGCGC TGTACGTGGC GCTGGAGCTG

GTCATCGCCG CGCTTTCGGT GGCGGGCAAC GTGCTGGTGT GCGCCGCGGT GGGCACGGCG AACACTCTGC

AGACGCCCAC CAACTACTTC CTGGTGTCCC TGGCTGCGGC CGACGTGGCC GTGGGGCTCT TCGCCATCCC

CTTTGCCATC ACCATCAGCC TGGGCTTCTG CACTGACTTC TACGGCTGCC TCTTCCTCGC CTGCTTCGTG

CTGGTGCTCA CGCAGAGCTC CATCTTCAGC CTTCTGGCCG TGGCAGTCGA CAGATACCTG GCCATCTGTG

TCCCGCTCAG GTATAAAAGT TTGGTCACGG GGACCCGAGC AAGAGGGGTC ATTGCTGTCC TCTGGGTCCT

TGCCTTTGGC ATCGGATTGA CTCCATTCCT GGGGTGGAAC AGTAAAGACA GTGCCACCAA CAACTGCACA

GAACCCTGGG ATGGAACCAC GAATGAAAGC TGCTGCCTTG TGAAGTGTCT CTTTGAGAAT GTGGTCCCCA

TGAGCTACAT GGTATATTTC AATTTCTTTG GGTGTGTTCT GCCCCACTG CTTATAATGC TGGTGATCTA

CATTAAGATC TTCCTGGTGG CCTGCAGGCA GCTTCAGCGC ACTGAGCTGA TGGACCACTC GAGGACCACC

CTCCAGCGGG AGATCCATGC AGCCAAGTCA CTGGCCATGA TTGTGGGGAT TTTTGCCCTG TGCTGGTTAC

CTGTGCATGC TGTTAACTGT GTCACTCTTT TCCAGCCAGC TCAGGGTAAA AATAAGCCCA AGTGGGCAAT

GAATATGGCC ATTCTTCTGT CACATGCCAA TTCAGTTGTC AATCCCATTG TCTATGCTTA CCGGAACCGA

GACTTCCGCT ACACTTTTCA CAAAATTATC TCCAGGTATC TTCTCTGCCA AGCAGATGTC AAGAGTGGGA

ATGGTCAGGC TGGGGTACAG CCTGCTCTCG GTGTGGGCCT ATGATCTAGG CTCTCGCCTC TTCCAGGAGA

AGATACAAAT CCACAAGAAA CAAAGAGGAC ACGGCTGGTT TCATTGTGA AAGATAGCTA CACCTCACAA

GGAAATGGAC TGCCTCTCTT GAGCACTTCC CTGGAGCTAC CACGTATCTA GCTAATATGT ATGTGTCAGT

AGTAGCACCA AGGATTGACA AATATATTTA TGATCTATTC AGCTGCTTTT ACTGTGTGGA TTATGCCAAC

AGCTTGAATG GATTCTAACA GACTCTTTTG TTTTTAAAAG TCTGCCTTGT TTATGGTGGA AAATTACTGA

AACTATTTTA CTGTGAAACA GTGTGAACTA TTATAATGCA AATACTTTTT AACTTAGAGG CAATGGAAAA

ATAAAAGTTG ACTGTACTAA AAATGTATAC TTGTTGCCAG GAAGGTGACC TCAAAAATTA AAGTATAAT

TATTCGGCCG GGCATGGTGG CTCACACCTG TAATCCCAGC ACTTTGGGAG GCCAAGGCAG GCGGATCACG

AGGTCAGGAG TTCAAAACCA GCCTGTCCAA TATAGTG GGCAATTTG TTAGTTATCC GCCGCCACCA

AGACGCGGCA CGGCGCCTGG ACCGAGGGG CCCCGCGCGG GCGCGAACTT TGGGCTCGGG CGAGTGGGTG

GTGCTCCGCC CAGCCCGAGA CGGGCGGCG CGCGGGCCAA TGGGTGCCGC CTCTTGGCCG CGGGGGGCCC

CGACCCGTGG GTCCCGGCCA CCAGCGCCCC AGCCCCGAGG CTCAGAAGCG GCAGGCGGAG GCGCGGTCCG

GGCGCTATGG CCATGCCCGG CGGGTCTCAC GCGGCTGCCC CTCGCCCGGC GCGCCTTCGG TAGGGGCGC
```

```
CCGGGGCCCA GCTGGCCCGG CCATGCTGCT GGAGACACAG GACGCGCTGT ACGTGGCGCT GGAGCTGGTC
ATCGCCGCGC TTTCGGTGGC GGGCAACGTG CTGGTGTGCG CCGCGGTGGG CACGGCGAAC ACTCTGCAGA
CGCCCACCAA CTACTTCCTG GTGTCCCTGG CTGCGGCCGA CGTGGCCGTG GGGCTCTTCG CCATCCCCTT
TGCCATCACC ATCAGCCTGG GCTTCTGCAC TGACTTCTAC GGCTGCCTCT TCCTCGCCTG CTTCGTGCTG
GTGCTCACGC AGAGCTCCAT CTTCAGCCTT CTGGCCGTGG CAGTCGACAG ATACCTGGCC ATCTGTGTCC
CGCTCAGGTA TAAAAGTTTG GTCACGGGGA CCCGAGCAAG AGGGGTCATT GCTGTCCTCT GGGTCCTTGC
CTTTGGCATC GGATTGACTC CATTCCTGGG GTGGAACAGT AAAGACAGTG CCACCAACAA CTGCACAGAA
CCCTGGGATG GAACCACGAA TGAAAGCTGC TGCCTTGTGA AGTGTCTCTT TGAGAATGTG GTCCCCATGA
GCTACATGGT ATATTTCAAT TTCTTTGGGT GTGTTCTGCC CCCACTGCTT ATAATGCTGG TGATCTACAT
TAAGATCTTC CTGGTGGCCT GCAGGCAGCT TCAGCGCACT GAGCTGATGG ACCACTCGAG GACCACCCTC
CAGCGGGAGA TCCATGCAGC CAAGTCACTG GCCATGATTG TGGGGATTTT TGCCCTGTGC TGGTTACCTG
TGCATGCTGT TAACTGTGTC ACTCTTTTCC AGCCAGCTCA GGGTAAAAAT AAGCCCAAGT GGGCAATGAA
TATGGCCATT CTTCTGTCAC ATGCCAATTC AGTTGTCAAT CCCATTGTCT ATGCTTACCG GAACCGAGAC
TTCCGCTACA CTTTTCACAA AATTATCTCC AGGTATCTTC TCTGCCAAGC AGATGTCAAG AGTGGGAATG
GTCAGGCTGG GGTACAGCCT GCTCTCGGTG TGGGCCTATG ATCTAGGCTC TCGCCTCTTC CAGGAGAAGA
TACAAATCCA CAAGAAACAA AGAGGACACG GCTGGTTTTC ATTGTGAAAG ATAGCTACAC CTCACAAGGA
AATGGACTGC CTCTCTTGAG CACTTCCCTG GAGCTACCAC GTATCTAGCT AATATGTATG TGTCAGTAGT
AGGCTCCAAG GATTGACAAA TATATTTATG ATCTATTCAG CTGCTTTTAC TGTGTGGATT ATGCCAACAG
CTTGAATGGA TTCTAACAGA CTCTTTTGTT TTTAAAAGTC TGCCTTGTTT ATGGTGGAAA ATTACTGAAA
CTATTTTACT GTGAAACAGT GTGAACTATT ATAATGCAAA TACTTTTTAA CTTAGAGGCA ATGGAAAAAT
AAAAGTTGAC TGTACTAAAA ATG-3' (FRAG. NO: 1670) (SEQ. ID NO: 3006)
5'-GGGCAATTTG TTAGTTATCC GCCGCCACCA AGACGCGGCA CGGCGCCTGG ACCGGAGGGG CCCCGCGCGG
GCGCGAACTT TGGGCTCGGG CGAGTGGGTG GTGCTCCGCC CAGCCCGAGA CGGGCGGGCG CGCGGGCCAA
TGGGTGCCGC CTCTTGGCCG CGGGGGGCCC CGACCCGTGG GTCCCGGCCA CCAGCGCCCC AGCCCCGAGG
CTCAGAAGCG GCAGGCGGAG GCGCGGTCCG GGCGCTATGG CCATGCCCGG CGGGTCTCAC GCGGCTGCCC
CTCGCCCGGC GCGCCTTCGG TAGGGGGCGC CCGGGGCCCA GCTGGCCCGG CCATGCTGCT GGAGACACAG
GACGCGCTGT ACGTGGCGCT GGAGCTGGTC ATCGCCGCGC TTTCGGTGGC GGGCAACGTG CTGGTGTGCG
CCGCGGTGGG CACGGCGAAC ACTCTGCAGA CGCCCACCAA CTACTTCCTG GTGTCCCTGG CTGCGGCCGA
CGTGGCCGTG GGGCTCTTCG CCATCCCCTT TGCCATCACC ATCAGCCTGG GCTTCTGCAC TGACTTCTAC
GGCTGCCTCT TCCTCGCCTG CTTCGTGCTG GTGCTCACGC AGAGCTCCAT CTTCAGCCTT CTGGCCGTGG
CAGTCGACAG ATACCTGGCC ATCTGTGTCC CGCTCAGGTA TAAAAGTTTG GTCACGGGGA CCCGAGCAAG
AGGGGTCATT GCTGTCCTCT GGGTCCTTGC CTTTGGCATC GGATTGACTC CATTCCTGGG GTGGAACAGT
AAAGACAGTG CCACCAACAA CTGCACAGAA CCCTGGGATG GAACCACGAA TGAAAGCTGC TGCCTTGTGA
AGTGTCTCTT TGAGAATGTG GTCCCCATGA GCTACATGGT ATATTTCAAT TTCTTTGGGT GTGTTCTGCC
CCCACTGCTT ATAATGCTGG TGATCTACAT TAAGATCTTC CTGGTGGCCT GCAGGCAGCT TCAGCGCACT
GAGCTGATGG ACCACTCGAG GACCACCCTC CAGCGGGAGA TCCATGCAGC CAAGTCACTG GCCATGATTG
TGGGGATTTT TGCCCTGTGC TGGTTACCTG TGCATGCTGT TAACTGTGTC ACTCTTTTCC AGCCAGCTCA
GGGTAAAAAT AAGCCCAAGT GGGCAATGAA TATGGCCATT CTTCTGTCAC ATGCCAATTC AGTTGTCAAT
CCCATTGTCT ATGCTTACCG GAACCGAGAC TTCCGCTACA CTTTTCACAA AATTATCTCC AGGTATCTTC
```

TCTGCCAAGC AGATGTCAAG AGTGGGAATG GTCAGGCTGG GGTACAGCCT GCTCTCGGTG TGGGCCTATG

ATCTAGGCTC TCGCCTCTTC CAGGAGAAGA TACAAATCCA CAAGAAACAA AGAGGACACG GCTGGTTTTC

ATTGTGAAAG ATAGCTACAC CTCACAAGGA AATGGACTGC CTCTCTTGAG CACTTCCCTG GAGCTACCAC

GTATCTAGCT AATATGTATG TGTCAGTAGT AGGCTCCAAG GATTGACAAA TATATTTATG ATCTATTCAG

CTGCTTTTAC TGTGTGGATT ATGCCAACAG CTTGAATGGA TTCTAACAGA CTCTTTTGTT TTTAAAAGTC

TGCCTTGTTT ATGGTGGAAA ATTACTGAAA CTATTTTACT GTGAAACAGT GTGAACTATT ATAATGCAAA

TACTTTTTAA CTTAGAGGCA ATGGAAAAAT AAAAGTTGAC TGTACTAAAA ATG-3' (FRAG. NO: _) (SEQ. ID NO: 2436)

5'-CCCAGCCCCG AGGCTCAGAA GCGGCAGGCG GAGGCGCGGT CCGGGCGCTA TGGCCATGCC CGGCGGGTCT

CACGCGGCTG CCCCTCGCCC GGCGCGCCTT CGGTAGGGGG CGCCCGGGGC CCAGCTGGCC CGGCCATGCT

GCTGGAGACA CAGGACGCGC TGTACGTGGC GCTGGAGCTG GTCATCGCCG CGCTTTCGGT GGCGGGCAAC

GTGCTGGTGT CGCCGCGGT GGGCACGGCG AACACTCTGC AGACGCCCAC CAACTACTTC CTGGTGTCCC

TGGCTGCGGC CGACGTGGCC GTGGGGCTCT TCGCCATCCC CTTTGCCATC ACCATCAGCC TGGGCTTCTG

CACTGACTTC TACGGCTGCC TCTTCCTCGC CTGCTTCGTG CTGGTGCTCA CGCAGAGCTC CATCTTCAGC

CTTCTGGCCG TGGCAGTCGA CAGATACCTG GCCATCTGTG TCCCGCTCAG GTATAAAAGT TTGGTCACGG

GGACCCGAGC AAGAGGGGTC ATTGCTGTCC TCTGGGTCCT TGCCTTTGGC ATCGGATTGA CTCCATTCCT

GGGGTGGAAC AGTAAAGACA GTGCCACCAA CAACTGCACA GAACCCTGGG ATGGAACCAC GAATGAAAGC

TGCTGCCTTG TGAAGTGTCT CTTTGAGAAT GTGGTCCCCA TGAGCTACAT GGTATATTTC AATTTCTTTG

GGTGTGTTCT GCCCCCACTG CTTATAATGC TGGTGATCTA CATTAAGATC TTCCTGGTGG CCTGCAGGCA

GCTTCAGCGC ACTGAGCTGA TGGACCACTC GAGGACCACC CTCCAGCGGG AGATCCATGC AGCCAAGTCA

CTGGCCATGA TTGTGGGGAT TTTTGCCCTG TGCTGGTTAC CTGTGCATGC TGTTAACTGT GTCACTCTTT

TCCAGCCAGC TCAGGGTAAA AATAAGCCCA AGTGGGCAAT GAATATGGCC ATTCTTCTGT CACATGCCAA

TTCAGTTGTC AATCCCATTG TCTATGCTTA CCGGAACCGA GACTTCCGCT ACACTTTTCA CAAAATTATC

TCCAGGTATC TTCTCTGCCA AGCAGATGTC AAGAGTGGGA ATGGTCAGGC TGGGGTACAG CCTGCTCTCG

GTGTGGGCCT ATGATCTAGG CTCTCGCCTC TTCCAGGAGA AGATACAAAT CCACAAGAAA CAAAGAGGAC

ACGGCTGGTT TTCATTGTGA AAGATAGCTA CACCTCACAA GGAAATGGAC TGCCTCTCTT GAGCACTTCC

CTGGAGCTAC CACGTATCTA GCTAATATGT ATGTGTCAGT AGTAGCACCA AGGATTGACA AATATATTTA

TGATCTATTC AGCTGCTTTT ACTGTGTGGA TTATGCCAAC AGCTTGAATG GATTCTAACA GACTCTTTTG

TTTTTAAAAG TCTGCCTTGT TTATGGTGGA AAATTACTGA AACTATTTTA CTGTGAAACA GTGTGAACTA

TTATAATGCA AATACTTTTT AACTTAGAGG CAATGGAAAA ATAAAAGTTG ACTGTACTAA AAATGTATAC

TTGTTGCCAG GAAGGTGACC TCAAAAATTA AAAGTATAAT TATTCGGCCG GGCATGGTGG CTCACACCTG

TAATTCCAGC ACTTTGGGAG GCCAAGGCAG GCGGATCACG AGGTCAGGAG TTCAAAACCA GCCTGTCCAA

TATAGTG-3' (FRAG. NO: _) (SEQ. ID NO: 2435)

5'-GGGCAATTTG TTAGTTATCC GCCGCCACCA AGACGCGGCA CGGCGCCTGG ACCGGAGGGG CCCCGCGCGG

GCGCGAACTT TGGGCTCGGG CGAGTGGGTG GTGCTCCGCC CAGCCCGAGA CGGGCGGGCG CGCGGGCCAA

TGGGTGCCGC CTCTTGGCCG CGGGGGGCCC CGACCCGTGG GTCCCGGCCA CCAGCGCCCC AGCCCCGAGG

CTCAGAAGCG GCAGGCGGAG GCGCGGTCCG GGCGCTATGG CCATGCCCGG CGGGTCTCAC GCGGCTGCCC

CTCGCCCGGC GCGCCTTCGG TAGGGGCGC CCGGGGCCCA GCTGGCCCGG CCATGCTGCT GGAGACACAG

GACGCGCTGT ACGTGGCGCT GGAGCTGGTC ATCGCCGCGC TTTCGGTGGC GGGCAACGTG CTGGTGTGCG

CCGCGGTGG CACGGCGAAC ACTCTGCAGA CGCCCACCAA CTACTTCCTG GTGTCCCTGG CTGCGGCCGA

CGTGGCCGTG GGGCTCTTCG CCATCCCCTT TGCCATCACC ATCAGCCTGG GCTTCTGCAC TGACTTCTAC

-continued

```
GGCTGCCTCT TCCTCGCCTG CTTCGTGCTG GTGCTCACGC AGAGCTCCAT CTTCAGCCTT CTGGCCGTGG

CAGTCGACAG ATACCTGGCC ATCTGTGTCC CGCTCAGGTA TAAAAGTTTG GTCACGGGGA CCCGAGCAAG

AGGGGTCATT GCTGTCCTCT GGGTCCTTGC CTTTGGCATC GGATTGACTC CATTCCTGGG GTGGAACAGT

AAAGACAGTG CCACCAACAA CTGCACAGAA CCCTGGGATG GAACCACGAA TGAAAGCTGC TGCCTTGTGA

AGTGTCTCTT TGAGAATGTG GTCCCCATGA GCTACATGGT ATATTTCAAT TTCTTTGGGT GTGTTCTGCC

CCCACTGCTT ATAATGCTGG TGATCTACAT TAAGATCTTC CTGGTGGCCT GCAGGCAGCT TCAGCGCACT

GAGCTGATGG ACCACTCGAG GACCACCCTC CAGCGGGAGA TCCATGCAGC CAAGTCACTG GCCATGATTG

TGGGGATTTT TGCCCTGTGC TGGTTACCTG TGCATGCTGT TAACTGTGTC ACTCTTTTCC AGCCAGCTCA

GGGTAAAAAT AAGCCCAAGT GGGCAATGAA TATGGCCATT CTTCTGTCAC ATGCCAATTC AGTTGTCAAT

CCCATTGTCT ATGCTTACCG GAACCGAGAC TTCCGCTACA CTTTTCACAA AATTATCTCC AGGTATCTTC

TCTGCCAAGC AGATGTCAAG AGTGGGAATG GTCAGGCTGG GGTACAGCCT GCTCTCGGTG TGGGCCTATG

ATCTAGGCTC TCGCCTCTTC AGGAGAAGA TACAAATCCA AGAAACAA AGAGGACACG CTGGTTTTC

ATTGTGAAAG ATAGCTACAC CTCACAAGGA ATGGACTGC CTCTCTTGAG CACTTCCCTG GAGCTACCAC

GTATCTAGCT AATATGTATG TGTCAGTAGT AGGCTCCAAG GATTGACAAA TATATTTATG ATCTATTCAG

CTGCTTTTAC TGTGTGGATT ATGCCAACAG CTTGAATGGA TTCTAACAGA CTCTTTTGTT TTTAAAAGTC

TGCCTTGTTT ATGGTGGAAA ATTACTGAAA CTATTTTACT GTGAAACAGT GTGAACTATT ATAATGCAAA

TACTTTTTAA CTTAGAGGCA ATGGAAAAAT AAAAGTTGAC TGTACTAAAA ATG-3' (FRAG NO: _) (SEQ. ID NO: 2425)

5'-CCCAGCCCCG AGGCTCAGAA GCGGCAGGCG GAGGCGCGGT CCGGGCGCTA TGGCCATGCC CGGCGGGTCT

CACGCGGCTG CCCCTCGCCC GGCGCGCCTT CGGTAGGGGG CGCCCGGGGC CCAGCTGGCC CGGCCATGCT

GCTGGAGACA CAGGACGCGC TGTACGTGGC GCTGGAGCTG GTCATCGCCG CGCTTTCGGT GGCGGGCAAC

GTGCTGGTGT GCGCCGCGGT GGGCACGGCG AACACTCTGC AGACGCCCAC CAACTACTTC CTGGTGTCCC

TGGCTGCGGC CGACGTGGCC GTGGGCTCT TCGCCATCCC CTTTGCCATC ACCATCAGCC TGGGCTTCTG

CACTGACTTC TACGGCTGCC TCTTCCTCGC CTGCTTCGTG CTGGTGCTCA CGCAGAGCTC CATCTTCAGC

CTTCTGGCCG TGGCAGTCGA CAGATACCTG GCCATCTGTG TCCCGCTCAG GTATAAAAGT TTGGTCACGG

GGACCCGAGC AAGAGGGGTC ATTGCTGTCC TCTGGGTCCT TGCCTTTGGC ATCGGATTGA CTCCATTCCT

GGGGTGGAAC AGTAAAGACA GTGCCACCAA CAACTGCACA GAACCCTGGG ATGGAACCAC GAATGAAAGC

TGCTGCCTTG TGAAGTGTCT CTTTGAGAAT GTGGTCCCCA TGAGCTACAT GGTATATTTC AATTTCTTTG

GGTGTGTTCT GCCCCCACTG CTTATAATGC TGGTGATCTA CATTAAGATC TTCCTGGTGG CCTGCAGGCA

GCTTCAGCGC ACTGAGCTGA TGGACCACTC GAGGACCACC CTCCAGCGGG AGATCCATGC AGCCAAGTCA

CTGGCCATGA TTGTGGGGAT TTTTGCCCTG TGCTGGTTAC CTGTGCATGC TGTTAACTGT GTCACTCTTT

TCCAGCCAGC TCAGGGTAAA AATAAGCCCA AGTGGGCAAT GAATATGGCC ATTCTTCTGT CACATGCCAA

TTCAGTTGTC AATCCCATTG TCTATGCTTA CCGGAACCGA GACTTCCGCT ACACTTTTCA CAAAATTATC

TCCAGGTATC TTCTCTGCCA AGCAGATGTC AAGAGTGGGA ATGGTCAGGC TGGGGTACAG CCTGCTCTCG

GTGTGGGCCT ATGATCTAGG CTCTCGCCTC TTCAGGAGA AGATACAAAT CCACAAGAAA CAAAGAGGAC

ACGGCTGGTT TTCATTGTGA AAGATAGCTA CACCTCACAA GGAAATGGAC TGCCTCTCTT GAGCACTTCC

CTGGAGCTAC CACCTATCTA GCTAATATGT ATGTGTCAGT AGTAGCACCA AGGATTGACA AATATATTTA

TGATCTATTC AGCTGCTTTT ACTGTGTGGA TTATGCCAAC AGCTTGAATG GATTCTAACA GACTCTTTTG

TTTTTAAAAG TCTGCCTTGT TTATGGTGGA AAATTACTGA AACTATTTTA CTGTGAAACA GTGTGAACTA

TTATAATGCA AATACTTTTT AACTTAGAGG CAATGGAAAA ATAAAAGTTG ACTGTACTAA AAATGTATAC
```

```
TTGTTGCCAG GAACGTGACC TCAAAAATTA AAAGTATAAT TATTCGGCCG GGCATGGTGG CTCACACCTG

TAATTCCAGC ACTTTGGGAG GCCAAGGCAG GCGGATCACG AGGTCAGGAG TTCAAAACCA GCCTGTCCAA

TATAGTG (FRAG. NO_) (SEQ. ID NO: 2424)
```

5'-GCGCGTCCTC-3' (FRAG. NO: 1671) (SEQ. ID NO: 1686)

5'-GCT GGG CCC CGG 3' (FRAG. NO: 1672) (SEQ. ID NO: 1687)

5'-CGG GTC GGG GCC CCC C-3' (FRAG. NO: 1673) (SEQ. ID NO: 1688)

5'-CGC GCC CGC G-3' (FRAG. NO: 1674) (SEQ. ID NO: 1689)

5'-GGC GCC GTG CCG CGT CTT GGT GGC GGC GG-3' (FRAG 972) (SEQ. ID NO: 982)

5'-GTT CGC GCC CGC GCG GGG CCC CTC CGG TCC-3' (FRAG 973) (SEQ. ID NO: 983)

5'-GTT CGC GCC CGC GCG GGG CCC CTC CGG TCC-3' (FRAG 974) (SEQ. ID NO: 984)

5'-CGG GTC GGG GCC CCC CGC GGC C-3' (FRAG 975) (SEQ. ID NO: 985)

5'-GCC TCG GGG CTG GGG CGC TGG TGG CCG GG-3' (FRAG 976) (SEQ. ID NO: 986)

5'-CCG CGC CTC CGC CTG CCG CTT CTG-3' (FRAG 977) (SEQ. ID NO: 987)

5'-GCT GGG CCC CGG GCG CCC CCT-3' (FRAG 978) (SEQ. ID NO: 988)

5'-CCC CTC TTG CTC GGG TCC CCG TG-3' (FRAG 979) (SEQ. ID NO: 989)

5'-ACAGCGCGTCCTGTGTCTCCAGCAGCATGGCCGGGCCAGCTGGGCCCC-3' (FRAG 980) (SEQ. ID NO: 990)

5'-BCBGCGCGTCCTGTGTCTCCBGCBGCBTGGCCGGGCCBGCTGGGCCCC-3' (FRAG 981) (SEQ. ID NO: 991)

Human Adenosine A3 Receptor Nucleic Acid and Antisense Oligonucleotide Fragments

```
5'-ACA GAG CAG TGC TGT TGT TGG GCA TCT TGC CTT CCC AGG G BCB GBG CB TGC TGT TGT TGG GCB TCT

TGC CTT CCC BGG GCC CTT TTC TGG TGG GGT GGT GCT GTT GTT GGG CTT TCT TCT GTT CCC BCB GBG CBG

TGC TGT TGT TGG GCB TCT TGC CTT CCC BGG GCC CTT TTC TGG TGG GGT GGT GCT GTT GTT GGG C TTT CTT

CTG TTC CC GAATTCCCAG ATGGGCAGAG GTGGCTGGGC TGGTGACCCT AAGTGTGTCT CCTGCCTTTA

TTCTCTCTAG TGGGTTATTC TTTCATGTGG TATCTTCCCT ACAGCATGCT GTGTTTGGAC ACAAACCCCT

TTCCTTGGTT TCTCTGACCC AGCTGAGATG GACTGATTCC AAAAGAACTC ACCTATGTAC TGGGGTAGGG

GAGGGAGGGT TTTTTGCAGT ATTTAACTAA GGTTCAAAGA GTGCTATATA GTGAGAAAGG CTTCTTTTTT

TTTTTTTTTT TTTTTTGGCA GAGTGCTGCC TCCTAGAAAT TTCTCTTGGT AACTTCCTTC TCTGAAGCAC

AGATAAAGAA AACAATTACA GTAGAAACAT TTATGAGGGA CACATTGGAG GCCGATGAAG CTTTTCAAGT

TCCAGCAGTG CAGGGATGTG GGCAGAACTG ACATTGGAAA ATACTAGAAT GATGGAAATT CAGTTGGAGA

GGACTGCCCT TTTTAATGTC TGGGGAGTCT GCTCAGGGAG AAATGACAAG TCTGGCGGGG ACAAGTATGG

GATTTGGTAA GACTTGGATC AACTTGGGAT ACAGGGTGGG GGTCGGGAGT GGAATCAATG AATGATGCCA

GAGCAGATCA ACTAACAAGA GGACCCTGAT GAGCCCCAGG CAGAGGCGTC TCCCTTATGC CCCACTCTGA

AGTGTTTGTT AGTAAACACC AGAACGCCAT TGTTGTTACT GCTGAATTTT ATTTTGGGCT GTACATATTT

AGATGCTTAA GGTAAAAATG ATAAAGCCCT CAAGCCACTG TGTGGGTTTG GGTCCAAGTG TTCCTTCTTG

CTGCCTCTCT AACACGCCTG GTTAAAATAA TCCCTTTGGA TGGTGCTGAG AAGCACCTGA ACCAAGTGGG

TCCCCAAATA ACAATGGCGT GCAAGTGTCT GGTTCCCAGA AGTTGGTGAC TAGGTAAGCA GCTTCAGGGA

GAGGGGGCTG ATTCCCAGAC AGTCGCCTGT TCCTGCGGGG ATGGGCTGA GGCTTGGGA ATGTGGGCAG

GAGGATATGC CAT TGATTC TGTTGCACAC GTTCTTTTCC CTTCTTTCTG TATGTCTGGT CATTCTGCTA

TTCTGTCGTT CCTCACATAG GTTGGACATT GGCCGGCTGC CAGCATAAGT GCCAGTGTGA TTTTGCTAGG

TGTGAGCTGA GAAAGAGAGG TGGAGGCTAA GCAGGTGTGA TGCTTCTCAG AGGTGCTGAG TTTTTGCCCT

TCTGAGCAGG GAATCTTTGC TTATCCCTTT GACCAAGGAT CTTTGCTGCA AAGGCTGGGT ATCGGCTGTG
```

```
CTCAGCAAAG CGTCAACTCG TGCAAGAACT TAGCAGGAAT AGTTCTGGCT AAGGTTAGGA GGCTGCCACC
AAAGTCTCTT TTTTGTTCCT CTGCTTCTCC CGTTTGCCTC CTTATCATGA GATCTTTTTG CTAAGCTGGC
AGAAAGATTG CATAGTCAGT GCTTCCAGCT CTGCTCCCAC CTGATCCTGC ACTGTCCTCT GGTCCCTGAA
TGAATGAACT CTGATACCCA ATCTTGTCTC GAGCCTTCTC TATGCCACTC ATGGCTCCTC TTCTGCTCTT
TCCATCTTTT TGCTGAGAGT TCTGAGCTCT GTACTTCCTC TTGGCCCATC TCACTTCCTG AAACACCCCT
GAAGAGGGTT GCTTATCTTG ATGGAACTCA AAAAGCCAAA AAGCTGCAGG CAGAGGCGTT GAGGACATCT
GTTTGGGGAA CTAAGAGCAG CAGCACTTTC AGATTCAGTC CATATAGAGC TGTCCTACAG CATTCTGGAA
ACTTGAGGAT GTGCGGTGCA TAAAGGGGCT GGAAGTGACC CACCTGTGAT GAGCCCTTTC TAAGGAGAAG
GGTTTCCAAG AGATCACCCC ACCAGAAAAG GGTAGGAATG AGCAAGTTGG GAATTTTAGA CTGTCACTGC
ACATGGACCT CTGGGAAGAC GTCTGGCGAG AGCTAGGCCC ACTGGCCCTA CAGACGGATC TTGCTGGCTC
ACCTGTCCCT GTGGAGGTTC CCCTGGGAAG GCAAGATGCC CAACAACAGC ACTGCTCTGT CATTGGCCAA
TGTTACCTAC ATCACCATGG AAATTTTCAT TGGACTCTGC GCCATAGTGG GCAACGTGCT GGTCATCTGC
GTGGTCAAGC TGAACCCCAG CCTGCAGACC ACCACCTTCT ATTTCATTGT CTCTCTAGCC CTGGCTGACA
TTGCTGTTGG GGTGCTGGTC ATGCCTTTGG CCATTGTTGT CAGCCTGGGC ATCACAATCC ACTTCTACAG
CTGCCTTTTT ATGACTTGCC TACTGCTTAT CTTTACCCAC GCCTCCATCA TGTCCTTGCT GGCCATCGCT
GTGGACCGAT ACTTGCGGGT CAAGCTTACC GTCAGGTAGC CTGCGGCGTG GGTGGGCAG CAATTGAGGC
AGCTGGGAAA TGAGGCTACA AAGCCAGAGC CTGCTGAATT TTATTTTGGA CTGTACATAT TTAGATGCTT
AAGGTAAAAA TGATAAAGCC CTCAAGCCAC TGTGTGGGTT GGGTCCAAGT GTTCCTTGCT GCTGCCTCTC
TAACACGCCT GGTTAAAATA ATCCCTTTGG ATGGTGCTGA GAAGCACCTG AACCAAGTGG GTCCCCAAAT
AACTATGGCG TGCAAGTGTC TGGTTCCCAG AAGTTGGTGA CTAGGTAAGC GACTCAGGGA GAGGGGCTGA
TTCCCAGACA GTCGCCTGTT CCTGCTGGGA TGGGGCTGAG GCTTGGGGAA TGTGGGCAGG AGGATATGCC
ATTTGATTCT GTTGCACACG TTCTTTTCCC TTCTTTCTGT ATGTCTGGTC ATTCTGCTAT TCTGTCGTTC
CTCACATAGG TTGGACATTG GCCGGCTGCC AGCATAAGTG CCAGTGTGAT TTTGCTAGGG TGTGAGCTGA
GAAAGAGAGG TGGAGGCTAA GCAGGTGTGA TGCTTCTCAG AGGTGCTGAG TTTTTGCCCT TCTGAGCAGG
GAATCTTTGC TTATCCCTTT GACCAAGGAT CTTTGCTCCA AAGGCTGGGT ATCGGCTGTG CTCAGCAAAG
CGTCAACTCG TGCAAGAACT TAGCAGGAAT AGTTCTGGCT AAGGTTAGGA GGCTGCCACC AAAGTCTCTT
TTTTGTTCCT CTGCTTCTCC CGTTTGCCTC CTTATCATGA GATCTTTTTG CTAAGCTGGC AGAAAGATTG
CATAATCAGT GCTTCCAGCT CCGCTCCCAC CTGATCCTGC ACTGTCCTCT GGTCCCTGAA TGAATGAACT
CTGATACCCA ATCTTGTCTC GAGCCTTCTC TATGCCACTC ATGGCTCCTC TTCTGCTCTT TCCATCTTTT
TGCTGAGAGT TACTGAGCTC TGTACTTCCT CTTGGCCCAT CTCACTTCCT GAAACACCCC TGAAGAGGGT
TGCTTATCTT GATGGAACTC AAAAAGCCAA AAGCTGCAG GCAGAGGCGT TGAGGACATC TGTTTGGGA
ACTAAGAGCA GCAGCACTTT CAGATTCAGT CCATATAGAG CTGTCCTACA GCATTCTGGA AACTTGAGGA
TGTGCGGTGC ATAAAGGGGC TGGAAGTGAC CCACCTGTGA TGAGCCCTTT CTAAGGAGAA GGGTTTCCAA
GAGATCACCC CACCAGAAAA GGGTAGGAAT GAGCAAGTTG GGAATTTTAG ACTGTCACTG CACATGGACC
TCTGGGAAGA CGTCTGGCGA GAGCTAGGCC CACTGGCCCT ACAGACGGAT CTTGCTGGCT CACCTGTCCC
TGTGGAGGTT CCCCTGGGAA GGCAAGATGC CCAACAACAG CACTGCTCTG CGAATTCGGG GACATCTGT
TTGGGGAACT AAGAGCAGCA GCACTTTCAG ATTCAGTCCA TATAGAGCTG TCCTACAGCA TTCTGGAAAC
TTGAGGATGT GCGGTGCATA AACGGGCTGG AAGTGACCCA CCTGTGATGA GCCCTTTCTA AGGAGAAGG
TTTCCAAGAG ATCACCCCAC CAGAAAAGGG TAGGAATGAG CAAGTGGGA ATTTAGACT GTCACTGCAC
```

-continued

```
ATGGACCTCT GGGAAGACGT CTGGCGAGAG CTAGGCCCAC TGGCCCTACA GACGGATCTT GCTGGCTCAC
CTGTCCCTGT GGAGGTTCCC CTGGGAAGGC AAGATGCCCA ACAACAGCAC TGCTCTGTCA TTGGCCAATG
TTACCTACAT CACCATGGAA ATTTTCATTG GACTCTGCGC CATAGTGGGC AACGTGCTGG TCATCTGCGT
GGTCAAGCTG AACCCCAGCC TGCAGACCAC CACCTTCTAT TTCATTGTCT CTCTAGCCCT GGCTGACATT
GCTGTTGGGG TGCTGGTCAT GCCTTTGGCC ATTGTTGTCA GCCTGGGCAT CACAATCCAC TTCTACAGCT
GCCTTTTTAT GACTTGCCTA CTGCTTATCT TTACCCACGC CTCCATCATG TCCTTGCTGG CCATCGCTGT
GGACCGATAC TTGCGGGTCA AGCTTACCGT CAGATACAAG AGGGTCACCA CTCACAGAAG AATATGGCTG
GCCCTGGGCC TTTGCTGGCT GGTGTCATTC CTGGTGGGAT TGACCCCCAT GTTTGGCTGG AACATGAAAC
TGACCTCAGA GTACCACAGA AATGTCACCT TCCTTTCATG CCAATTTGTT TCCGTCATGA GGATGGACTA
CATGGTATAC TTCAGCTTCC TCACCTGGAT TTTCATCCCC CTGGTTGTCA TGTGCGCCAT CTATCTTGAC
ATCTTTTACA TCATTCGGAA CAAACTCAGT CTGAACTTAT CTAACTCCAA AGAGACAGGT GCATTTTATG
GACGGGAGTT CAAGACGGCT AAGTCCTTGT TTCTGGTTCT TTTCTTGTTT GCTCTGTCAT GGCTGCCTTT
ATCTCTCATC AACTGCATCA TCTACTTTAA TGGTGAGGTA CCACAGCTTG TGCTGTACAT GGGCATCCTG
CTGTCCCATG CCAACTCCAT GATGAACCCT ATCGTCTATG CCTATAAAAT AAAGAAGTTC AAGGAAACCT
ACCTTTTGAT CCTCAAAGCC TGTGTGGTCT GCCATCCCTC TGATTCTTTG GACACAAGCA TTGAGAAGAA
TTCTGAGTAG TTATCCATCA GAGATGACTC TGTCTCATTG ACCTTCAGAT TCCCCATCAA CAAACACTTG
AGGGCCTGTA TGCCTGGGCC AAGGGATTTT TACATCCTTG ATTACTTCCA CTGAGGTGGG AGCATCTCCA
GTGCTCCCCA ATTATATCTC CCCCACTCCA CTACTCTCTT CCTCCACTTC ATTTTTCCTT TGTCCTTTCT
CTCTAATTCA GTGTTTTGGA GGCCTGACTT GGGGACAACG TATTATTGAT ATTATTGTCT GTTTTCCTTC
TTCCCAATAG AAGAATAAGT CATGGAGCCT GAAGGGTGCC TAGTTGACTT ACTGACAAAA GGCTCTAGTT
GGGCTGAACA TGTGTGTGGT GGTGACTCAT TTCCATGCCA TTGTGGAATT GAGCAGAGAA CCTGCTCTCG
GAGGATGCCT AGGAGATGTT GGGAACAGAA GAAATAAACT GAGTTTAAGG GGGACTTAAA CTGCTGAATT C
GAATTCCCAG ATGGGCAGAG GTGGCTGGGC TGGTGACCCT AAGTGTGTCT CCTGCCTTTA TTCTCTCTAG
TGGGTTATTC TTTCATGTGG TATCTTGCCT ACAGCATGCT GTGTTGGAC ACAAACCCCT TTCCTTGGTT
TCTCTGACCC AGCTGAGATG GACTGATTCC AAAAGAACTC ACCTATGTAC TGGGGTAGGG GAGGGAGGGT
TTTTTGCAGT ATTTAACTAA GGTTCAAAGA GTGCTATATA GTGAGAAAGG CTTCTTTTTT TTTTTTTTT
TTTTTTGGCA GAGTGCTGCC TCCTAGAAAT TTCTCTTGGT AACTTCCTTC TCTGAAGCAC AGATAAAGAA
AACAATTACA GTAGAAACAT TTATGAGGGA CACATTGGAG GCCGATGAAG CTTTTCAAGT TCCAGCAGTG
CAGGGATGTG GGCAGAACTG ACATTGGAAA ATACTAGAAT GATGGAAATT CAGTTGGAGA GGACTGCCCT
TTTTAATGTC TGGGGAGTCT GCTCAGGGAG AAATGACAAG TCTGGCGGGG ACAAGTATGG GATTTGGTAA
GACTTGGATC AACTTGGGAT ACAGGGTGGG GGTCGGGAGT GGAATCAATG AATGATGCCA GAGCAGATCA
ACTAACAAGA GGACCCTGAT GAGCCCCAGG CAGAGGCGTC TCCCTTATGC CCCACTCTGA AGTGTTTGTT
AGTAAACACC AGAACGCCAT TGTTGTTACT GCTGAATTTT ATTTTGGGCT GTACATATTT AGATGCTTAA
GGTAAAAATG ATAAAGCCCT CAAGCCACTG TGTGGGTTTG GGTCCAAGTG TTCCTTCTTG CTGCCTCTCT
AACACGCCTG GTTAAAATAA TCCCTTTGGA TGGTGCTGAG AAGCACCTGA ACCAAGTGGG TCCCCAAATA
ACAATGGCGT GCAAGTGTCT GGTTCCCAGA AGTTGGTGAC TAGGTAAGCA GCTTCAGGGA GAGGGGCTG
ATTCCCGAC AGTCGCCTGT TCCTGCGGGG ATGGGGCTGA GGCTTGGGA ATGTGGGCAG GAGGATATGC
CATTTGATTC TGTTGCACAC GTTCTTTTCC CTTCTTTCTG TATGTCTGGT CATTCTGCTA TTCTGTCGTT
CCTCACATAG GTTGGACATT GGCCGGCTGC CAGCATAAGT GCCAGTGTGA TTTTGCTAGG TGTGAGCTGA
GAAAGAGAGG TGGAGGCTAA GCAGGTGTGA TGCTTCTCAG AGGTGCTGAG TTTTTGCCCT TCTGAGCAGG
```

-continued

```
GAATCTTTGC TTATCCCTTT GACCAAGGAT CTTTGCTGCA AAGGCTGGGT ATCGGCTGTG CTCAGCAAAG
CGTCAACTCG TGCAAGAACT TAGCAGGAAT AGTTCTGGCT AAGGTTAGGA GGCTGCCACC AAAGTCTCTT
TTTTGTTCCT CTGCTTCTCC CGTTTGCCTC CTTATCATGA GATCTTTTTG CTAAGCTGGC AGAAAGATTG
CATAGTCAGT GCTTCCAGCT CTGCTCCCAC CTGATCCTGC ACTGTCCTCT GGTCCCTGAA TGAATGAACT
CTGATACCCA ATCTTGTCTC GAGCCTTCTC TATGCCACTC ATGGCTCCTC TTCTGCTCTT TCCATCTTTT
TGCTGAGAGT TCTGAGCTCT GTACTTCCTC TTGGCCCATC TCACTTCCTG AAACACCCCT GAAGAGGGTT
GCTTATCTTG ATGGAACTCA AAAAGCCAAA AAGCTGCAGG CAGAGGCGTT GAGGACATCT GTTTGGGGAA
CTAAGAGCAG CAGCACTTTC AGATTCAGTC CATATAGAGC TGTCCTACAG CATTCTGGAA ACTTGAGGAT
GTGCGGTGCA TAAAGGGGCT GGAAGTGACC CACCTGTGAT GAGCCCTTTC TAAGGAGAAG GGTTTCCAAG
AGATCACCCC ACCAGAAAAG GGTAGGAATG AGCAAGTTGG GAATTTTAGA CTGTCACTGC ACATGGACCT
CTGGGAAGAC GTCTGGCGAG AGCTAGGCCC ACTGGCCCTA CAGACGGATC TTGCTGGCTC ACCTGTCCCT
GTGGAGGTTC CCCTGGGAAG GCAAGATGCC CAACAACAGC ACTGCTCTGT CATTGGCCAA TGTTACCTAC
ATCACCATGG AAATTTTCAT TGGACTCTGC GCCATAGTGG GCAACGTGCT GGTCATCTGC GTGGTCAAGC
TGAACCCCAG CCTGCAGACC ACCACCTTCT ATTTCATTGT CTCTCTAGCC CTGGCTGACA TTGCTGTTGG
GGTGCTGGTC ATGCCTTTGG CCATTGTTGT CAGCCTGGGC ATCACAATCC ACTTCTACAG CTGCCTTTTT
ATGACTTGCC TACTGCTTAT CTTTACCCAC GCCTCCATCA TGTCCTTGCT GGCCATCGCT GTGGACCGAT
ACTTGCGGGT CAAGCTTACC GTCAGGTAGC CTGCGGCGTG GGGTGGGCAG CAATTGAGGC AGCTGGGAAA
TGAGGCTACA AAGCCAGAGC TGCTGAATT TTATTTTGGA CTGTACATAT TTAGATGCTT AAGGTAAAAA
TGATAAAGCC CTCAAGCCAC TGTGTGGGTT GGGTCCAAGT GTTCCTTGCT GCTGCCTCTC TAACACGCCT
GGTTAAAATA ATCCCTTTGG ATGGTGCTGA GAAGCACCTG AACCAAGTGG GTCCCCAAAT AACTATGGCG
TGCAAGTGTC TGGTTCCCAG AAGTTGGTGA CTAGGTAAGC GACTCAGGGA GAGGGGCTGA TTCCCAGACA
GTCGCCTGTT CCTGCTGGGA TGGGGCTGAG GCTTGGGGAA TGTGGGCAGG AGGATATGCC ATTTGATTCT
GTTGCACACG TTCTTTTCCC TTCTTTCTGT ATGTCTGGTC ATTCTGCTAT TCTGTCGTTC CTCACATAGG
TTGGACATTG GCCGGCTGCC AGCATAAGTG CCAGTGTGAT TTTGCTAGGG TGTGAGCTGA GAAAGAGAGG
TGGAGGCTAA GCAGGTGTGA TGCTTCTCAG AGGTGCTGAG TTTTTGCCCT TCTGAGCAGG GAATCTTTGC
TTATCCCTTT GACCAAGGAT CTTTGCTCCA AAGGCTGGGT ATCGGCTGTG CTCAGCAAAG CGTCAACTCG
TGCAAGAACT TAGCAGGAAT AGTTCTGGCT AAGGTTAGGA GGCTGCCACC AAAGTCTCTT TTTTGTTCCT
CTGCTTCTCC CGTTTGCCTC CTTATCATGA GATCTTTTTG CTAAGCTGGC AGAAAGATTG CATAATCAGT
GCTTCCAGCT CCGCTCCCAC CTGATCCTGC ACTGTCCTCT GGTCCCTGAA TGAATGAACT CTGATACCCA
ATCTTGTCTC GAGCCTTCTC TATGCCACTC ATGGCTCCTC TTCTGCTCTT TCCATCTTTT TGCTGAGAGT
TACTGAGCTC TGTACTTCCT CTTGGCCCAT CTCACTTCCT GAAACACCCC TGAAGAGGGT TGCTTATCTT
GATGGAACTC AAAAAGCCAA AAAGCTGCAG GCAGAGGCGT TGAGGACATC TGTTTGGGGA ACTAAGAGCA
GCAGCACTTT CAGATTCAGT CCATATAGAG CTGTCCTACA GCATTCTGGA ACTTGAGGA TGTGCGGTGC
ATAAAGGGGC TGGAAGTGAC CCACCTGTGA TGAGCCCTTT CTAAGGAGAA GGGTTTCCAA GAGATCACCC
CACCAGAAAA GGGTAGGAAT GAGCAAGTTG GAATTTTAG ACTGTCACTG CACATGGACC TCTGGGAAGA
CGTCTGGCGA GAGCTAGGCC CACTGGCCCT ACAGACGGAT CTTGCTGGCT CACCTGTCCC TGTGGAGGTT
CCCCTGGGAA GGCAAGATGC CCAACAACAG CACTGCTCTG CGAATTCGGG GGACATCTGT TTGGGGAACT
AAGAGCAGCA GCACTTTCAG ATTCAGTCCA TATAGAGCTG TCCTACAGCA TTCTGGAAAC TTGAGGATGT
GCGGTGCATA AACGGGCTGG AAGTGACCCA CCTGTGATGA GCCCTTTCTA AGGAGAAGGG TTTCCAAGAG
```

ATCACCCCAC CAGAAAAGGG TAGGAATGAG CAAGTTGGGA ATTTTAGACT GTCACTGCAC ATGGACCTCT
GGGAAGACGT CTGGCGAGAG CTAGGCCCAC TGGCCCTACA GACGGATCTT GCTGGCTCAC CTGTCCCTGT
GGAGGTTCCC CTGGGAAGGC AAGATGCCCA ACAACAGCAC TGCTCTGTCA TTGGCCAATG TTACCTACAT
CACCATGGAA ATTTTCATTG GACTCTGCGC CATAGTGGGC AACGTGCTGG TCATCTGCGT GGTCAAGCTG
AACCCCAGCC TGCAGACCAC CACCTTCTAT TTCATTGTCT CTCTAGCCCT GGCTGACATT GCTGTTGGGG
TGCTGGTCAT GCCTTTGGCC ATTGTTGTCA GCCTGGGCAT CACAATCCAC TTCTACAGCT GCCTTTTTAT
GACTTGCCTA CTGCTTATCT TTACCCACGC CTCCATCATG TCCTTGCTGG CCATCGCTGT GGACCGATAC
TTGCGGGTCA AGCTTACCGT CAGATACAAG AGGGTCACCA CTCACAGAAG AATATGGCTG GCCCTGGGCC
TTTGCTGGCT GGTGTCATTC CTGGTGGGAT TGACCCCCAT GTTTGGCTGG AACATGAAAC TGACCTCAGA
GTACCACAGA AATGTCACCT TCCTTTCATG CCAATTTGTT TCCGTCATGA GGATGGACTA CATGGTATAC
TTCAGCTTCC TCACCTGGAT TTTCATCCCC CTGGTTGTCA TGTGCGCCAT CTATCTTGAC ATCTTTTACA
TCATTCGGAA CAAACTCAGT CTGAACTTAT CTAACTCCAA AGAGACAGGT GCATTTTATG ACGGGAGTT
CAAGACGGCT AAGTCCTTGT TTCTGGTTCT TTTCTTGTTT GCTCTGTCAT GGCTGCCTTT ATCTCTCATC
AACTGCATCA TCTACTTTAA TGGTGAGGTA CCACAGCTTG TGCTGTACAT GGGCATCCTG CTGTCCCATG
CCAACTCCAT GATGAACCCT ATCGTCTATG CCTATAAAAT AAAGAAGTTC AAGGAAACCT ACCTTTTGAT
CCTCAAAGCC TGTGTGGTCT GCCATCCCTC TGATTCTTTG GACACAAGCA TTGAGAAGAA TTCTGAGTAG
TTATCCATCA GAGATGACTC TGTCTCATTG ACCTTCAGAT TCCCCATCAA CAAACACTTG AGGGCCTGTA
TGCCTGGGCC AAGGGATTTT ACATCCTTG ATTACTTCCA CTGAGGTGGG AGCATCTCCA GTGCTCCCCA
ATTATATCTC CCCCACTCCA CTACTCTCTT CCTCCACTTC ATTTTTCCTT TGTCCTTTCT CTCTAATTCA
GTGTTTTGGA GGCCTGACTT GGGGACAACG TATTATTGAT ATTATTGTCT GTTTTCCTTC TTCCCAATAG
AAGAATAAGT CATGGAGCCT GAAGGGTGCC TAGTTGACTT ACTGACAAAA GGCTCTAGTT GGGCTGAACA
TGTGTGTGGT GGTGACTCAT TTCCATGCCA TTGTGGAATT GAGCAGAGAA CCTGCTCTCG GAGGATGCCT
AGGAGATGTT GGGAACAGAA GAAATAAACT GAGTTTAAGG GGGACTTAAA CTGCTGAATT C-3' (FRAG.
NO: 1675) (SEQ. ID NO: 3007)
5'-CGAATTCGGG GGACATCTGT TTGGGGAACT AAGAGCAGCA GCACTTTCAG ATTCAGTCCA TATAGAGCTG
TCCTACAGCA TTCTGGAAAC TTGAGGATGT GCGGTGCATA AACGGGCTGG AAGTGACCCA CCTGTGATGA
GCCCTTTCTA AGGAGAAGGG TTTCCAAGAG ATCACCCCAC CAGAAAAGGG TAGGAATGAG CAAGTTGGGA
ATTTTAGACT GTCACTGCAC ATGGACCTCT GGGAAGACGT CTGGCGAGAG CTAGGCCCAC TGGCCCTACA
GACGGATCTT GCTGGCTCAC CTGTCCCTGT GGAGGTTCCC CTGGGAAGGC AAGATGCCCA ACAACAGCAC
TGCTCTGTCA TTGGCCAATG TTACCTACAT CACCATGGAA ATTTTCATTG GACTCTGCGC CATAGTGGGC
AACGTGCTGG TCATCTGCGT GGTCAAGCTG AACCCCAGCC TGCAGACCAC CACCTTCTAT TTCATTGTCT
CTCTAGCCCT GGCTGACATT GCTGTTGGGG TGCTGGTCAT GCCTTTGGCC ATTGTTGTCA GCCTGGGCAT
CACAATCCAC TTCTACAGCT GCCTTTTTAT GACTTGCCTA CTGCTTATCT TTACCCACGC CTCCATCATG
TCCTTGCTGG CCATCGCTGT GGACCGATAC TTGCGGGTCA AGCTTACCGT CAGATACAAG AGGGTCACCA
CTCACAGAAG AATATGGCTG GCCCTGGGCC TTTGCTGGCT GGTGTCATTC CTGGTGGGAT TGACCCCCAT
GTTTGGCTGG AACATGAAAC TGACCTCAGA GTACCACAGA AATGTCACCT TCCTTTCATG CCAATTTGTT
TCCGTCATGA GGATGGACTA CATGGTATAC TTCAGCTTCC TCACCTGGAT TTTCATCCCC CTGGTTGTCA
TGTGCGCCAT CTATCTTGAC ATCTTTTACA TCATTCGGAA CAAACTCAGT CTGAACTTAT CTAACTCCAA
AGAGACAGGT GCATTTTATG ACGGGAGTT CAAGACGGCT AAGTCCTTGT TTCTGGTTCT TTTCTTGTTT
GCTCTGTCAT GGCTGCCTTT ATCTCTCATC AACTGCATCA TCTACTTTAA TGGTGAGGTA CCACAGCTTG

TGCTGTACAT GGGCATCCTG CTGTCCCATG CCAACTCCAT GATGAACCCT ATCGTCTATG CCTATAAAAT
AAAGAAGTTC AAGGAAACCT ACCTTTTGAT CCTCAAAGCC TGTGTGGTCT GCCATCCCTC TGATTCTTTG
GACACAAGCA TTGAGAAGAA TTCTGAGTAG TTATCCATCA GAGATGACTC TGTCTCATTG ACCTTCAGAT
TCCCCATCAA CAAACACTTG AGGGCCTGTA TGCCTGGGCC AAGGGATTTT TACATCCTTG ATTACTTCCA
CTGAGGTGGG AGCATCTCCA GTGCTCCCCA ATTATATCTC CCCCACTCCA CTACTCTCTT CCTCCACTTC
ATTTTTCCTT TGTCCTTTCT CTCTAATTCA GTGTTTTGGA GGCCTGACTT GGGGACAACG TATTATTGAT
ATTATTGTCT GTTTTCCTTC TTCCCAATAG AAGAATAAGT CATGGAGCCT GAAGGGTGCC TAGTTGACTT
ACTGACAAAA GGCTCTAGTT GGGCTGAACA TGTGTGTGGT GGTGACTCAT TTCCATGCCA TTGTGGAATT
GAGCAGAGAA CCTGCTCTCG GAGGATGCCT AGGAGATGTT GGGAACAGAA GAAATAAACT GAGTTTAAGG
GGGACTTAAA CTGCTGAATT C-3' (FRAG. NO: _) (SEQ. ID NO: 2439)
5'-CTGCTGAATT TTATTTTGGA CTGTACATAT TTAGATGCTT AAGGTAAAAA TGATAAAGCC CTCAAGCCAC
TGTGTGGGTT GGGTCCAAGT GTTCCTTGCT GCTGCCTCTC TAACACGCCT GGTTAAAATA ATCCCTTTGG
ATGGTGCTGA GAAGCACCTG AACCAAGTGG GTCCCCAAAT AACTATGCGC TGCAAGTGTC TGGTTCCCAG
AAGTTGGTGA CTAGGTAAGC GACTCAGGGA GAGGGCTGA TTCCCAGACA GTCGCCTGTT CCTGCTGGGA
TGGGGCTGAG GCTTGGGAA TGTGGGCAGG AGGATATGCC ATTTGATTCT GTTGCACACG TTCTTTTCCC
TTCTTTCTGT ATGTCTGGTC ATTCTGCTAT TCTGTCGTTC CTCACATAGG TTGGACATTG GCCGGCTGCC
AGCATAAGTG CCAGTGTGAT TTTGCTAGGG TGTGAGCTGA GAAAGAGAGG TGGAGGCTAA GCAGGTGTGA
TGCTTCTCAG AGGTGCTGAG TTTTTGCCCT TCTGAGCAGG GAATCTTTGC TTATCCCTTT GACCAAGGAT
CTTTGCTCCA AAGGCTGGGT ATCGGCTGTG CTCAGCAAAG CGTCAACTCG TGCAAGAACT TAGCAGGAAT
AGTTCTGGCT AAGGTTAGGA GGCTGCCACC AAAGTCTCTT TTTTGTTCCT CTGCTTCTCC CGTTTGCCTC
CTTATCATGA GATCTTTTTG CTAAGCTGGC AGAAAGATTG CATAATCAGT GCTTCCAGCT CCGCTCCCAC
CTGATCCTGC ACTGTCCTCT GGTCCCTGAA TGAATGAACT CTGATACCCA ATCTTGTCTC GAGCCTTCTC
TATGCCACTC ATGGCTCCTC TTCTGCTCTT TCCATCTTTT TGCTGAGAGT TACTGAGCTC TGTACTTCCT
CTTGGCCCAT CTCACTTCCT GAAACACCCC TGAAGAGGGT TGCTTATCTT GATGAACTC AAAAAGCCAA
AAAGCTGCAG GCAGAGGCGT TGAGGACATC TGTTTGGGGA ACTAAGAGCA GCAGCACTTT CAGATTCAGT
CCATATAGAG CTGTCCTACA GCATTCTGGA AACTTGAGGA TGTGCGGTGC ATAAGGGGC TGGAAGTGAC
CCACCTGTGA TGAGCCCTTT CTAAGGAGAA GGGTTTCCAA GAGATCACCC CACCAGAAAA GGGTAGGAAT
GAGCAAGTTG GGAATTTTAG ACTGTCACTG CACATGGACC TCTGGGAAGA CGTCTGGCGA GAGCTAGGCC
CACTGGCCCT ACAGACGGAT CTTGCTGGCT CACCTGTCCC TGTGGAGGTT CCCCTGGGAA GGCAAGATGC
CCAACAACAG CACTGCTCTG-3' (FRAG. NO: _) (SEQ. ID NO: 2438)
5'-GAATTCCCAG ATGGGCAGAG GTGGCTGGGC TGGTGACCCT AAGTGTGTCT CCTGCCTTTA TTCTCTCTAG
TGGGTTATTC TTTCATGTGG TATCTTGCCT ACAGCATGCT GTGTTGGAC ACAAACCCCT TTCCTTGGTT
TCTCTGACCC AGCTGAGATG GACTGATTCC AAAAGAACTC ACCTATGTAC TGGGGTAGGG GAGGGAGGGT
TTTTTGCAGT ATTTAACTAA GGTTCAAAGA GTGCTATATA GTGAGAAAGG CTTCTTTTTT TTTTTTTTT
TTTTTTGGCA GAGTGCTGCC TCCTAGAAAT TTCTCTTGGT AACTTCCTTC TCTGAAGCAC AGATAAAGAA
AACAATTACA GTAGAAACAT TTATGAGGGA CACATTGGAG GCCGATGAAG CTTTTCAAGT TCCAGCAGTG
CAGGGATGTG GGCAGAACTG ACATTGGAAA ATACTAGAAT GATGGAAATT CAGTTGGAGA GGACTGCCCT
TTTTAATGTC TGGGGAGTCT GCTCAGGGAG AAATGACAAG TCTGGCGGGG ACAAGTATGG GATTTGGTAA
GACTTGGATC AACTTGGGAT ACAGGGTGGG GGTCGGGAGT GGAATCAATG AATGATGCCA GAGCAGATCA

-continued

ACTAACAAGA GGACCCTGAT GAGCCCCAGG CAGAGGCGTC TCCCTTATGC CCCACTCTGA AGTGTTTGTT
AGTAAACACC AGAACGCCAT TGTTGTTACT GCTGAATTTT ATTTTGGGCT GTACATATTT AGATGCTTAA
GGTAAAAATG ATAAAGCCCT CAAGCCACTG TGTGGGTTTG GGTCCAAGTG TTCCTTCTTG CTGCCTCTCT
AACACGCCTG GTTAAAATAA TCCCTTTGGA TGGTGCTGAG AAGCACCTGA ACCAAGTGGG TCCCCAAATA
ACAATGGCGT GCAAGTGTCT GGTTCCCAGA AGTTGGTGAC TAGGTAAGCA GCTTCAGGGA GAGGGGCTG
ATTCCCAGAC AGTCGCCTGT TCCTGCGGGG ATGGGGCTGA GGCTTGGGGA ATGTGGGCAG GAGGATATGC
CATTTGATTC TGTTGCACAC GTTCTTTTCC CTTCTTTCTG TATGTCTGGT CATTCTGCTA TTCTGTCGTT
CCTCACATAG GTTGGACATT GGCCGGCTGC CAGCATAAGT GCCAGTGTGA TTTTGCTAGG TGTGAGCTGA
GAAAGAGAGG TGGAGGCTAA GCAGGTGTGA TGCTTCTCAG AGGTGCTGAG TTTTTGCCCT TCTGAGCAGG
GAATCTTTGC TTATCCCTTT GACCAAGGAT CTTTGCTGCA AAGGCTGGGT ATCGGCTGTG CTCAGCAAAG
CGTCAACTCG TGCAAGAACT TAGCAGGAAT AGTTCTGGCT AAGGTTAGGA GGCTGCCACC AAAGTCTCTT
TTTTGTTCCT CTGCTTCTCC CGTTTGCCTC CTTATCATGA GATCTTTTTG CTAAGCTGGC AGAAAGATTG
CATAGTCAGT GCTTCCAGCT CTGCTCCCAC CTGATCCTGC ACTGTCCTCT GGTCCCTGAA TGAATGAACT
CTGATACCCA ATCTTGTCTC GAGCCTTCTC TATGCCACTC ATGGCTCCTC TTCTGCTCTT TCCATCTTTT
TGCTGAGAGT TCTGAGCTCT GTACTTCCTC TTGGCCCATC TCACTTCCTG AAACACCCCT GAAGAGGGTT
GCTTATCTTG ATGGAACTCA AAAAGCCAAA AAGCTGCAGG CAGAGGCGTT GAGGACATCT GTTTGGGGAA
CTAAGAGCAG CAGCACTTTC AGATTCAGTC CATATAGAGC TGTCCTACAG CATTCTGGAA ACTTGAGGAT
GTGCGGTGCA TAAAGGGGCT GGAAGTGACC CACCTGTGAT GAGCCCTTTC TAAGGAGAAG GGTTTCCAAG
AGATCACCCC ACCAGAAAAG GGTAGGAATG AGCAAGTTGG GAATTTTAGA CTGTCACTGC ACATGGACCT
CTGGGAAGAC GTCTGGCGAG AGCTAGGCCC ACTGGCCCTA CAGACGGATC TTGCTGGCTC ACCTGTCCCT
GTGGAGGTTC CCCTGGGAAG GCAAGATGCC CAACAACAGC ACTGCTCTGT CATTGGCCAA TGTTACCTAC
ATCACCATGG AAATTTTCAT TGGACTCTGC GCCATAGTGG GCAACGTGCT GGTCATCTGC GTGGTCAAGC
TGAACCCCAG CCTGCAGACC ACCACCTTCT ATTTCATTGT CTCTCTAGCC CTGGCTGACA TTGCTGTTGG
GGTGCTGGTC ATGCCTTTGG CCATTGTTGT CAGCCTGGGC ATCACAATCC ACTTCTACAG CTGCCTTTTT
ATGACTTGCC TACTGCTTAT CTTTACCCAC GCCTCCATCA TGTCCTTGCT GGCCATCGCT GTGGACCGAT
ACTTGCGGGT CAAGCTTACC GTCAGGTAGC CTGCGGCGTG GGGTGGGCAG CAATTGAGGC AGCTGGGAAA
TGAGGCTACA AAGCCAGAGC-3' (FRAG. NO: _) (SEQ. ID NO: 2437)
5'-CGAATTCGGG GGACATCTGT TTGGGGAACT AAGAGCAGCA GCACTTTCAG ATTCAGTCCA TATAGAGCTG
TCCTACAGCA TTCTGGAAAC TTGAGGATGT GCGGTGCATA AACGGGCTGG AAGTGACCCA CCTGTGATGA
GCCCTTTCTA AGGAGAAGGG TTTCCAAGAG ATCACCCCAC CAGAAAAGGG TAGGAATGAG CAAGTTGGGA
ATTTTAGACT GTCACTGCAC ATGGACCTCT GGGAAGACGT CTGGCGAGAG CTAGGCCCAC TGGCCCTACA
GACGGATCTT GCTGGCTCAC CTGTCCCTGT GGAGGTTCCC CTGGGAAGGC AAGATGCCCA ACAACAGCAC
TGCTCTGTCA TTGGCCAATG TTACCTACAT CACCATGGAA ATTTTCATTG GACTCTGCGC CATAGTGGGC
AACGTGCTGG TCATCTGCGT GGTCAAGCTG AACCCCAGCC TGCAGACCAC CACCTTCTAT TTCATTGTCT
CTCTAGCCCT GGCTGACATT GCTGTTGGGT GCTGGTCAT GCCTTTGGCC ATTGTTGTCA GCCTGGGCAT
CACAATCCAC TTCTACAGCT GCCTTTTTAT GACTTGCCTA CTGCTTATCT TTACCCACGC CTCCATCATG
TCCTTGCTGC CATCGCTGT GGACCGATAC TTGCGGGTCA AGCTTACCGT CAGATACAAG AGGGTCACCA
CTCACAGAAG AATATGGCTG GCCCTGGGCC TTTGCTGGCT GGTGTCATTC CTGGTGGGAT TGACCCCCAT
GTTTGGCTGG AACATGAAAC TGACCTCAGA GTACCACAGA AATGTCACCT TCCTTTCATG CCAATTTGTT
TCCGTCATGA GGATGGACTA CATGGTATAC TTCAGCTTCC TCACCTGGAT TTTCATCCCC CTGGTTGTCA

```
TGTGCGCCAT CTATCTTGAC ATCTTTTACA TCATTCGGAA CAAACTCAGT CTGAACTTAT CTAACTCCAA
AGAGACAGGT GCATTTTATG GACGGGAGTT CAAGACGGCT AAGTCCTTGT TTCTGGTTCT TTTCTTGTTT
GCTCTGTCAT GGCTGCCTTT ATCTCTCATC AACTGCATCA TCTACTTTAA TGGTGAGGTA CCACAGCTTG
TGCTGTACAT GGGCATCCTG CTGTCCCATG CCAACTCCAT GATGAACCCT ATCGTCTATG CCTATAAAT
AAAGAAGTTC AAGGAAACCT ACCTTTTGAT CCTCAAAGCC TGTGTGGTCT GCCATCCCTC TGATTCTTTG
GACACAAGCA TTGAGAAGAA TTCTGAGTAG TTATCCATCA GAGATGACTC TGTCTCATTG ACCTTCAGAT
TCCCCATCAA CAAACACTTG AGGGCCTGTA TGCCTGGGCC AAGGGATTTT ACATCCTTG ATTACTTCCA
CTGAGGTGGG AGCATCTCCA GTGCTCCCCA ATTATATCTC CCCCACTCCA CTACTCTCTT CCTCCACTTC
ATTTTTCCTT TGTCCTTTCT CTCTAATTCA GTGTTTTGGA GGCCTGACTT GGGGACAACG TATTATTGAT
ATTATTGTCT GTTTTCCTTC TTCCCAATAG AAGAATAAGT CATGGAGCCT GAAGGGTGCC TAGTTGACTT
ACTGACAAAA GGCTCTAGTT GGGCTGAACA TGTGTGTGGT GGTGACTCAT TTCCATGCCA TTGTGAATT
GAGCAGAGAA CCTGCTCTCG GAGGATGCCT AGGAGATGTT GGGAACAGAA GAAATAAACT GAGTTTAAGG
GGGACTTAAA CTGCTGAATT C-3' (FRAG. NO: _) (SEQ. ID NO: 2427)
5'-TTCCCAG ATGGGCAGAG GTGGCTGGGC TGGTGACCCT AAGTGTGTCT CCTGCCTTTA TTCTCTCTAG
TGGGTTATTC TTTCATGTGG TATCTTGCCT ACAGCATGCT GTGTTTGGAC ACAAACCCCT TTCCTTGGTT
TCTCTGACCC AGCTGAGATG GACTGATTCC AAAAGAACTC ACCTATGTAC TGGGGTAGGG GAGGGAGGGT
TTTTTGCAGT ATTTAACTAA GGTTCAAAGA GTGCTATATA GTGAGAAAGG CTTCTTTTT TTTTTTTTT
TTTTTTGGCA GAGTGCTGCC TCCTAGAAAT TTCTCTTGGT AACTTCCTTC TCTGAAGCAC AGATAAAGAA
AACAATTACA GTAGAAACAT TTATGAGGGA CACATTGGAG GCCGATGAAG CTTTTCAAGT TCCAGCAGTG
CAGGGATGTG GCAGAACTG ACATTGGAAA ATACTAGAAT GATGGAAATT CAGTTGGAGA GGACTGCCCT
TTTTAATGTC TGGGGAGTCT GCTCAGGGAG AAATGACAAG TCTGGCGGGG ACAAGTATGG GATTTGGTAA
GACTTGGATC AACTTGGGAT ACAGGGTGGG GGTCGGGAGT GGAATCAATG AATGATGCCA GAGCAGATCA
ACTAACAAGA GGACCCTGAT GAGCCCCAGG CAGAGGCGTC TCCCTTATGC CCCACTCTGA AGTGTTTGTT
AGTAAACACC AGAACGCCAT TGTTGTTACT GCTGAATTTT ATTTTGGGCT GTACATATTT AGATGCTTAA
GGTAAAAATG ATAAAGCCCT CAAGCCACTG TGTGGGTTTG GGTCCAAGTG TTCCTTCTTG CTGCCTCTCT
AACACGCCTG GTTAAAATAA TCCCTTTGGA TGGTGCTGAG AAGCACCTGA ACCAAGTGGG TCCCCAAATA
ACAATGGCGT GCAAGTGTCT GGTTCCCAGA AGTTGGTGAC TAGGTAAGCA GCTTCAGGGA GAGGGGCTG
ATTCCCAGAC AGTCGCCTGT TCCTGCGGGG ATGGGCTGA GGCTTGGGA ATGTGGGCAG GAGGATATGC
CATTTGATTC TGTTGCACAC GTTCTTTTCC CTTCTTTCTG TATGTCTGGT CATTCTGCTA TTCTGTCGTT
CCTCACATAG GTTGGACATT GGCCGGCTGC CAGCATAAGT GCCAGTGTGA TTTTGCTAGG TGTGAGCTGA
GAAAGAGAGG TGGAGGCTAA GCAGGTGTGA TGCTTCTCAG AGGTGCTGAG TTTTTGCCCT TCTGAGCAGG
GAATCTTTGC TTATCCCTTT GACCAAGGAT CTTTGCTGCA AAGCTGGGT ATCGGCTGTG CTCAGCAAAG
CGTCAACTCG TGCAAGAACT TAGCAGGAAT AGTTCTGGCT AAGGTTAGGA GGCTGCCACC AAAGTCTCTT
TTTTGTTCCT CTGCTTCTCC CGTTTGCCTC CTTATCATGA GATCTTTTTG CTAAGCTGGC AGAAAGATTG
CATAGTCAGT GCTTCCAGCT CTGCTCCCAC CTGATCCTGC ACTGTCCTCT GGTCCCTGAA TGAATGAACT
CTGATACCCA ATCTTGTCTC GAGCCTTCTC TATGCCACTC ATGGCTCCTC TTCTGCTCTT TCCATCTTTT
TGCTGAGAGT TCTGAGCTCT GTACTTCCTC TTGGCCCATC TCACTTCCTG AAACACCCCT GAAGAGGGTT
GCTTATCTTG ATGGAACTCA AAAAGCCAAA AAGCTGCAGG CAGAGGCGTT GAGGACATCT GTTTGGGAA
CTAAGAGCAG CAGCACTTTC AGATTCAGTC CATATAGAGC TGTCCTACAG CATTCTGGAA ACTTGAGGAT
```

```
GTGCGGTGCA TAAAGGGGCT GGAAGTGACC CACCTGTGAT GAGCCCTTTC TAAGGAGAAG GGTTTCCAAG
AGATCACCCC ACCAGAAAAG GGTAGGAATG AGCAAGTTGG GAATTTTAGA CTGTCACTGC ACATGGACCT
CTGGGAAGAC GTCTGGCGAG GCTAGGCCC ACTGGCCCTA CAGACGGATC TTGCTGGCTC ACCTGTCCCT
GTGGAGGTTC CCTGGGAAG GCAAGATGCC CAACAACAGC ACTGCTCTGT CATTGGCCAA TGTTACCTAC
TCACCATGG AAATTTTCAT TGGACTCTGC GCCATAGTGG GCAACGTGCT GGTCATCTGC GTGGTCAAGC
TGAACCCCAG CCTGCAGACC ACCACCTTCT ATTTCATTGT CTCTCTAGCC TGGCTGACA TTGCTGTTGG
GGTGCTGGTC ATGCCTTTGG CCATTGTTGT CAGCCTGGGC TCACAATCC ACTTCTACAG CTGCCTTTTT
ATGACTTGCC TACTGCTTAT CTTTACCCAC CCTCCATCA TGTCCTTGCT GGCCATCGCT GTGGACCGAT
ACTTGCGGGT CAAGCTTACC GTCAGGTAGC CTGCGGCGTG GGGTGGGCAG CAATTGAGGC AGCTGGGAAA
TGAGGCTACA AGCCAGAGC-3'   (FRAG. NO: _)   (SEQ. ID NO: 2426)
5'-GGCAATTTG TTAGTTATCC GCCGCCACCA AGACGCGGCA CGGCGCCTGG ACCGGAGGGG CCCCGCGCGG
GCGCGAACTT TGGGCTCGGG CGAGTGGGTG GTGCTCCGCC CAGCCCGAGA CGGGCGGGCG CGCGGGCCAA
TGGGTGCCGC CTCTTGGCCG CGGGGGGCCC CGACCCGTGG GTCCCGGCCA CCAGCGCCCC AGCCCCGAGG
CTCAGAAGCG GCAGGCGGAG GCGCGGTCCG GGCGCTATGG CCATGCCCGG CGGGTCTCAC GCGGCTGCCC
CTCGCCCGGC GCGCCTTCGG TAGGGGCGC CCGGGGCCCA GCTGGCCCGG CCATGCTGCT GGAGACACAG
GACGCGCTGT ACGTGGCGCT GGAGCTGGTC ATCGCCGCGC TTTCGGTGGC GGGCAACGTG CTGGTGTGCG
CCGCGGTGGG CACGGCGAAC ACTCTGCAGA CGCCCACCAA CTACTTCCTG GTGTCCCTGG CTGCGGCCGA
CGTGGCCGTG GGGCTCTTCG CCATCCCCTT TGCCATCACC ATCAGCCTGG GCTTCTGCAC TGACTTCTAC
GGCTGCCTCT TCCTCGCCTG CTTCGTGCTG GTGCTCACGC AGAGCTCCAT CTTCAGCCTT CTGGCCGTGG
CAGTCGACAG ATACCTGGCC ATCTGTGTCC CGCTCAGGTA TAAAAGTTTG GTCACGGGGA CCCGAGCAAG
AGGGGTCATT GCTGTCCTCT GGGTCCTTGC CTTTGGCATC GGATTGACTC CATTCCTGGG GTGGAACAGT
AAAGACAGTG CCACCAACAA CTGCACAGAA CCCTGGGATG GAACCACGAA TGAAAGCTGC TGCCTTGTGA
AGTGTCTCTT TGAGAATGTG GTCCCCATGA GCTACATGGT ATATTTCAAT TTCTTTGGGT GTGTTCTGCC
CCCACTGCTT ATAATGCTGG TGATCTACAT TAAGATCTTC CTGGTGGCCT GCAGGCAGCT TCAGCGCACT
GAGCTGATGG ACCACTCGAG GACCACCCTC CAGCGGGAGA TCCATGCAGC CAAGTCACTG GCCATGATTG
TGGGGATTTT TGCCCTGTGC TGGTTACCTG TGCATGCTGT TAACTGTGTC ACTCTTTTCC AGCCAGCTCA
GGGTAAAAAT AAGCCCAAGT GGGCAATGAA TATGGCCATT CTTCTGTCAC ATGCCAATTC AGTTGTCAAT
CCCATTGTCT ATGCTTACCG GAACCGAGAC TTCCGCTACA CTTTTCACAA AATTATCTCC AGGTATCTTC
TCTGCCAAGC AGATGTCAAG AGTGGGAATG GTCAGGCTGG GGTACAGCCT GCTCTCGGTG TGGGCCTATG
ATCTAGGCTC TCGCCTCTTC CAGGAGAAGA TACAAATCCA CAAGAAACAA AGAGGACACG GCTGGTTTTC
ATTGTGAAAG ATAGCTACAC CTCACAAGGA AATGGACTGC CTCTCTTGAG CACTTCCCTG GAGCTACCAC
GTATCTAGCT AATATGTATG TGTCAGTAGT AGGCTCCAAG GATTGACAAA TATATTTATG ATCTATTCAG
CTGCTTTTAC TGTGTGGATT ATGCCAACAG CTTGAATGGA TTCTAACAGA CTCTTTTGTT TTTAAAAGTC
TGCCTTGTTT ATGGTGGAAA ATTACTGAAA CTATTTTACT GTGAAACAGT GTGAACTATT ATAATGCAAA
TACTTTTTAA CTTAGAGGCA ATGGAAAAAT AAAAGTTGAC TGTACTAAAA ATG-3'   (FRAG. NO: _)   (SEQ. ID NO: 2425)
5'-GBG CB TGC-3'   (FRAG. NO: 1676)   (SEQ. ID NO: 1691)
5'-TTG TTG GGC-3'   (FRAG. NO: 1677)   (SEQ. ID NO: 1692)
5'-TGC CTT CCC BGG G-3'   (FRAG. NO: 1678)   (SEQ. ID NO: 1693)
5'-GTT GTT GGG CAT CTT GCC-3'   (FRAG. NO: 1679)   (SEQ. ID NO: 3)
5'-GTG GGC CTA GCT CTC GCC-3'   (FRAG. NO: 1680)   (SEQ. ID NO: 5)
```

5'-ACA GAG CA TGC TGT TGT TGG GCA TCT TGC CTT CCC AGG G-3' (FRAG 982) (SEQ. ID NO: 992)

5'-BCB GBG CB TGC TGT TGT TGG GCB TCT TGC CTT CCC BGG G-3' (FRAG 983) (SEQ. ID NO: 993)

5'-CCC TTT TCT GGT GGG GTG-3' (FRAG 984) (SEQ. ID NO: 994)

5'-GTG CTG TTG TTG GGC-3' (FRAG 985) (SEQ. ID NO: 995)

5'-TTT CTT CTG TTC CC-3' (FRAG 986) (SEQ. ID NO: 996)

5'-CCC TTT TCT GGT GGG GTG-3' (FRAG 987) (SEQ. ID NO: 997)

5'-GTG CTG TTG TTG GGC-3' (FRAG 988) (SEQ. ID NO: 998)

5'-TTT CTT CTG TTC CC-3' (FRAG 989) (SEQ. ID NO: 999)

Human IgE Receptor β Nucleic Acid and Antisense Oligonucleotide Fragments

5'-TTT CCC CTG GGT CTT CC CTC CTG CTC TTT TTT C ATT TGC TCT CCT ATT ACT TTC TGT GTC CAT TTT TTC ATT AAC CGA GCT GT BTT TGC TCT CCT BTT BCT TTC TGT GTC CBT TTT TTC BTT BBC CGB GCT GT-3' (FRAG. NO: 1681) (SEQ. ID NO: 1694)

5'-CCC CTG GG-3' (FRAG. NO: 1682) (SEQ. ID NO: 1695)

5'-GCTCTCCTBTT-3' (FRAG. NO: 1683) (SEQ. ID NO: 1696)

5'-CBTTBBCCGBGCTG-3' (FRAG. NO: 1684) (SEQ. ID NO: 1697)

5'-TTT CCC CTG GGT CTT CC-3' (FRAG 990) (SEQ. ID NO: 1000)

5'-CTC CTG CTC TTT TTT C-3' (FRAG 991) (SEQ. ID NO: 1001)

ATTTGCTCTCCTATTACTTTCTGTGTCCATTTTTTCATTAACCGAGCTGT (FRAG 992) (SEQ. ID NO: 1002)

BTTTGCTCTCCTBTTBCTTTCTGTGTCCBTTTTTTCBTTBBCCGBGCTGT (FRAG 993) (SEQ. ID NO: 1003)

Human Fc-ε Receptor CD23 Antigen (IgE Receptor)

Nucleic Acid and Antisense Oligonucleotide Fragments

5'-GCC TGT GTC TGT CCT CCT GCT TCG TTC CTC TCG TTC CTG CTT GGT GCC CTT GCC G GTC CTG CTC CTC CGG GCT GTG G GTC GTG GCC CTG GCT CCG GCT GGT GGG CTC CCC TGG CCT TCG CTG GCT GGC GGC GTG C GGG TCT TGC TCT GGG CCT GGC TGT GGC CGT GGT TGG GGG TCT TC GCT GCC TCC GTT GGG TGG GC TCT CTG AAT ATT GAC CTT CCT CCA TGG CGG TCC TGC TTG GAT TCT CCC GA TCT CTG BBT BTT GBC CTT CCT CCB TGG CGG TCC TGC TTG GBT TCT CCC GB-3' (FRAG 1685) (SEQ. ID NO: 1698)

5'-GT CCT CCT-3' (FRAG 1686) (SEQ. ID NO: 1699)

5'-TGT GTC TGT CCT CC-3' (FRAG 1687) (SEQ. ID NO: 1700)

5'-GTG GCC CTG GC-3' (FRAG 1688) (SEQ. ID NO: 1701)

5'-CGT GGT TGG GG-3' (FRAG 1689) (SEQ. ID NO: 1702)

5'-TCT CTG BBT BTT GBC C-3' (FRAG 1690) (SEQ. ID NO: 1703)

5'-GCC TGT GTC TGT CCT CCT-3' (FRAG 994) (SEQ. ID NO: 1004)

5'-GCT TCG TTC CTC TCG TTC-3' (FRAG 995) (SEQ. ID NO: 1005)

5'-CTG CTT GGT GCC CTT GCC G-3' (FRAG 996) (SEQ. ID NO: 1006)

5'-GTC CTG CTC CTC CGG GCT GTG G-3' (FRAG 997) (SEQ. ID NO: 1007)

5'-GTC GTG GCC CTG GCT CCG GCT GGT GGG CTC CCC TGG-3' (FRAG 998) (SEQ. ID NO: 1008)

5'-CCT TCG CTG GCT GGC GGC GTG C-3' (FRAG 999) (SEQ. ID NO: 1009)

5'-GGG TCT TGC TCT GGG CCT GGC TGT-3' (FRAG 1000) (SEQ. ID NO 1010)

5'-GGC CGT GGT TGG GGG TCT TC-3' (FRAG 1001) (SEQ. ID NO: 1011)

-continued

5'-GCT GCC TCC GTT TGG GTG GC (FRAG 1002) (SEQ. ID NO: 1012)

5'-TCT CTG AAT ATT GAC CTT CCT CCA TGG CGG TCC TGC TTG GAT TCT CCC GA (FRAG 1003) (SEQ. ID NO: 1013)

5'-TCT CTG BBT BTT GBC CTT CCT CCB TGG CGG TCC TGC TTG GBT TCT CCC GB (FRAG 1004) (SEQ. ID NO: 1014)

Human IgE Receptor α Subunit Nucleic Acid and Antisense Oligonucleotide Fragments 5'-GCC TTT CCT GGT TCT CTT GTT GTT TTT GGG GTT TGG CTT ACA GTA GAG TAG GGG ATT CCA TGG CAG GAG CCA TCT TCT TCA TGG ACT CC TTC AAG GAG ACC TTA GGT TTC TGA GGG ACT GCT AAC ACG CCA TCT GGA GC BCB GTB GBG TBG GGG BTT CCB TGG CBG GBG CCB TCT TCT TCB TGG BCT CC TTC BBG GBG BCC TTB GGT TTC TGB GGG BCT GCT BBC BCG CCB TCT GGB GC GTT GTT TTT GGG GTT TGG CTT GCC TTT CCT GGT TCT CTT BCB GTB GBG TBG GGG BTT CCB TGG CBG GBG CCB TCT TCT TCB TGG BCT CC TTC BBG GBG BCC TTB GGT TTC TGB GGG BCT GCT BBC BCG CCB TCT GGB GC-3' (FRAG. NO: 1691) (SEQ. ID NO: 1704)

5'-TGG BCT CC-3' (FRAG. NO: 1692) (SEQ ID NO: 1705)

5'-CCB TCT GGB-3' (FRAG. NO: 1693) (SEQ. ID NO: 1706)

5'-CT GCT BBC BCG-3' (FRAG. NO: 1694) (SEQ. ID NO: 1707)

5'-GTT TTT GGG GTT TG-3' (FRAG. NO: 1695) (SEQ. ID NO: 1708)

5'-GCC TTT CCT GGT TCT CTT GTT GTT TTT GGG GTT TGG CTT-3' (FRAG. NO: 1005) (SEQ. ID NO: 1015)

5'-ACAGTAGAGTAGGGGATTCCATGGCAGGAGCCATCTTCTTCATGGACTCC-3' (FRAG. NO: 1006) (SEQ. ID NO: 1016)

5'-TTC AAG GAG ACC TTA GGT TTC TGA GGG ACT GCT AAC ACG CCA TCT GGA GC-3' (FRAG. NO: 1007) (SEQ. ID NO: 1017)

5'-BCB GTB GBG TBG GGG BTT CCB TGG CBG GBG CCB TCT TCT TCB TGG BCT CC TTC BBG GBG BCC TTB GGT TTC TGB GGG-3' (FRAG. NO: 1008) (SEQ. ID NO: 1018)

5'-BCT GCT BBC BCG CCB TCT GGB GC-3' (FRAG. NO: 1009) (SEQ. ID NO: 1019)

5'-GTT GTT TTT GGG GTT TGG CTT-3' (FRAG. NO: 1010) (SEQ. ID NO: 1020)

5'-GCC TTT CCT GGT TCT CTT-3' (FRAG. NO: 1011) (SEQ. ID NO: 1021)

5'-BCBGTBGBGTBGGGGBTTCCBTGGCBGGBGCCBTCTTCTTCBTGGBCTCC-3' (FRAG. NO: 1012) (SEQ. ID NO: 1022)

5'-TTC BBG GBG BCC TTB GGT TTC TGB GGG BCT GCT BBC BCG CCB TCT GGB GC-3' (FRAG. NO: 1013) (SEQ. ID NO: 1023)

Human IgE Receptor (Fc Epsilon R) Nucleic Acid and Antisense Oligonucleotide Fragments 5'-GCC TGT GTC TGT CCT CCT GCT TCG TTC CTC TCG TTC CTG CTT GGT GCC CTT GCC G GTC CTG CTC CTC CGG GCT GTG G GTC CTC GCC CTG GCT CCG GCT GGT GGG CTC CCC TGG CCT TCG CTG GCT GGC GGC GTG C CCC BGB BCG BGB CCC GGB CCG BCB GGC CGT GGT TGG GGG TCT TC GCT GCC TCC GTT TGG GTG GC GAT CTC TGA ATA TTGA CCT TCC ATG GCG GTC CTG CTT GGA GBT CTC TGB BTB TTGB CCT TCC BTG GCG GTC CTG CTT GGB-3' (FRAG: 1696) (SEQ. ID NO: 1709)

5'-TCG TTC CTC TCG-3' (FRAG: 1697) (SEQ. ID NO: 3001)

5'-BGB BCG BGB C-3' (FRAG: 1698) (SEQ. ID NO: 1711)

5'-TGB BTB TTGB-3' (FRAG: 1699) (SEQ. ID NO: 1712)

5'-GCC TGT GTC TGT CCT CCT-3' (FRAG. NO: 1014) (SEQ. ID NO: 1024)

5'-GCT TCG TTC CTC TCG TTC-3' (FRAG. NO: 1015) (SEQ. ID NO: 1025)

5'-CTG CTT GGT GCC CTT GCC G-3' (FRAG. NO: 1016) (SEQ. ID NO: 1026)

-continued

5'-GTC CTG CTC CTC CGG GCT GTG G-3' (FRAG. NO: 1017) (SEQ. ID NO: 1027)

5'-GTC CTC GCC CTG GCT CCG GCT GGT GGG CTC CCC TGG-3' (FRAG. NO: 1018) (SEQ. ID NO: 1028)

5'-CCT TCG CTG GCT GGC GGC GTG C-3' (FRAG. NO: 1019) (SEQ. ID NO: 1029)

5'-CCC BGB BCG BGB CCC GGB CCG BCB-3' (FRAG. NO: 1020) (SEQ. ID NO: 1030)

5'-GGC CGT GGT TGG GGG TCT TC-3' (FRAG. NO: 1021) (SEQ. ID NO: 1031)

5'-GCT GCC TCC GTT TGG GTG GC-3' (FRAG. NO: 1022) (SEQ. ID NO: 1032)

5'-GBT CTC TGB BTB TTGB CCT TCC BTG GCG GTC CTG CTT GGB-3' (FRAG. NO: 1023) (SEQ. ID NO: 1033)

Human High Affinity IgE Receptor Oligonucleotide Fragments

5'-AACAAGAAAA GCGTTGGTAG CTCTGGTGAA TCCCAAAAGA ATGTGGCAGT TGCTAGCCAT GCTCCTGAAT

ATGTATAAAC AGTACATCAT ATGACTAAGA GTTTGACTTA GGGGTTAGAT TTTATGTGTT TGAACCCCAA

ATTAGTTATT TAATAGTTGG CACCCCAAAA CAAGTTACTT AACCTCACTA AGGTTCAGTT TTCCTGTTTA

TAAAATGTAG ATAGTGATAG TATGTACTTT ATAGGATTAT TGTGAAAAAT AAATGAAATA TCAGATTTAT

TTAGGATAAC ACCTGGCATA TGTTTGGTAT TCAGAATTAG TTGCTGCTGT TTTATTCTGC TCTCCCTTGC

ATCCCACTTT TCTAAGTTGT AAACTAAATA GTTGTACACA GATTGACAGA TTAAGAAAGG CTTGTGATTG

TGCTAGACCT ATGCCTATGC CTCTGTCTCA CCAGATTCCA GGTGTATATG TGGAGGTGGG ATAGGGAGTG

GAGTAAGTGG GTAAATATTA AATTGCCCAG TTGGGCACCA TCCTGAATAT TATCTCTAAA GAAAGAAGCA

AAACCAGGCA CAGCTGATGG GTTAACCAGA TATGATACAG AAAACATTTC CTTCTGCTTT TTGGTTTTAA

GCCTATATTT GAAGCCTTAG ATCTCTCCAG CACAGTAAGC ACCAGGAGTC CATGAAGAAG ATG GAT CTT CATG

TGGAATGACT GGTTTCATTC AATAGACTTA ATTCAGCAGT CTGTGGGAA GAGCAAGGTA TGATAGAATG

GTTCCTCAAG TGCTTCAGAT GTGAAGTGGG TTTAAATATA CTGTCCCTGT CTTCTTCAGA GTTTTGGTAA

AGATAAAATA GGACACTCAT TTAAAAGCAA TCTTTGCAAA TGACAAGCCA CTATAGACAT TAATAGAGTT

TTCATTTCCA GTATTATCAT TAATATCAGA TCCTGGAAGA AGGTTGAGCC TTGACCTAGA GCAAAAAAAC

AGAAGAATTA GTAAAGGAAT CCTGGAGAAA GCCCCTGCTG TGTATTTAAA GGAGAAAGGG AGATCATGTT

GGGAAATTAT AATATTAAAA GTAAACAAAA GCTAGGAAGT AAAATAAAAT AAATTATATG GCCTAGATCC

CCATAAGTAA TGGTTTAACT TCTGCCTTCC TGTGTTCTGA GCCAGATTAG GGCACAGTAG AGAAAGAGGA

GTCTCTGAAA ATGTTTCCAA TTTCGCTGGT CAGACAGCGG ATCATCAGTG AATCAGATGA AAATTTGTGG

ATTTATGCAC TAACTGATCA GCAGGAAATT AAACAAGAAA AGCGTTGGTA GCTCTGGTGA ATCCCAAAAG

AATTTGGCAG TTGCTAGCCA TGCTCCTGAA TATGTATAAA CAGTACATCA TATGACTAAG AGTTTGACTT

AGGGGTTAGA TTTTATGTGT TTGAACCCCA AATTAGTTAT TTAATAGTTG GCACCCCAAA ACAAGTTACT

TAACCTCACT AAGGATTCAGT TTTCCTGTTT ATAAAATGTA GATAGTGATA GTATGTACTT TATAGGATTA

TTGTGAAAAA TAAATGAAAT ATCAGATTTA TTTAGGATAA CACCTGGCAT ATGTTTGGTA TTCAGTAATT

AGTTGCTGCT GTTTTATTCT GCTCTCCCTT GCATCCCACT TTTCTAAGTT GTAAACTAAA TAGTTGTACA

CAGATTGACA GATTAAGAAA GGCTTGTGAT TGTGCTAGAC CTATGCCTCT CTCTCACCAG ATTCCAGGTG

TATATGTGGA GGTGGATAG GGAGTGGAGT AAGTGGGTAA ATATTAAATT GCCCAGTTGG GCACCATCCT

GAATATTATC TCTAAAGAAA GAAGCAAAAC CAGGCACAGC TGATGGGTTA ACCAGATATG ATACAGAAAA

CATTTCCTTC TGCTTTTTGG TTTTAAGCCT ATATTTGAAG CCTTAGATCT CTCCAGCACA GTAAGCACCA

GGAGTCCATG AAGAAGATGG CTCCTGCCAT GGAATCCCCT ACTCTACTGT GTGTAGCCTT ACTGTTCTTC

GGTAAGTAGA GATTCAATTA CCCCTCCCAG GGAGGCCCAA ATGAATTTGG GGAGCAGCTG GGGTAGGAAC

CTTTACTGTG GGTGGTGACT TTTTTCTAGGA CATGTGCAAA CTATTGGGCA TTTCCCAGGG ACTCTGTAGT

GGAGCCAAGC TAGAAAGCAG AGGCAAGTGG GCTGAGCAAC ACCTAAGGAG GAAGCCAGAC TGAAAGCCTG

```
GTTCCTTGCA TTTGCTCTGG CATCTTCCAG AGTGCAAATT TCCTACCAAG GTAATGAGGG TAGAGGAGAG

AAAGAAGCTC TTTCTTCCCC TGATTCTCAT TCCTGAAAAG ACGGTTGGTC CTTAAAATTC CATGGATGTA

GATCTTATCC CCACACCCAG ATTCTAGTCC TCTGGAGATA AAGAAGACTG CTGGACACTA ATGTATCCTC

TCTGGACTTT TGCAGCTCCA GATGGCGTGT TAGCAGGTGA GTCCTCTGTT CTTGTTCCCT TGGTGTATCA

ACATGTCTGG GCATTGCTTT CCTCTCACTA TTTTCTTCGT CCCATCACTT CTGCTTTCTA ATGAGCATGA

ATCTGTTCCT TGGCCAGACT ACTTTCCCTC TCCACCTTGC CTTGTCTTTC TTTTTTTCCC TGATTCATTG

CATTCTCTCA AGTCATTCTC TCCTCTGTTT TAGTCAATAA CCATGTCTGT TGCACATATA CATGTCTCAT

TCTCTCTCCT AGACACTTTG GCATGATCTC GCTCAATAAT TACATTATTA TTATTATTGC CATTTTATAA

TTGAGGATGC TGAAACTCAG TGATTTTCTG GTGGTTACAT GGCTAAGGAA CTGGATTTCA ACGTAAGTTC

CTTGGATCTA AGTCCAGTTC TCTTCTGACT ATATCACCCT TTTGTTATCA CCATGTATCT ACTTCTTTGG

TCTCTGTTCA AATTTGCACT ACATCCCCTT GTTCCAGGAA GCCATTCAAG ACTGACTTTC TTAGTGCCTC

TCACTACTTT CTGGAACTGA CATATGTTTT TCACTCTGTA TATACTTACA ATTAAATAGT CATAAATATT

CAGAGCTTGG AGAAACCTTA TATTTCATCC AGTCCAGTAA ATTTATCCAT CCATAATTCA CTCATTCATT

CACATAATAA ATATTTAATG TAACAATGGT TGAACATGGC AGACAGTGTT TCTACCTCAA AAGAGATTGC

AGTCCTCATT TACAGATACT GAATTGAAAT TAACAGAAGT AGAGTGAGTC AGCTCAAATC ACATAGTGAA

TTGGTTTCTT TGTTTTTAAA TCTCCTGCAT ATGTGTCCTG TCTTTCTCCC TGTGTTGGGC GTTCCCTGGG

GCACCAATAC TAATTTCTCC TTCCCCTAGA AATCAAAACA GGGTCTTATC ACCAACAGAA TAAGGACAGG

TTGACCACTG ATTGTCAGAA TATTGCTTCG TTTGTACTTT TAAGCCTAGA CAGTTTTCAA TGACTTTTTT

TCTCTCTACA TGTCTTTTCA TATTTTTATC TTCTTGAAGT CCCTCAGAAA CCTAAGGTCT CCTTGAACCC

TCCATGGAAT AGAATATTTA AAGGAGAGAA TGTGACTCTT ACATGTAATG GAACAATTT CTTTGAAGTC

AGTTCCACCA AATGGTTCCA CAATGGCAGC CTTTCAGAAG AGACAAATTC AAGTTTGAAT ATTGTGAATG

CCAAATTTGA AGACAGTGGA GAATACAAAT GTCAGCACCA ACAAGTTAAT GAGAGTGAAC CTGTGTACCT

GGAAGTCTTC AGTGGTAAGT TCCAGGGATA TGGAAATACA GATCTCTCAT GTGAGGGATG GCTCATCTGA

AGATGGGAAA AAACAGGTTA TTCCAAGGGT TAGGACACCA GAGTGGGATT CAAGGCCTCT CATTTTTAAG

ACCCCTGCAT TGGCTGGGCA CAGTGGCTCA CGCCTGTAAT CCCAGCACTT TGGGAGGCTG AGGCAGGTGG

ATCACGAGGT CAGGAGATCG AGACCATCCG GCTAACATGG TGAAACCCCA TCTCTGCTAA AAAATATATA

TATATAAAAT TAGCCGGGCG TAGTGGTGGG CACCTGTAGT CCCAGGTACT CGGGAGGCTG AGGCAGGAGA

ATGGTGTGAA CCCAGGAGGT GGAGGTTGCA GTGAGCTGAG ATCACGCCAC TGCCCTCCAG CCTGGGCTAC

AGAGCAAGAC TCCGTCTCAA AAAATAAATA AATAAATAAA AAAGACCCCT GCATCTCTTT TCTTCTACCC

CCTTCCCTTT TGATTACTTG TATGCCTTCT TTCAATATTC TAGTCATCTC TCAATATTAT TCCTCCACCC

TATTTTCCTC TATCTTTTCT GCCTAGATTC AGGTATATAT TATGTGGTCA AACAGCATGA CATATATGTG

AACATTTCAA AGAGCTGTGT ATCTGGAATA GGATCAAAAG GTTTGACTTA AAGTTTTGCT CTGCATAATC

CATATGGCAG GACCTGAATA TTAGGTTGTA CTCTTCGTTA TGAAACATAT CTGGGTACAT TTCCTTATGT

CCTCTGTTGT TACTTAAGAA CACATATTTC ATGCTTGTTT CATTTTTATC ACTCCTACTG CCAACAAATA

GCATAGCATG CTTAGGCACA TGTGGCTTAA TTAGCAAATG TTGAATAAAC AAATTAATGA TTTTGAATAG

TGACCAATAG GTCTCTTTTA TACTCTATAT TTTTCTCTTG AGTGAAAAAA AATGTTTCAA CCTCCATATG

TAAATTCCAA ACACAAACTA AAGCAATGTA GAATAGCTTC TTTATTCCCT GGAGTAGGTT CTAGAGAAGT

CCTAAAGGAT TGGTCCTAAA TTAATTATGC TTATTATGCT AGCGATATTT CCTTTCAAAA TTCTCCTTTA

ATGAATGCTT TTTAATTTTT ACAAAAGCAT TAACCATAGA ATGTGATTCT TGTCTTTCAC TGACTCATTA
```

-continued

```
GTGACAAATA TTTGTTGAGT ACCTACCAAC TCCTAAGTAT TGCTACCAAC TCCTAAATAC TGTGTTGGGC
ATTCAGAATA GAATGTAGAA CTAGACAGGG TCCCTGACTT CTTGGAGCAC AGAGCAGTAT GGGAAGAGGA
CATTAAATAA AGAATTACAT AAGTAATTAA TTTAAATTAT ACATGTTTTG AAGAAGTTTT TTTTTGACAA
CTATAATTAA CACTAGAACT GGGAAGTTTC TATAAGGTAA GAGAGGACAA AATAGACACT CTCCTAAGCT
AAAATTCCCA AGAAAGACTG TTTATTTTCC CCTAACTAAC TAGAACTAGC AACAGAAGAT CTGAAAGGAA
TTCTGGCTTT CAAGTGTTCC ATGTATGGAC TCATCAGGGA GGTCCGAGAG GCTTTGTGGC CCCAGACTGA
CTTTTCAGGA GGGGAAAGGA TTTATCAATA CACAAGACAG GCTCTAAGCA TTATTTTGTG CCCTTTAAAA
ATCCACTTTA TGAGCCAAAA AGTGAGTTAA TGATAATTCA TAGTTTCTGA CACATGCTCT ATGCGTGGCT
CTCTTTTCTC TATTCATTCT CTCTCTCTTC ATTTATTGTT AAATAAATAA TGTAATGAAT GTTCTTCAGA
CTGGCTGCTC CTTCAGGCCT CTGCTGAGGT GGTGATGGAG GGCCAGCCCC TCTTCCTCAG GTGCCATGGT
TGGAGGAACT GGGATGTGTA CAAGGTGATC TATTATAAGG ATGGTGAAGC TCTCAAGTAC TGGTATGAGA
ACCACAACAT CTCCATTACA AATGCCACAG TTGAAGACAG TGGAACCTAC TACTGTACGG CAAAGTGTG
GCAGCTGGAC TATGAGTCTG AGCCCCTCAA CATTACTGTA ATAAAAGGTG AGTTGGTAAA GGAAAGGAAA
AGCATCCATA GCAGGGGAAG GAAGAGAGAA CTTCTGAGCC TGAGCAGTTG CAGCTTGTAG AAGGGGGGCA
CCTGTGATAC ACTGGAAAGC CTACCAGACT TGCAATGAGG AGACCTGGGT GATAGTATAT ATCTCAATCT
CTGTTTCAAA GCCTTGACTT GTTAAATGGT GATAGTAATA CCTGCTTGCA CTATGAAATT TTTATGAAGA
TTAATGTGGT AATATTTGTG AAATGACTTT GTAAACTGTT AAGCACTACC AAGCATAAC AGATTGTGAT
TACTATTTTG ATCTCAAAGT CATCTGTTGC TCCTGGGGA ACACTATAT TTATCAAATT GAAAAAAGT
TTCAAAGTTG AATGAAGAAA GGATATAAAG AGCTTGAGGA GCCCATTCCA GCTTAGGAGG GCTGGGAAAG
GAAACCAGCA AGTCAGTAAG CTGTGTGCCT GTGTATTGAG GGAGGAGGGA ATGGACTTGA TATGGAGAGG
GTAGGGAGGT GGACTGCCTC TATGGCCTGT AAGAAAAACT GCTCTCTCCA AACTCTTTAT AAGAGAGGGA
GCCTGTGAAG TATTCACTTT TGAAGGAGAA AGTTAGACTT TTCCTTCACA CACTTTGTAC ATAATAATGT
TTAAAAAAGC ATGAGGTCAA AATACATAAT TAAGTCCTAG CAGTTCTCTG TTAACTAATT TGAGACTGAA
GTGCTATGTA CTTGTCTCTA GGCTTCCAGT ATCTTCATCT GTAAAACAGA ATATTTGGTC TAGATTCCAT
TAGAATCATT TGATAACTTA AAAAATATAT TGATGCTCAT GTCTCATTTC TTGAGATTCT GATTTAATTG
GTTTGGGGTG CAGCCTGGGT ATACGTATTT TTCATAGGTC TTTCACATAA TGGTAATGGG TAGCCAATAT
TGAGAATCAC TTGTCTAGGT GATCTTTAAA TGATTTCTGG ATGTAATATT CTGAGGCTCT ATAATTTGAG
ACTAATCACA AAAATCGGTA CAGTTTATAA ACAGACTAAC AGAACCACAA AATAATAGAA TTGGAAGGCA
ATTTAACTAG TGCAATTTCT TCATTTTGCC TAACAGGCAT GTAAGAAATG ATGATTGATT GAGTAATAGG
CATTGATGAC CCCTGTCCTC ACTTTGTCCC CTTTCCACCC CTTAATTATA TGTGAATTCT GGTCTTGTCA
TTTCGAATAA GGGGTTTATC TTTCCTATTG TCTTCCCCTC TGGGCACGGC ACACTGGCTA CTGGAGTTAA
GAGGAAATGC TTAGGACTCC CTGTGGCTCC AGGGAGCACC AACAGAGCAA CTCAACCTAG TGTTAATCTG
AGTGTTTTCT CTGTGCTTCT GGATGCCACA TCACGCTAAA AATGAAGGAC AAAGCTTGGT CTTTCTCTTA
GGGAGGATGA AACTCTGAAC CTCATTTTTC AGTTCCCAAG ATGAATTATG TTTCTCATTG CATCTGTGTT
CCACTACAGC TCCGCGTGAG AAGTACTGGC TACAATTTTT TATCCCATTG TTGGTGGTGA TTCTGTTTGC
TGTGGACACA GGATTATTTA TCTCAACTCA GCAGCAGGTC ACATTTCTCT TGAAGATTAA GAGAACCAGG
AAAGGCTTCA GACTTCTGAA CCCACATCCT AAGCCAAACC CCAAAAACAA CTGATATAAT TACTCAAGAA
ATATTTGCAA CATTAGTTTT TTTCCAGCAT CAGCAATTGC TACTCAATTG TCAAACACAG CTTGCAATAT
ACATAGAAAC GTCTGTGCTC AAGGATTTAT AGAAATGCTT CATTAAACTG AGTGAAACTG GTTAAGTGGC
ATGTAATAGT AAGTGCTCAA TTAACATTGG TTGAATAAAT GAGAGAATGA ATAGATTCAT TTATTAGCAT
```

```
TTGTAAAAGA GATGTTCAAT TTCAATAAAA TAAATATAAA ACCATGTAAC AGAATGCTTC TGAGTATTCA
AGGCTTGCTA GTTTGTTTGT TTGTTTTCTA CTAAAGGCAA GGACCATGAA GTTCTAGATT GGAAATGTCC
TCTCTTGACT ATTGCAAGTG CGATCTAGGA ATGAAAAGAC ATAGGAGGAT GCCAGTGAGG TGGATCATTT
TTATGCTTCT TCTTCAGCTT ACTAAATATG AACTTTCAGT TCTTGGCAGA ATCAGGGACA GTCTCAAGAC
ATAGGACTCT CAGGATGAAG TAGAGTCCAG GATTCCTCTG TGATTGTTTT GCCCCTCCCA AATTTATATC
TTGAACTTAT GTCTTGTATC TTTATACAGC ACCTGAACCA AGCATTTTGG AGAAATTCCA GCTAATAATA
ATAACCAAAA CCTTCGGCTC TGAAAACAGT CCAGGACTGA ATAAGATCTT GGGCAAAAGA ACTAGACAGT
TTTGGTTTAT TTTCCCTTTC ATTTTATGTC TTCATCATAG TCATTGGAGG CTCATTCTTC TTGTCATGGA
GTAAATGGGA TTAAAGTTC TACTAAGAGT CTCCAGCATC CTCCACCTGT CTACCACCGA GCATGGGCCT
ATATTTGAAG CCTTAGATCT CTCCAGCACA GTAAGCACCA GGAGTCCATG AAGAAGATGG CTCCTGCCAT
GGAATCCCCT ACTCTACTGT GTGTAGCCTT ACTGTTCTTC GCTCCAGATG GCGTGTTAGC AGTCCCTCAG
AAACCTAAGG TCTCCTTGAA CCCTCCATGG AATAGAATAT TTAAAGGAGA GAATGTGACT CTTACATGTA
ATGGAACAA TTTCTTTGAA GTCAGTTCCA CCAAATGGTT CCACAATGGC AGCCTTTCAG AAGAGACAAA
TTCAAGTTTG AATATTGTGA ATGCCAAATT TGAAGACAGT GGAGAATACA AATGTCAGCA CCAACAAGTT
AATGAGAGTG AACCTGTGTA CCTGGAAGTC TTCAGTGACT GGCTGCTCCT TCAGGCCTCT GCTGAGGTGG
TGATGGAGGG CCAGCCCCTC TTCCTCAGGT GCCATGGTTG GAGGAACTGG GATGTGTACA AGGTGATCTA
TTATAAGGAT GGTGAAGCTC TCAAGTACTG GTATGAGAAC CACAACATCT CCATTACAAA TGCCACAGTT
GAAGACAGTG GAACCTACTA CTGTACGGGC AAAGTGTGGC AGCTGGACTA TGAGTCTGAG CCCCTCAACA
TTACTGTAAT AAAAGCTCCG CGTGAGAAGT ACTGGCTACA ATTTTTTATC CCATTGTTGG TGGTGATTCT
GTTTGCTGTG GACACAGGAT TATTTATCTC AACTCAGCAG CAGGTCACAT TTCTCTTGAA GATTAAGAGA
ACCAGGAAAG GCTTCAGACT TCTGAACCCA CATCCTAAGC CAAACCCCAA AACAACTGA TATAATTACT
CAAGAAATAT TTGCAACATT AGTTTTTTTC CAGCATCAGC AATTGCTACT CAATTGTCAA ACACAGCTTG
CAATATACAT AGAAACGTCT GTGCTCAAGG ATTTATAGAA ATGCTTCATT AAACTGAGTG AAACTGGTTA
AGTGGCATGT AATAGTAAGT GCTCAATTAA CATTGGTTGA ATAAATGAGA GAATGAATAG ATTCATTTAT
TAGCATTTGT AAAAGAGATG TTCAATTTCA ATAAAATAAA TATAAAACCA TGTAACAGAA TGCTTCTGAG
TAAAAAAAAA AAAAAAAAAA AAAAAAAA TCTCAATATA ATAATATTCT TTATTCCTGG ACAGCTCGGT
TAATGAAAAA ATGGACACAG AAAGTAATAG GAGAGCAAAT CTTGCTCTCC CACAGGAGCC TTCCAGTGTG
CCTGCATTTG AAGTCTTGGA AATATCTCCC CAGGAAGTAT CTTCAGGCAG ACTATTGAAG TCGGCCTCAT
CCCCACCACT GCATACATGG CTGACAGTTT TGAAAAAAGA GCAGGAGTTC CTGGGGGTAA CACAAATTCT
GACTGCTATG ATATGCCTTT GTTTTGGAAC AGTTGTCTGC TCTGTACTTG ATATTTCACA CATTGAGGGA
GACATTTTTT CATCATTTAA AGCAGGTTAT CCATTCTGGG GAGCCATATT TTTTTCTATT TCTGGAATGT
TGTCAATTAT ATCTGAAAGG AGAAATGCAA CATATCTGGT GAGAGGAAGC CTGGGAGCAA ACACTGCCAG
CAGCATAGCT GGGGGAACGG GAATTACCAT CCTGATCATC AACCTGAAGA AGAGCTTGGC CTATATCCAC
ATCCACAGTT GCCAGAAATT TTTTGAGACC AAGTGCTTTA TGGCTTCCTT TTCCACTGAA ATTGTAGTGA
TGATGCTGTT TCTCACCATT CTGGGACTTG GTAGTGCTGT GTCACTCACA ATCTGTGGAG CTGGGGAAGA
ACTCAAAGGA AACAAGGTTC CAGAGGATCG TGTTTATGAA GAATTAAACA TATATTCAGC TACTTACAGT
GAGTTGGAAG ACCCAGGGGA AATGTCTCCT CCCATTGATT TATAAGAATC ACGTGTCCAG AACACTCTGA
TTCACAGCCA AGGATCCAGA AGGCCAAGGT CTTGTTAAGG GGCTACTGGA AAAATTTCTA TTCTCTCCAC
AGCCTGCTGG TTTT AAGCTTTTCA AAGGTGCAAT TGGATAACTT CTGCCATGAG AAATGGCTGA ATTGGGACAC
```

```
AAGTGGGGAC AATTCCAGAA GAAGGGCACA TCTCTTTCTT TTCTGCAGTT CTTTCTCACC TTCTCAACTC

CTACTAAAAT GTCTCATTTT CAGGTTCTGT AAATCCTGCT AGTCTCAGGC AAAATTATGC TCCAGGAGTC

TCAAATTTTC TTATTTCATA TTAGTCTTTA TTTAGTAGAC TTCTCAATTT TTCTATTCAT CACAAGTAAA

AGCCTGTTGA TCTTAATCAG CCAAGAAACT TATCTGTCTG GCAAATGACT TATGTATAAA GAGAATCATC

AATGTCATGA GGTAACCCAT TTCAACTGCC TATTCAGAGC ATGCAGTAAG AGGAAATCCA CCAAGTCTCA

ATATAATAAT ATTCTTTATT CCTGGACAGC TCGGTTAATG AAAAAATGGA CACAGAAAGT AATAGGAGAG

CAAATCTTGC TCTCCCACAG GAGCCTTCCA GGTAGGTACA AGGTATTATT TTTTTCTACC CTCAGTCACT

TGTGGCAGGG GAAGTCATAG TCACGGTGCT TAGGAGATGA AACTTTATTG ATTTAGGCAT GGATCCATCT

AGTTTAATTA ATATATTGGG TATGAGGAAG CTACTTGCTG TACTTTCCAT GTGGTTCTCT CTCCCTGGAG

AGGAACATTT TTACTCAGCT TGCAAACTGG AAATAGATTT TCTCACATTA GAAGCTCATT TTCTGGGTAT

GAGACAGGAG AGTTCATACT GTGTATGTAG ATCTCTGGCT TCTGGGTCTG ACATGTGCTG AGGGACACAT

ATCCTTCACA CATGCTTTTA TAAATACTTG ATAAAGTAAC CTGCTTCTTG ATTGGTCTTT ATAATCCATA

AGCTGTGGGA TGCTTCTCTG AAGATGAAAA TAGTAATAGA GTCCCATCTA GCTATTCAAA GCCATTCCTT

CATTGTATTC TGTGCACATG AAGTTGGGGT TTGTTACTGA CAAAATATAT TCAGATACAT TTCTATGTTA

AAAGGATTGT GAGATGCATA GGTAAATGTG TTTATTTTCA GTTTTACTTG TCAACATAGA TGAATGAGAA

AGAACTTGAA AGTAACACTG GATTAAGAAT AGGAAAATTT GGCATGGATT TTGCTCCATT TTGTCCCATC

TAATCACTTG GATAGTGTTC AGGTGTTCTT GGTCAGTTAC TTGGATGCTC TGAGCTTTAG TTTCTTGGTG

ATTACAATGA AGATTTGAAT TACAGGATGG CTTTGAAAAA ATAAACAAAA CTCCCCTTTC TGTCTGTCGA

GAATGTTGCA CAGGGAGTTA CAGAATGTTC TCATGACTGA ATTGCTTTTA AATTTCACAG TGTGCCTGCA

TTTGAAGTCT TGGAAATATC TCCCCAGGAA GTATCTTCAG GCAGACTATT GAAGTCGGCC TCATCCCCAC

CACTGCATAC ATGGCTGACA GTTTTGAAAA AAGAGCAGGA GTTCCTGGGG GTGAGTGAGC CTCCTCCAAC

TTTGACTAGA GTAAGGGTTG GGTCTAGAAA AGAATATTGA GTTGCATCAA CTGTTTTCCC ACTTGGATTC

ATGAGAGGTG TTAGGTCCTT TAAAAAACAT GGTAGATAAA GAGTTGACAC TAACTGGGTC CTTTTGGGAA

GAGCCAGAAG CATTTCCTCA TAAAGACTTT AAATTGCTAG GACGAGAATG GCCAACAGGA GTGAAGGATT

CATAACTTTA TCTTTACTTA GATGTAAAGA ACAATTACTG ATGTTCAACA TGACTACATA CATAAAGGCG

CATGGAGAAA AGTATTGGCC TTCCATGCAT TAGGTAGTGC TTGTATCAAT TCTTATAGTG GCTAGGGTAT

CCTGGAAAAT CTTACGTGTG GATCATTTCT CAGGACAGTC TAGGACACTA ACGCAGTTTC TCATGTTTGG

CTTCTATTAT TAAAAAATGA TACAATCTCG GGAAAATTTT TTTGATTTTC ATGAAATTCA TGTGTTTTTC

TATAGGTAAC ACAAATTCTG ACTGCTATGA TATGCCTTTG TTTTGGAACA GTTGTCTGCT CTGTACTTGA

TATTTCACAC ATTGAGGGAG ACATTTTTTC ATCATTTAAA GCAGGTTATC CATTCTGGGG AGCCATATTT

GTGAGTATAT ATCTATAATT GTTTCTGAAA TAACACTGAA CATAGGTTTT TCTCTTTCTC AGATCTAACC

AGTTGTTTAT TCCCAGTATT AAGATGATAT TTATAATTCT TAATTATAAA TATATGTGAG CATATATAAC

ATAGATATGC TCATTAACAA CAACAAAAGA TTCTTTTTAC AATTAACGGT GGGTTAAACA TTTAGCCCAC

AGTTTTATCC CATGAGAAAC CTGAATCTAA TACAAGTTAA ATGACTTGCC TAAGGGCCAC TTGACTAATA

GTAATTGAAC CTAAACTTTC AGAATCCAAC TCCAGGAACA TACTTCTAGC ACTATTCATC AATAAAGTTA

TATGATAAAT ACATACAACT TTATCTGTCA ACTAAAAATA ACAACAGAGG CTGGGCATGG TGGCTCACAC

CCGTAATCCC AGCACTTTGG GAGGCTGAGG CAGGTGGATC ACCTGAGGTC AGGAGTTTGA GACCAGCCTG

ACCAACATGG TGAAACCTCA TCTCTACTAA ATATAAAAAA TTAGCTGAGT GTGATAGTGC ATACCTGTAA

TCCAGCTACT TAAGAGGCTG AGGCAGGAGG CTTGTTTGAA CCTGGAAGGC AGAGGTTGCA GTGAGCTGAG

ATTGTGCCAT TGCACTCCAG CCTGGGCAAT AAGTGCGAAC TCTGTCTCAA AATAATAATA ATAATAATAG
```

-continued

```
AAAATAAAGT TGTCTTCATG AAAAATGAGG AAAGAGATTG CTGGGGTGAG AAACATTAAG ATCAATGGGC

ATATGGTGAC CTTCTATGCC CTAGAAACTC TTTTANGGTA TTTTCTCCTG GTATCTCTTT TACNCATCGT

TCTATCTGGA AAAATAGGTG GATGAGTGAG ATAATAACGG TATATACTTT TTAAAGGTCT AATTGACATA

TATAAATTGC AAGTATTTCA GATGTCAATT TGCTAACCTT GACACACATA GACACACATG AAAACATCAC

CACATTAATA CAATGTATGT ATCCATCATT CCAAAAGCTT CCCTGTGTAT CTTTGTAACT CTTTCTTCCT

CCCTCCACTC CTTGTCCTCT CGTTCCCAAG AAAACATTGA TCTGCTTCCT GTGAATATAA ATTAACTTAC

ATTTTTTAGA GCTTTATATA AGTATGTTCT CTTTACTGTT TGTCTTCCTT CGCTGCACAG TTATTTTGAG

ATTCTTCAAG TTTTTTCTTT ATATCGATAC TTCATTCACA AGAATATATT TTAATTCTAG ACTATGTCAC

ATTGACTTTG TCGTCTGCTA AATCCTTAGT GCTCAGATGA CTTGTTCAGG ACTCTCCTTG AACCTGTACC

TCTGTTANAT TGAAACTTGT CTCTACTGTC TTTTTATTTC AAACACAGCT TATTAGGTGT CTCTCAACCC

ATCAAACNCA CAATCTGAGT CTTTAGGAGA TTGCTTTGAA TTTGTGCTAT TGACTTATAT NTATATNAAA

TNTGTAAATG TTTGGTAAAA ATATCATCAT GTACNTTTTC ATAATTACGC TATNTNCACA TGATATATGT

CAGACTCTGG AAATATGCAT GCCACAGACA CGTGTTTCTT GCCTAAAGGG GCTGATGGAA GACNCACATA

CNAATAGACG ATTGCAGTAG AATGAGAGTG GTGGTCTAAN CAGTACATGT CCTGATGTTG CTCGGACAGT

TACTACNCCA AGAGTACCCC CTGCATTGTC AGGGTTAGCA TCTCCTGGAA GCCTCATGTA AATGAAGAAT

TTCATGCTCC ATCCAGGACC TAATGAATAA GAATCTGCAT TTTAGCAAGA CCCTCATATG ATTCATATAC

ACTTTTTTTT TTTTTTTTTA GATGGAGTCT CACTCTTGTC GCCCAGGCTG GAGTGCAATG GCATGATCTT

GGCTCACTGC AACCTCTGCC TCCCGGGTTC AAGTGATTCT CCTGTCTCAG CCTCCCTAGT AGCTGGGACT

ACAGGTGCAT GCCACAGTGG CTGGCTAATT TTTGTATTTT TAGTAGAGAC AGGGTTTCAC CATTTGGTC

AGGCTGGTCT TGAACTCATG ACCTCCGGTG ATTCCCCCGC CTCGGCTTCC CAAAGTGCTG GGATTACAGA

CATGAGCCAC CACACCCGCC TTATTCGTAT ACNCATTTAA TTCTGAGAAG CACTCTATAG AAAATAAGAA

TAAGAAAATA TTGGGCTCAC AGGTGACATT AATAAGTAAC TTTATCGAGT ACCCCAAATT TTACCTATGT

TTGGAAGATG GGGTTAAAAG GACACATTGA AAACAAGAAC TCATTGTGGC TTTTTTTTCC TCCTTTTTGA

ACAGTTTTCT ATTTCTGGAA TGTTGTCAAT TATATCTGAA AGGAGAAATG CAACATATCT GGTGAGTTGC

CCGTTTCTGT CTTTGTCCAT CCTTGAAAAG ATAAGAAGAA CAGAGTTTTA AGAGTCTTAA GGGAAACACA

TCTTTGTCTC CTATATTACT TGTGAATGTG GATATATGAT TTTGTTTCAA TCTATTTTGT GTCCTAAGGC

TTTTTGCAAC AGAAGTTGGA TATATCATTA GAAACATAAA TTGTACCATT AACATACAT GAAGTTTATG

TTTACCTTGA CGTTCTTCTA AAAAGTGTCC TACACCGGCA TTGTCCTTGT AGGCATATTC ACATGATCAA

ATAAAATAAT TAGTTTTCAA TTAAGGAGAA TATTTGAGGA AAGACCGTAC GTGTTCATGT GGTTCCTGAA

GGCAGTCCAG TGAGAAAGTA ATATATGCTT CATTAAACAA TGCGGACATT TTCAGGGTTT CCCTTTTTAA

CCAAAATTTG GAAGCAATGT GGAATTTACT GGATGCATCC AGCCCTGAAA TGAAGATAGG TTTATTGAAT

GTGCCAGCAA GTGCAGGCCC AGGTCTGAGT GTTCTTCATT ATTATCAGGT GAGAGGAAGC CTGGGAGCAA

ACACTGCCAG CAGCATAGCT GGGGGAACGG GAATTACCAT CCTGATCATC AACCTGAAGA AGAGCTTGGC

CTATATCCAC ATCCACAGTT GCCAGAAATT TTTTGAGACC AAGTGCTTTA TGGCTTCCTT TTCCACTGTA

TGTATTTTTT TTTGTGTGGG AAGACTAAGA TTCTGGGTCC TAATGTAAGT AAGAAGCCCT CTTCTCCTGT

TCCATGAACA CCATCCTTTT CTGTAACTTC TATTACACAG TATAGTGGTT CTGTAAGTTC ACACAGCCCA

GGGAGATGCT GGCTGCCCAC TCCCCTCAAC CCAGGCAAAT TCCTCGGGGT TAAAGTTATC TACTGCAAGT

GACGATCTCT GGGTTTTTCT GTGCCTGTGT TTGTGTGTGT GTGTGTGTGT GTGTGTGTGT GTATGTGTCA

CTTTAAAAGG ACTGGTCAGA TGGTAGGGAG ATGAAAACAG GAGATGCTAT AAGAAAATAA ACTTTTGGGG
```

```
CGAATACCAA TGTGACTCTT TTTGTTTGTC ATTTGTTGCT GTTCAATAGG AAATTGTAGT GATGATGCTG
TTTCTCACCA TTCTGGGACT TGGTAGTGCT GTGTCACTCA CAATCTGTGG AGCTGGGGAA GAACTCAAAG
GAAACAAGGT AGATAGAAGC CCGATATAAA ATCTTGAATG ACAGGTTAAC GAATTGGAGC TTTATTCCTT
AAAATATGGC CTGGGTTTTC TGAAACATTT CTTCCAGAAA ATAGTTTCTC CAAGTTTTAT TACTTTGGTT
TACAAATCTC ACATTTAAAT CACATTTTAT ACCATAAGTA GCACACATTT CATAATATTC CTCTGAATGA
GGGTTGGGAT AATAGGACTG ATATGTTAGA AATGCCTTAA AGTGTGTGGA GCATGAGAGA TGGATGTACA
GAAGGCTTGT GAGGAAACCA CCCAGGTATC TGGCCTTGTT TTCTGCCCCA GAACTAGCCG CCTATTCCTG
TTTCTGTTTT ATTCCTTTGT TTCTTGACTT TTCCTTTCCA ACTTGCTCTA AAACCTCAGT TTTCTTTCCT
TTCTGATTCA TGACTACCAA ATGTTTTCAC TTGCCTCACC CGTCCATTAC ACCTTTGATA AGAACCACCA
GACCTTGTGC TCATGTACTT GCCCATGTCT GATGGAAGAA ACATACTCTC TCCATCTGTC CACTTTCCTG
AGGCATTCAA GTCTAGCCAC CTTTTAAAAT CACTCTCCTC CAGGCTGGGC ACGGTGTCAC GCCTGTAATC
TCAGCACTTT GTGAGGCTGA GGAGGGCGGA TCACTTGAAG TCAGGAGTTC AAAACCAGCC TGGCCAAATG
GCAAAACCAA ATCTTCTTCA ATTATAACCA AATCTTAAAC CAAATCTCTA CTAAAAAATA CAACAAAACA
AAACAACAAC AACAAAAACA GAAAAGGAAA CATTAGCCCA GCGTGGTGGC AGGTACCTGA GGTTCCAGAT
ACTTGGGAGG CTGAAGCAGG AGAATCGCTT GAGCCCAAGA GATGGAGGTT GCAGTGAGCC GAGATCATGC
CACTGCACCA CAGCCAGGGT GACAGAGCCA TACTTCCCAG CACATTGGGA GGCCAAAGCT GAAGAATAAT
TTGAGGTGAG GATTTGGAGA CCAGCCTGGC AACATGGTG AAACTCCGTC TGTACTAAAA ATATAAAACT
TAGTGGGCA TGGGGCACA CACCTGTAAT TTCAGCTACT TAGGAGGCTG AGGCAGGAGA ATTGCTTGAA
CCCGGGAGGC GGAAGTTGCA GTGAGCCAAG ATCGTGGCCA CTGCACTCCA GCCTGGGTGA CATAGTGAGA
TTCTGTCTCA AAAAAAATAA AAGAAATTTA AAAAATCACT CTCTTCCAAA GATAGATAAA TAAGACAGCA
GATATACTAA GGAATAACCT CACCAACTTG TCATTGACTG ACATGATTTC TTTTGGCCCA CTTGGCCAGC
TAGTCTGGTT TGGTTTTCTG GAAATGAAAG AAATAATCAG AGTTTAATGA CAGAGAGCGT GAGACCCAGA
AAGACAAAAG TAGATGAGGT AAGTCTCTTG AGCGAGACTT CTAGGGATGG GAAATTTGTG GTGATTGATA
TGAAATGATT TTTCCCTTAT CAGGTTCCAG AGGATCGTGT TTATGAAGAA TTAAACATAT ATTCAGCTAC
TTACAGTGAG TTGGAAGACC CAGGGGAAAT GTCTCCTCCC ATTGATTTAT AAGAATCACG TGTCCAGAAC
ACTCTGATTC ACAGCCAAGG ATCCAGAAGG CCAAGGTTTT GTTAAGGGGC TACTGGAAAA ATTTCTATTC
TCTCCACAGC CTGCTGGTTT ACATTAGAT TTATTCGCCT GATAAGAATA TTTTGTTTCT GCTGCTTCTG
TCCAGCTTAA TATGCTCCTT CTATTTGTAG ATATGATAGA CTCCTATTTT TCTTGTTTTA TATTATGACC
ACACACATCT CTGCTGGAAA GTCAACATGT AGTAAGCAAG ATTTAACTGT TTGATTATAA CTGTGCAAAT
ACAGAAAAAA AGAAGGCTGG CTGAAAGTTA AGTTAAACTT TGACAGTTTG ATAATATTTG GTTCTTAGGG
TTTTTTTTTT TTTTAGCATT CTTAATAGTT ACAGTTGGGC ATGATTTGTA CCATCCACCC ATACCCACAC
AGTCACAGTC ACACACACAT ATGTATTACT TACACTATAT ATAACTTCCT ATGCAAATAT TTTACCACCA
GTCAATAATA CATTTTTGCC AAGACATGAA GTTTTATAAA GATCTGTATA ATTGCCTGAA TCACCAGCAC
ATCCACTGAC ATGATATTAT TTGCAGATTG ACAAGTAGGA AGTGGGGAAC TTTTATTAAG TTACTCGTTG
TCTGGGGAGG TAAATAGGTT AAAAACAGGG AAATTATAAG TGCAGAGATT AACATTTCAC AAATGTTTAG
TGAAACATTT GTGAAAAAAG AAGACTAAAT TAAGACCTGA GCTGAAATAA AGTGACGTGG AAATGGAAAT
AATGGTTATA TCTAAAACAT GTAGAAAAAG AGTAACTGGT AGATTTTGTT AACAAATTAA AGAATAAAGT
TAGACAAGCA ACTGGTTGAC TAATACATTA AGCGTTTGAG TCTAAGATGA AAGGAGAACA CTGGTTATGT
TGATAGAATG ATAAAAAGGG TCGGGCGCGG AGGCTCACGC CTGTAATCCC AGCCCTTTGG GAGGCCGAGG
TGGGCAGATC ACGAAGTCAG TAGTTTGAGA CCAGCCTGGC AACATAGTG AAACCCCGTC TCTACTAAAA
```

```
ATACAAAAAA AAAATTAGCT GGGTGTGGTG GCAGTCACCT GTAGTCCCAG CTACTTGGGA GGATGAGGCA
GGAGAATCGC TTGAACCTGG GAGGCGGAGG TTGCAGTGAG CCGAGATCGC ACCAGTGCAC TCCAGCCTTG
GTGACAATGG GAGACTCCAT CTCAAAAAAA AAAAAAAAAA AAAAAAGATA AAAGTCAGA ATCTGAAAA
GTGGAGGAAG AGTACAAATA GACCTAAATT AAGTCTCATT TTTTGGCTTT GATTTTGGGG AGACAAAGGG
AAATGCAGCC ATAGAGGGCC TGATGACATC CAATACATGA GTTCTGGTAA AGATAAAATT TGATACACGG
TTTGGTGTCA TTATAAGAGA AATCATTATT AAATGAAGCA AGTTAACACT CTAAGAGAAT TATTTTGAGA
TAGAAGTGAA GCTAAGCTAA ACTTCACATG CCTATAATTG GAGGGAAAAA CTAAGGATAA AATCTAGCCT
AGAAGATACA ATAATTAGTC ATAAACATGC ATTGTGAAAC TGTAGAGAGC AGGTAGCCCA AAATAGAGAA
AGATTAGATA AAGAGAAAAT AAGTATCCAT CAGAGACAGT ATCTCTAGGC TTGGGCAAGA GAAAAGTCCA
CAGTGATAAG CAACTCCACC TAAGGCATGA ATATGCGGCA GAGAAACAG CAATAGTGAA TGAATGCAAA
AGGTGCTGAG CAAATTCCAC ACATGAGTAT TGTGCATGAG TAAATGAATA AAACATTTGC AAAGACCTTT
AGAGAAAGAG AATGGGAGCA TATGTGCGAA ATAAGATAGT TGATTATGAA TAGAAGGTAG TGAAGAAAAG
CAAGCTAAGA AAAAATTCTG TTTATAAAAG AAGGAAAAGA TAGTTTATGT TTTTAGCCTA AGTATAAGAG
TCCTACAGAT GGACTGAAAA AAATCAGTCT GAGAGTATTA GTCACAATTA ATGAAATAAT TACATTTTAT
GTATTGAGGA TGCCAAGATT AAAAGGTGAC AGGTAGATGT TAATTTCCCT AGATTGTGAA AGTGATCACG
ACAATCACAC AACAAATAAT TAAGTGACTT GGTATGCTTT ATTTAATTGT AGGGCCTGAG GTTTTCCATT
CTCATTTTTC TAAAATACAA TTTTGTTTCT CCAAATTTGA CAGCAGAATA AAAACCCTAC CCTTTCACTG
TGTATCATGC TAAGCTGCAT CTCTACTCTT GATCATCTGT AGGTATTAAT CACATCACTT CCATGGCATG
GATGTTCACA TACAGACTCT TAACCCTGGT TTACCAGGAC CTCTAGGAGT GGATCCAATC TATATCTTTA
CAGTTGTATA GTATATGATA TCTCTTTTAT TTCACTCAAT TTATATTTTC ATCATTGACT ACATATTTCT
TATACACAAC ACACAATTTA TGAATTTTTT CTCAAGATCA TTCTGAGAGT TGCCCCACCC TACCTGCCTT
TTATAGTACG CCCACCTCAG GCAGACACAG AGCACAATGC TGGGGTTCTC TTCACACTAT CACTGCCCCA
AATTGTCTTT CTAAATTTCA ACTTCAATGT CATCTTCTCC ATGAAGACCA CTGAATGAAC ACCTTTTCAT
CCAGCCTTAA TTTCTTGCTC CATAACTACT CTATCCCACG ATGCAGTATT GTATCATTAA TTATTAGTGT
GCTTGTGACC TCCTTATGTA TTCTCAATTA CCTGTATTTG TGCAATAAAT TGGAATAATG TAACTTGATT
TCTTATCTGT GTTTGTGTTG GCATGCAAGA TTTAGGTACT TATCAAGATA ATGGGGAATT AAGGCATCAA
TAAAATGATG CCAAAGACCA AGAGCAGTTT CTGAAGTCCT CCTTTTCATC AGCTCTTTAT CAAACAGAAC
ACTCTATAAA CAACCCATAG CCAGAAAACA GGATGTAGGA ACAATCACCA GCACACTCTA TAAACAACCC
ATAGCCAGAA AACAGAATGT AAGGACAATC ACCAGCCATC TTTTGTCAAT AATTGATGGA ATAGAGTTGA
AAGGAACTGG AGCATGAGTC ATATTTGACC AGTCAGTCCT CACTCTTATT TACTTGCTAT GTAAACTTGA
GAAAGCTTTT TTCTCTTTGT GAACCTCAGG TTTTACATCT GAAAATGAGA AATTTGGAAC AAAAGATTCC
TAACTGGTCT TTCTGTTCCC ATATTCTGTG ATTTTTCAAT ATTTAGGATT TTGGTAATAC ACAATTACTT
AGTTTGTGGT TGAGATAGCA ACACGAATCA GAACTATTTG GTGGACATAT TTCAAAGGA GTAGCTCTCC
ACTTTGGGTA AAGAAGTGAT GCNGGTCGTG GTGGCTCACG CCTGTAATCC CAGCACTTTA GGGAGGCCAA
GGCGGGTGGA TCACGAGGTC AGGAGATCGA GACCATCCTG GCTAACACGG TGAAACCCCG TCTCTACTAA
AAAATACAAA AAATTAGCCA GGCGTGGTGG CGGGCGCCTG TAGTCCCACG TACTCGGGAG GCTGAGGCAG
GAGAATGGCA TGAACCAGGG AGGCGGAGCT TGCCGTGAGC CGAGATAGCG CCACTGCAGT CCCTCCTGGG
CAAAAGAGCA AGACTGCGTC TCAAAAAAAA AAAAAAAAAA AAAAAAGAA GTGTGTGGAG TAGCAGGACA
CCTGCAACAA TAATATTTTT CTAAATCCCT CTGAAAAATG CTAATCAAAG GGTTTTTTTC CTAAAAATTG
```

TCTTAGAAAT AAAATTTCCC CTTTGGGAGA CCGAGGCTGG CAGATCACGA GGTCAGGAGA TAGAGACCAC

GGTGAAACCC CGTCTCTACT AAAAATACTA AAAATTAGCC GGGGNGTGGT GGTGGGTACA CCTGTAGTCC

CAGCTACTTG GAGGCTGAGG CTGGAGAATC ACGTGAAC-3' (FRAG. NO: _) (SEQ. ID NO: 2505)

5'-AACAAGAAAA GCGTGGTAG CTCTGGTGAA TCCCAAAAGA ATGTGGCAGT TGCTAGCCAT GCTCCTGAAT

ATGTATAAAC AGTACATCAT ATGACTAAGA GTTTGACTTA GGGGTTAGAT TTTATGTGTT TGAACCCCAA

ATTAGTTATT TAATAGTTGG CACCCCAAAA CAAGTTACTT AACCTCACTA AGGTTCAGTT TTCCTGTTTA

TAAAATGTAG ATAGTGATAG TATGTACTTT ATAGGATTAT TGTGAAAAAT AAATGAAATA TCAGATTTAT

TTAGGATAAC ACCTGGCATA TGTTTGGTAT TCAGAATTAG TTGCTGCTGT TTTATTCTGC TCTCCCTTGC

ATCCCACTTT TCTAAGTTGT AAACTAAATA GTTGTACACA GATTGACAGA TTAAGAAAGG CTTGTGATTG

TGCTAGACCT ATGCCTATGC CTCTGTCTCA CCAGATTCCA GGTGTATATG TGGAGGTGGG ATAGGGAGTG

GAGTAAGTGG GTAAATATTA AATTGCCCAG TTGGGCACCA TCCTGAATAT TATCTCTAAA GAAAGAAGCA

AAACCAGGCA CAGCTGATGG GTTAACCAGA TATGATACAG AAAACATTTC CTTCTGCTTT TTGGTTTTAA

GCCTATATTT GAAGCCTTAG ATCTCTCCAG CACAGTAAGC ACCAGGAGTC CATGAAGAAG ATG-3' (FRAG.

NO: _) (SEQ. ID NO: 2500)

5'-GATCTTCATG TGGAATGACT GGTTTCATTC AATAGACTTA ATTCAGCAGT CTGTGGGGAA GAGCAAGGTA

TGATAGAATG GTTCCTCAAG TGCTTCAGAT GTGAAGTGGG TTTAAATATA CTGTCCCTGT CTTCTTCAGA

GTTTTGGTAA AGATAAAATA GGACACTCAT TTAAAAGCAA TCTTTGCAAA TGACAAGCCA CTATAGACAT

TAATAGAGTT TTCATTTCCA GTATTATCAT TAATATCAGA TCCTGGAAGA AGGTTGAGCC TTGACCTAGA

GCAAAAAAAC AGAAGAATTA GTAAAGGAAT CCTGGAGAAA GCCCCTGCTG TGTATTTAAA GGAGAAAGGG

AGATCATGTT GGGAAATTAT AATATTAAAA GTAAACAAAA GCTAGGAAGT AAAATAAAAT AAATTATATG

GCCTAGATCC CCATAAGTAA TGGTTTAACT TCTGCCTTCC TGTGTTCTGA GCCAGATTAG GGCACAGTAG

AGAAAGAGGA GTCTCTGAAA ATGTTTCCAA TTTCGCTGGT CAGACAGCGG ATCATCAGTG AATCAGATGA

AAATTTGTGG ATTTATGCAC TAACTGATCA GCAGGAAATT AAACAAGAAA AGCGTTGGTA GCTCTGGTGA

ATCCCAAAAG AATTTGGCAG TTGCTAGCCA TGCTCCTGAA TATGTATAAA CAGTACATCA TATGACTAAG

AGTTTGACTT AGGGGTTAGA TTTTATGTGT TTGAACCCCA AATTAGTTAT TTAATAGTTG CACCCCAAA

ACAAGTTACT TAACCTCACT AAGATTCAGT TTTCCTGTTT ATAAAATGTA GATAGTGATA GTATGTACTT

TATAGGATTA TTGTGAAAAA TAAATGAAAT ATCAGATTTA TTTAGGATAA CACCTGGCAT ATGTTTGGTA

TTCAGTAATT AGTTGCTGCT GTTTTATTCT GCTCTCCCTT GCATCCCACT TTTCTAAGTT GTAAACTAAA

TAGTTGTACA CAGATTGACA GATTAAGAAA GGCTTGTGAT TGTGCTAGAC CTATGCCTCT CTCTCACCAG

ATTCCAGGTG TATATGTGGA GGTGGGATAG GGAGTGGAGT AAGTGGGTAA ATATTAAATT GCCCAGTTGG

GCACCATCCT GAATATTATC TCTAAAGAAA GAAGCAAAAC CAGGCACAGC TGATGGGTTA ACCAGATATG

ATACAGAAAA CATTTCCTTC TGCTTTTTGG TTTTAAGCCT ATATTTGAAG CCTTAGATCT CTCCAGCACA

GTAAGCACCA GGAGTCCATG AAGAAGATGG CTCCTGCCAT GGAATCCCCT ACTCTACTGT GTGTAGCCTT

ACTGTTCTTC GGTAAGTAGA GATTCAATTA CCCCTCCCAG GGAGGCCCAA ATGAATTTGG GGAGCAGCTG

GGGTAGGAAC CTTTACTGTG GGTGGTGACT TTTTCTAGGA CATGTGCAAA CTATTGGGCA TTTCCCAGGG

ACTCTGTAGT GGAGCCAAGC TAGAAAGCAG AGGCAAGTGG GCTGAGCAAC ACCTAAGGAG GAAGCCAGAC

TGAAAGCTTG GTTCCTTGCA TTTGCTCTGG CATCTTCCAG AGTGCAAATT TCCTACCAAG GTAATGAGGG

TAGAGGAGAG AAAGAAGCTC TTTCTTCCCC TGATTCTCAT TCCTGAAAAG ACGGTTGGTC CTTAAAATTC

CATGGATGTA GATCTTATCC CCACACCCAG ATTCAGTCC TCTGGAGATA AGAAGACTG CTGGACACTA

ATGTATCCTC TCTGGACTTT TGCAGCTCCA GATGGCGTGT TAGCAGGTGA GTCCTCTGTT CTTGTTCCCT

```
TGGTGTATCA ACATGTCTGG GCATTGCTTT CCTCTCACTA TTTTCTTCGT CCCATCACTT CTGCTTTCTA
ATGAGCATGA ATCTGTTCCT TGGCCAGACT ACTTTCCCTC TCCACCTTGC CTTGTCTTTC TTTTTTTCCC
TGATTCATTG CATTCTCTCA AGTCATTCTC TCCTCTGTTT TAGTCAATAA CCATGTCTGT TGCACATATA
CATGTCTCAT TCTCTCTCCT AGACACTTTG GCATGATCTC GCTCAATAAT TACATTATTA TTATTATTGC
CATTTTATAA TTGAGGATGC TGAAACTCAG TGATTTTCTG GTGGTTACAT GGCTAAGGAA CTGGATTTCA
ACGTAAGTTC CTTGGATCTA AGTCCAGTTC TCTTCTGACT ATATCACCCT TTTGTTATCA CCATGTATCT
ACTTCTTTGG TCTCTGTTCA AATTTGCACT ACATCCCCTT GTTCCAGGAA GCCATTCAAG ACTGACTTTC
TTAGTGCCTC TCACTACTTT CTGGAACTGA CATATGTTTT TCACTCTGTA TATACTTACA ATTAAATAGT
CATAAATATT CAGAGCTTGG AGAAACCTTA TATTTCATCC AGTCCAGTAA ATTTATCCAT CCATAATTCA
CTCATTCATT CACATAATAA ATATTTAATG TAACAATGGT TGAACATGGC AGACAGTGTT TCTACCTCAA
AAGAGATTGC AGTCCTCATT TACAGATACT GAATTGAAAT TAACAGAAGT AGAGTGAGTC AGCTCAAATC
ACATAGTGAA TTGGTTTCTT TGTTTTTAAA TCTCCTGCAT ATGTGTCCTG TCTTTCTCCC TGTGTTGGGC
GTTCCCTGGG GCACCAATAC TAATTTCTCC TTCCCCTAGA AATCAAAACA GGGTCTTATC ACCAACAGAA
TAAGGACAGG TTGACCACTG ATTGTCAGAA TATTGCTTCG TTTGTACTTT TAAGCCTAGA CAGTTTTCAA
TGACTTTTTT TCTCTCTACA TGTCTTTTCA TATTTTTATC TTCTTGAAGT CCCTCAGAAA CCTAAGGTCT
CCTTGAACCC TCCATGGAAT AGAATATTTA AAGGAGAGAA TGTGACTCTT ACATGTAATG GGAACAATTT
CTTTGAAGTC AGTTCCACCA AATGGTTCCA CAATGGCAGC CTTTCAGAAG AGACAAATTC AAGTTTGAAT
ATTGTGAATG CCAAATTTGA AGACAGTGGA GAATACAAAT GTCAGCACCA ACAAGTTAAT GAGAGTGAAC
CTGTGTACCT GGAAGTCTTC AGTGGTAAGT TCCAGGGATA TGGAAATACA GATCTCTCAT GTGAGGGATG
GCTCATCTGA AGATGGGAAA AAACAGGTTA TTCCAAGGGT TAGGACACCA GAGTGGGATT CAAGGCCTCT
CATTTTTAAG ACCCCTGCAT TGGCTGGGCA CAGTGGCTCA CGCCTGTAAT CCCAGCACTT TGGGAGGCTG
AGGCAGGTGG ATCACGAGGT CAGGAGATCG AGACCATCCG GCTAACATGG TGAAACCCCA TCTCTGCTAA
AAAATATATA TATATAAAAT TAGCCGGGCG TAGTGGTGGG CACCTGTAGT CCCAGGTACT CGGGAGGCTG
AGGCAGGAGA ATGGTGTGAA CCCAGGAGGT GGAGGTTGCA GTGAGCTGAG ATCACGCCAC TGCCCTCCAG
CCTGGGCTAC AGAGCAAGAC TCCGTCTCAA AAAATAAATA AATAAATAAA AAGACCCCT GCATCTCTTT
TCTTCTACCC CCTTCCCTTT TGATTACTTG TATGCCTTCT TTCAATATTC TAGTCATCTC TCAATATTAT
TCCTCCACCC TATTTTCCTC TATCTTTTCT GCCTAGATTC AGGTATATAT TATGTGGTCA AACAGCATGA
CATATATGTG AACATTTCAA AGAGCTGTGT ATCTGGAATA GGATCAAAAG GTTTGACTTA AGTTTTGCT
CTGCATAATC CATATGGCAG GACCTGAATA TTAGGTTGTA CTCTTCGTTA TGAAACATAT CTGGGTACAT
TTCCTTATGT CCTCTGTTGT TACTTAAGAA CACATATTTC ATGCTTGTTT CATTTTTATC ACTCCTACTG
CCAACAAATA GCATAGCATG CTTAGGCACA TGTGGCTTAA TTAGCAAATG TTGAATAAAC AAATTAATGA
TTTTGAATAG TGACCAATAG GTCTCTTTTA TACTCTATAT TTTTCTCTTG AGTGAAAAAA AATGTTTCAA
CCTCCATATG TAAATTCCAA ACACAAACTA AGCAATGTA GAATAGCTTC TTTATTCCCT GGAGTAGGTT
CTAGAGAAGT CCTAAAGGAT TGGTCCTAAA TTAATTATGC TTATTATGCT AGCGATATTT CCTTTCAAAA
TTCTCCTTTA ATGAATGCTT TTTAATTTTT ACAAAAGCAT TAACCATAGA ATGTGATTCT TGTCTTTCAC
TGACTCATTA GTGACAAATA TTTGTTGAGT ACCTACCAAC TCCTAAGTAT TGCTACCAAC TCCTAAATAC
TGTGTTGGGC ATTCAGAATA GAATGTAGAA CTAGACAGGG TCCCTGACTT CTTGGAGCAC AGAGCAGTAT
GGGAAGAGGA CATTAAATAA AGAATTCAT AAGTAATTAA TTTAAATTAT ACATGTTTTG AAGAAGTTTT
TTTTTGACAA CTATAATTAA CACTAGAACT GGGAAGTTTC TATAAGGTAA GAGAGGACAA AATAGACACT
```

-continued

```
CTCCTAAGCT AAAATTCCCA AGAAAGACTG TTTATTTTCC CCTAACTAAC TAGAACTAGC AACAGAAGAT

CTGAAAGGAA TTCTGGCTTT CAAGTGTTCC ATGTATGGAC TCATCAGGGA GGTCCGAGAG GCTTTGTGGC

CCCAGACTGA CTTTTCAGGA GGGGAAAGGA TTTATCAATA CACAAGACAG GCTCTAAGCA TTATTTTGTG

CCCTTTAAAA ATCCACTTTA TGAGCCAAAA AGTGAGTTAA TGATAATTCA TAGTTTCTGA CACATGCTCT

ATGCGTGGCT CTCTTTTCTC TATTCATTCT CTCTCTCTTC ATTTATTGTT AAATAAATAA TGTAATGAAT

GTTCTTCAGA CTGGCTGCTC CTTCAGGCCT CTGCTGAGGT GGTGATGGAG GGCCAGCCCC TCTTCCTCAG

GTGCCATGGT TGGAGGAACT GGGATGTGTA CAAGGTGATC TATTATAAGG ATGGTGAAGC TCTCAAGTAC

TGGTATGAGA ACCACAACAT CTCCATTACA AATGCCACAG TTGAAGACAG TGGAACCTAC TACTGTACGG

GCAAAGTGTG GCAGCTGGAC TATGAGTCTG AGCCCCTCAA CATTACTGTA ATAAAAGGTG AGTTGGTAAA

GGAAAGGAAA AGCATCCATA GCAGGGGAAG GAAGAGAGAA CTTCTGAGCC TGAGCAGTTG CAGCTTGTAG

AAGGGGGGCA CCTGTGATAC ACTGGAAAGC CTACCAGACT TGCAATGAGG AGACCTGGGT GATAGTATAT

ATCTCAATCT CTGTTTCAAA GCCTTGACTT GTTAAATGGT GATAGTAATA CCTGCTTGCA CTATGAAATT

TTTATGAAGA TTAATGTGGT AATATTTGTG AAATGACTTT GTAAACTGTT AAGCACTACC CAAGCATAAC

AGATTGTGAT TACTATTTTG ATCTCAAAGT CATCTGTTGC TCCTGGGGGA ACACTTATAT TTATCAAATT

GAAAAAAAGT TTCAAAGTTG AATGAAGAAA GGATATAAAG AGCTTGAGGA GCCCATTCCA GCTTAGGAGG

GCTGGGAAAG GAAACCAGCA AGTCAGTAAG CTGTGTGCCT GTGTATTGAG GGAGGAGGGA ATGGACTTGA

TATGGAGAGG GTAGGGAGGT GGACTGCCTC TATGGCCTGT AAGAAAAACT GCTCTCTCCA AACTCTTTAT

AAGAGAGGGA GCCTGTGAAG TATTCACTTT TGAAGGAGAA AGTTAGACTT TTCCTTCACA CACTTTGTAC

ATAATAATGT TTAAAAAAGC ATGAGGTCAA AATACATAAT TAAGTCCTAG CAGTTCTCTG TTAACTAATT

TGAGACTGAA GTGCTATGTA CTTGTCTCTA GGCTTCCAGT ATCTTCATCT GTAAAACAGA ATATTTGGTC

TAGATTCCAT TAGAATCATT TGATAACTTA AAAAATATAT TGATGCTCAT GTCTCATTTC TTGAGATTCT

GATTTAATTG GTTTGGGGTG CAGCCTGGGT ATACGTATTT TTCATAGGTC TTTCACATAA TGGTAATGGG

TAGCCAATAT TGAGAATCAC TTGTCTAGGT GATCTTTAAA TGATTTCTGG ATGTAATATT CTGAGGCTCT

ATAATTTGAG ACTAATCACA AAAATCGGTA CAGTTTATAA ACAGACTAAC AGAACCACAA AATAATAGAA

TTGGAAGGCA ATTTAACTAG TGCAATTTCT TCATTTTGCC TAACAGGCAT GTAAGAAATG ATGATTGATT

GAGTAATAGG CATTGATGAC CCCTGTCCTC ACTTTGTCCC CTTTCCACCC CTTAATTATA TGTGAATTCT

GGTCTTGTCA TTTCGAATAA GGGGTTTATC TTTCCTATTG TCTTCCCCTC TGGGCACGGC ACACTGGCTA

CTGGAGTTAA GAGGAAATGC TTAGGACTCC CTGTGGCTCC AGGGAGCACC AACAGAGCAA CTCAACCTAG

TGTTAATCTG AGTGTTTTCT CTGTGCTTCT GGATGCCACA TCACGCTAAA AATGAAGGAC AAAGCTTGGT

CTTTCTCTTA GGGAGGATGA AACTCTGAAC CTCATTTTTC AGTTCCCAAG ATGAATTATG TTTCTCATTG

CATCTGTGTT CCACTACAGC TCCGCGTGAG AAGTACTGGC TACAATTTTT TATCCCATTG TTGGTGGTGA

TTCTGTTTGC TGTGGACACA GGATTATTTA TCTCAACTCA GCAGCAGGTC ACATTTCTCT TGAAGATTAA

GAGAACCAGG AAAGGCTTCA GACTTCTGAA CCCACATCCT AAGCCAAACC CCAAAAACAA CTGATATAAT

TACTCAAGAA ATATTTGCAA CATTAGTTTT TTTCCAGCAT CAGCAATTGC TACTCAATTG TCAAACACAG

CTTGCAATAT ACATAGAAAC GTCTGTGCTC AAGGATTTAT AGAATGCTT CATTAAACTG AGTGAAACTG

GTTAAGTGGC ATGTAATAGT AAGTGCTCAA TTAACATTGG TTGAATAAAT GAGAGAATGA ATAGATTCAT

TTATTAGCAT TTGTAAAAGA GATGTTCAAT TTCAATAAAA TAAATATAAA ACCATGTAAC AGAATGCTTC

TGAGTATTCA AGGCTTGCTA GTTTGTTTGT TTGTTTTCTA CTAAAGGCAA GGACCATGAA GTTCTAGATT

GGAAATGTCC TCTCTTGACT ATTGCAAGTG CGATCTAGGA ATGAAAGAC ATAGGAGGAT GCCAGTGAGG

TGGATCATTT TTATGCTTCT TCTTCAGCTT ACTAAATATG AACTTTCAGT TCTTGGCAGA ATCAGGGACA
```

GTCTCAAGAC ATAGGACTCT CAGGATGAAG TAGAGTCCAG GATTCCTCTG TGATTGTTTT GCCCCTCCCA

AATTTATATC TTGAACTTAT GTCTTGTATC TTTATACAGC ACCTGAACCA AGCATTTTGG AGAAATTCCA

GCTAATAATA ATAACCAAAA CCTTCGGCTC TGAAAACAGT CCAGGACTGA ATAAGATCTT GGGCAAAAGA

ACTAGACAGT TTTGGTTTAT TTTCCCTTTC ATTTTATGTC TTCATCATAG TCATTGGAGG CTCATTCTTC

TTGTCATGGA GTAAATGGGA TTAAAGTTC-3' (FRAG. NO: _) (SEQ. ID NO: 2501)

5'-TACTAAGAGT CTCCAGCATC CTCCACCTGT CTACCACCGA GCATGGGCCT ATATTTGAAG CCTTAGATCT

CTCCAGCACA GTAAGCACCA GGAGTCCATG AAGAAGATGG CTCCTGCCAT GGAATCCCCT ACTCTACTGT

GTGTAGCCTT ACTGTTCTTC GCTCCAGATG GCGTGTTAGC AGTCCCTCAG AAACCTAAGG TCTCCTTGAA

CCCTCCATGG AATAGAATAT TTAAAGGAGA GAATGTGACT CTTACATGTA ATGGGAACAA TTTCTTTGAA

GTCAGTTCCA CCAAATGGTT CCACAATGGC AGCCTTTCAG AAGAGACAAA TTCAAGTTTG AATATTGTGA

ATGCCAAATT TGAAGACAGT GGAGAATACA AATGTCAGCA CCAACAAGTT AATGAGAGTG AACCTGTGTA

CCTGGAAGTC TTCAGTGACT GGCTGCTCCT TCAGGCCTCT GCTGAGGTGG TGATGGAGGG CCAGCCCCTC

TTCCTCAGGT GCCATGGTTG GAGGAACTGG GATGTGTACA AGGTGATCTA TTATAAGGAT GGTGAAGCTC

TCAAGTACTG GTATGAGAAC CACAACATCT CCATTACAAA TGCCACAGTT GAAGACAGTG GAACCTACTA

CTGTACGGGC AAAGTGTGGC AGCTGGACTA TGAGTCTGAG CCCCTCAACA TTACTGTAAT AAAAGCTCCG

CGTGAGAAGT ACTGGCTACA ATTTTTTATC CCATTGTTGG TGGTGATTCT GTTTGCTGTG ACACAGGAT

TATTTATCTC AACTCAGCAG CAGGTCACAT TTCTCTTGAA GATTAAGAGA ACCAGGAAAG GCTTCAGACT

TCTGAACCCA CATCCTAAGC CAAACCCCAA AAACAACTGA TATAATTACT CAAGAAATAT TTGCAACATT

AGTTTTTTTC CAGCATCAGC AATTGCTACT CAATTGTCAA ACACAGCTTG CAATATACAT AGAAACGTCT

GTGCTCAAGG ATTTATAGAA ATGCTTCATT AAACTGAGTG AAACTGGTTA AGTGGCATGT AATAGTAAGT

GCTCAATTAA CATTGGTTGA ATAAATGAGA GAATGAATAG ATTCATTTAT TAGCATTTGT AAAAGAGATG

TTCAATTTCA ATAAAATAAA TATAAAACCA TGTAACAGAA TGCTTCTGAG TAAAAAAAAA AAAAAAAAA

AAAAAAA-3' (FRAG. NO: _) (SEQ. ID NO: 2502)

5'-TCTCAATATA ATAATATTCT TTATTCCTGG ACAGCTCGGT TAATGAAAAA ATGGACACAG AAAGTAATAG

GAGAGCAAAT CTTGCTCTCC CACAGGAGCC TTCCAGTGTG CCTGCATTTG AAGTCTTGGA AATATCTCCC

CAGGAAGTAT CTTCAGGCAG ACTATTGAAG TCGGCCTCAT CCCCACCACT GCATACATGG CTGACAGTTT

TGAAAAAGA GCAGGAGTTC CTGGGGGTAA CACAAATTCT GACTGCTATG ATATGCCTTT GTTTTGGAAC

AGTTGTCTGC TCTGTACTTG ATATTTCACA CATTGAGGGA GACATTTTTT CATCATTTAA AGCAGGTTAT

CCATTCTGGG GAGCCATATT TTTTTCTATT TCTGGAATGT TGTCAATTAT ATCTGAAAGG AGAAATGCCA

CATATCTGGT GAGAGGAAGC CTGGGAGCAA ACACTGCCAG CAGCATAGCT GGGGAACGG GAATTACCAT

CCTGATCATC AACCTGAAGA AGAGCTTGGC CTATATCCAC ATCCACAGTT GCCAGAAATT TTTTGAGACC

AAGTGCTTTA TGGCTTCCTT TTCCACTGAA ATTGTAGTGA TGATGCTGTT CTCACCATT CTGGGACTTG

GTAGTGCTGT GTCACTCACA ATCTGTGGAG CTGGGGAAGA ACTCAAAGGA AACAAGGTTC AGAGGATCG

TGTTTATGAA GAATTAAACA TATATTCAGC TACTTACAGT GAGTTGGAAG ACCCAGGGGA AATGTCTCCT

CCCATTGATT TATAAGAATC ACGTGTCCAG AACACTCTGA TTCACAGCCA AGGATCCAGA AGGCCAAGGT

CTTGTTAAGG GGCTACTGGA AAAATTTCTA TTCTCTCCAC AGCCTGCTGG TTTT-3' (FRAG. NO: _) (SEQ. ID NO: 2503)

5'-AAGCTTTTCA AAGGTGCAAT TGGATAACTT CTGCCATGAG AAATGGCTGA ATTGGGACAA AGTGGGGAC

AATTCCAGAA GAAGGGCACA TCTCTTTCTT TTCTGCAGTT CTTTCTCACC TTCTCAACTC CTACTAAAAT

GTCTCATTTT CAGGTTCTGT AAATCCTGCT AGTCTCAGGC AAAATTATGC TCCAGGAGTC TCAAATTTTC

```
TTATTTCATA TTAGTCTTTA TTTAGTAGAC TTCTCAATTT TTCTATTCAT CACAAGTAAA AGCCTGTTGA
TCTTAATCAG CCAAGAAACT TATCTGTCTG GCAAATGACT TATGTATAAA GAGAATCATC AATGTCATGA
GGTAACCCAT TTCAACTGCC TATTCAGAGC ATGCAGTAAG AGGAAATCCA CCAAGTCTCA ATATAATAAT
ATTCTTTATT CCTGGACAGC TCGGTTAATG AAAAAATGGA CACAGAAAGT AATAGGAGAG CAAATCTTGC
TCTCCCACAG GAGCCTTCCA GGTAGGTACA AGGTATTATT TTTTTCTACC CTCAGTCACT TGTGGCAGGG
GAAGTCATAG TCACGGTGCT TAGGAGATGA AACTTTATTG ATTTAGGCAT GGATCCATCT AGTTTAATTA
ATATATTGGG TATGAGGAAG CTACTTGCTG TACTTTCCAT GTGGTTCTCT CTCCCTGGAG AGGAACATTT
TTACTCAGCT TGCAAACTGG AAATAGATTT TCTCACATTA GAAGCTCATT TTCTGGGTAT GAGACAGGAG
AGTTCATACT GTGTATGTAG ATCTCTGGCT TCTGGGTCTG ACATGTGCTG AGGGACACAT ATCCTTCACA
CATGCTTTTA TAAATACTTG ATAAAGTAAC CTGCTTCTTG ATTGGTCTTT ATAATCCATA AGCTGTGGGA
TGCTTCTCTG AAGATGAAAA TAGTAATAGA GTCCCATCTA GCTATTCAAA GCCATTCCTT CATTGTATTC
TGTGCACATG AAGTTGGGGT TTGTTACTGA CAAAATATAT TCAGATACAT TTCTATGTTA AAAGGATTGT
GAGATGCATA GGTAAATGTG TTTATTTTCA GTTTTACTTG TCAACATAGA TGAATGAGAA AGAACTTGAA
AGTAACACTG GATTAAGAAT AGGAAAATTT GGCATGGATT TTGCTCCATT TTGTCCCATC TAATCACTTG
GATAGTGTTC AGGTGTTCTT GGTCAGTTAC TTGGATGCTC TGAGCTTTAG TTTCTTGGTG ATTACAATGA
AGATTTGAAT TACAGGATGG CTTTGAAAAA ATAAACAAAA CTCCCCTTTC TGTCTGTCGA GAATGTTGCA
CAGGGAGTTA CAGAATGTTC TCATGACTGA ATTGCTTTTA AATTTCACAG TGTGCCTGCA TTTGAAGTCT
TGGAAATATC TCCCCAGGAA GTATCTTCAG GCAGACTATT GAAGTCGGCC TCATCCCCAC CACTGCATAC
ATGGCTGACA GTTTTGAAAA AAGAGCAGGA GTTCCTGGGG GTGAGTGAGC CTCCTCCAAC TTTGACTAGA
GTAAGGGTTG GGTCTAGAAA AGAATATTGA GTTGCATCAA CTGTTTTCCC ACTTGGATTC ATGAGAGGTG
TTAGGTCCTT TAAAAAACAT GGTAGATAAA GAGTTGACAC TAACTGGGTC CTTTTGGGAA GAGCCAGAAG
CATTTCCTCA TAAAGACTTT AAATTGCTAG GACGAGAATG GCCAACAGGA GTGAAGGATT CATAACTTTA
TCTTTACTTA GATGTAAAGA ACAATTACTG ATGTTCAACA TGACTACATA CATAAAGGCG CATGGAGAAA
AGTATTGGCC TTCCATGCAT TAGGTAGTGC TTGTATCAAT TCTTATAGTG GCTAGGGTAT CCTGGAAAAT
CTTACGTGTG GATCATTTCT CAGGACAGTC TAGGACACTA ACGCAGTTTC TCATGTTTGG CTTCTATTAT
TAAAAAATGA TACAATCTCG GGAAAATTTT TTTGATTTTC ATGAAATTCA TGTGTTTTTC TATAGGTAAC
ACAAATTCTG ACTGCTATGA TATGCCTTTG TTTTGGAACA GTTGTCTGCT CTGTACTTGA TATTTCACAC
ATTGAGGGAG ACATTTTTTC ATCATTTAAA GCAGGTTATC CATTCTGGGG AGCCATATTT GTGAGTATAT
ATCTATAATT GTTTCTGAAA TAACACTGAA CATAGGTTTT TCTCTTTCTC AGATCTAACC AGTTGTTTAT
TCCCAGTATT AAGATGATAT TTATAATTCT TAATTATAAA TATATGTGAG CATATATAAC ATAGATATGC
TCATTAACAA CAACAAAAGA TTCTTTTTAC AATTAACGGT GGGTTAAACA TTTAGCCCAC AGTTTTATCC
CATGAGAAAC CTGAATCTAA TACAAGTTAA ATGACTTGCC TAAGGGCCAC TTGACTAATA GTAATTGAAC
CTAAACTTTC AGAATCCAAC TCCAGGAACA TACTTCTAGC ACTATTCATC AATAAAGTTA TATGATAAAT
ACATACAACT TTATCTGTCA ACTAAAAATA ACAACAGAGG CTGGGCATGG TGGCTCACAC CCGTAATCCC
AGCACTTTGG GAGGCTGAGG CAGGTGGATC ACCTGAGGTC AGGAGTTTGA GACCAGCCTG ACCAACATGG
TGAAACCTCA TCTCTACTAA ATATAAAAAA TTAGCTGAGT GTGATAGTGC ATACCTGTAA TCCAGCTACT
TAAGAGGCTG AGGCAGGAGG CTTGTTTGAA CCTGGAAGGC AGAGGTTGCA GTGAGCTGAG ATTGTGCCAT
TGCACTCCAG CCTGGGCAAT AAGTGCGAAC TCTGTCTCAA AATAATAATA ATAATAATAG AAAATAAAGT
TGTCTTCATG AAAAATGAGG AAAGAGATTG CTGGGGTGAG AAACATTAAG ATCAATGGGC ATATGGTGAC
CTTCTATGCC CTAGAAACTC TTTTANGGTA TTTTTCTCCTG GTATCTCTTT TACNCATCGT TCTATCTGGA
```

```
AAAATAGGTG GATGAGTGAG ATAATAACGG TATATACTTT TTAAAGGTCT AATTGACATA TATAAATTGC
AAGTATTTCA GATGTCAATT TGCTAACCTT GACACACATA GACACACATG AAAACATCAC CACATTAATA
CAATGTATGT ATCCATCATT CCAAAAGCTT CCCTGTGTAT CTTTGTAACT CTTTCTTCCT CCCTCCACTC
CTTGTCCTCT CGTTCCCAAG AAAACATTGA TCTGCTTCCT GTGAATATAA ATTAACTTAC ATTTTTTAGA
GCTTTATATA AGTATGTTCT CTTTACTGTT TGTCTTCCTT CGCTGCACAG TTATTTTGAG ATTCTTCAAG
TTTTTTCTTT ATATCGATAC TTCATTCACA AGAATATATT TTAATTCTAG ACTATGTCAC ATTGACTTTG
TCGTCTGCTA AATCCTTAGT GCTCAGATGA CTTGTTCAGG ACTCTCCTTG AACCTGTACC TCTGTTANAT
TGAAACTTGT CTCTACTGTC TTTTTATTTC AAACACAGCT TATTAGGTGT CTCTCAACCC ATCAAACNCA
CAATCTGAGT CTTTAGGAGA TTGCTTTGAA TTTGTGCTAT TGACTTATAT NTATATNAAA TNTGTAAATG
TTTGGTAAAA ATATCATCAT GTACNTTTTC ATAATTACGC TATNTNCACA TGATATATGT CAGACTCTGG
AAATATGCAT GCCACAGACA CGTGTTTCTT GCCTAAAGGG GCTGATGGAA GACNCACATA CNAATAGACG
ATTGCAGTAG AATGAGAGTG GTGGTCTAAN CAGTACATGT CCTGATGTTG CTCGGACAGT TACTACNCCA
AGAGTACCCC CTGCATTGTC AGGGTTAGCA TCTCCTGGAA GCCTCATGTA AATGAAGAAT TTCATGCTCC
ATCCAGGACC TAATGAATAA GAATCTGCAT TTTAGCAAGA CCCTCATATG ATTCATATAC ACTTTTTTTT
TTTTTTTTTA GATGGAGTCT CACTCTTGTC GCCCAGGCTG GAGTGCAATG GCATGATCTT GGCTCACTGC
AACCTCTGCC TCCCGGGTTC AAGTGATTCT CCTGTCTCAG CCTCCCTAGT AGCTGGGACT ACAGGTGCAT
GCCACAGTGG CTGGCTAATT TTTGTATTTT TAGTAGAGAC AGGGTTTCAC CATTTTGGTC AGGCTGGTCT
TGAACTCATG ACCTCCGGTG ATTCCCCCGC CTCGGCTTCC CAAAGTGCTG GGATTACAGA CATGAGCCAC
CACACCCGCC TTATTCGTAT ACNCATTTAA TTCTGAGAAG CACTCTATAG AAAATAAGAA TAAGAAAATA
TTGGGCTCAC AGGTGACATT AATAAGTAAC TTTATCGAGT ACCCCAAATT TTACCTATGT TTGGAAGATG
GGGTTAAAAG GACACATTGA AAACAAGAAC TCATTGTGGC TTTTTTTTCC TCCTTTTTGA ACAGTTTTCT
ATTTCTGGAA TGTTGTCAAT TATATCTGAA AGGAGAAATG CAACATATCT GGTGAGTTGC CCGTTTCTGT
CTTTGTCCAT CCTTGAAAAG ATAAGAAGAA CAGAGTTTTA AGAGTCTTAA GGGAAACACA TCTTTGTCTC
CTATATTACT TGTGAATGTG GATATATGAT TTTGTTTCAA TCTATTTTGT GTCCTAAGGC TTTTTGCAAC
AGAAGTTGGA TATATCATTA GAAACATAAA TTGTACCATT TAACATACAT GAAGTTTATG TTTACCTTGA
CGTTCTTCTA AAAAGTGTCC TACACCGGCA TTGTCCTTGT AGGCATATTC ACATGATCAA ATAAAATAAT
TAGTTTTCAA TTAAGGAGAA TATTTGAGGA AGACCGTAC GTGTTCATGT GGTTCCTGAA GGCAGTCCAG
TGAGAAAGTA ATATATGCTT CATTAAACAA TGCGGACATT TTCAGGGTTT CCCTTTTTAA CCAAAATTTG
GAAGCAATGT GGAATTTACT GGATGCATCC AGCCCTGAAA TGAAGATAGG TTTATTGAAT GTGCCAGCAA
GTGCAGGCCC AGGTCTGAGT GTTCTTCATT ATTATCAGGT GAGAGGAAGC CTGGGAGCAA ACACTGCCAG
CAGCATAGCT GGGGGAACGG GAATTACCAT CCTGATCATC AACCTGAAGA AGAGCTTGGC CTATATCCAC
ATCCACAGTT GCCAGAAATT TTTTGAGACC AAGTGCTTTA TGGCTTCCTT TTCCACTGTA TGTATTTTTT
TTTGTGTGGG AAGACTAAGA TTCTGGGTCC TAATGTAAGT AAGAAGCCCT CTTCTCCTGT TCCATGAACA
CCATCCTTTT CTGTAACTTC TATTACACAG TATAGTGGTT CTGTAAGTTC ACACAGCCCA GGGAGATGCT
GGCTGCCCAC TCCCCTCAAC CCAGGCAAAT TCCTCGGGGT TAAAGTTATC TACTGCAAGT GACGATCTCT
GGGTTTTTCT GTGCCTGTGT TTGTGTGTGT GTGTGTGTGT GTGTGTGTGT GTATGTGTCA CTTTAAAAGG
ACTGGTCAGA TGGTAGGGAG ATGAAAACAG GAGATGCTAT AAGAAAATAA ACTTTTGGGG CGAATACCAA
TGTGACTCTT TTTGTTTGTC ATTTGTTGCT GTTCAATAGG AAATTGTAGT GATGATGCTG TTTCTCACCA
TTCTGGGACT TGGTAGTGCT GTGTCACTCA CAATCTGTGG AGCTGGGGAA GAACTCAAAG GAAACAAGGT
```

-continued

```
AGATAGAAGC CCGATATAAA ATCTTGAATG ACAGGTTAAC GAATTGGAGC TTTATTCCTT AAAATATGGC
CTGGGTTTTC TGAAACATTT CTTCCAGAAA ATAGTTTCTC CAAGTTTTAT TACTTTGGTT TACAAATCTC
ACATTTAAAT CACATTTTAT ACCATAAGTA GCACACATTT CATAATATTC CTCTGAATGA GGGTTGGGAT
AATAGGACTG ATATGTTAGA AATGCCTTAA AGTGTGTGGA GCATGAGAGA TGGATGTACA GAAGGCTTGT
GAGGAAACCA CCCAGGTATC TGGCCTTGTT TTCTGCCCCA GAACTAGCCG CCTATTCCTG TTTCTGTTTT
ATTCCTTTGT TTCTTGACTT TTCCTTTCCA ACTTGCTCTA AAACCTCAGT TTTCTTTGCT TTCTGATTCA
TGACTACCAA ATGTTTTCAC TTGCCTCACC CGTCCATTAC ACCTTTGATA AGAACCACCA GACCTTGTGC
TCATGTACTT GCCCATGTCT GATGGAAGAA ACATACTCTC TCCATCTGTC CACTTTCCTG AGGCATTCAA
GTCTAGCCAC CTTTTAAAAT CACTCTCCTC CAGGCTGGGC ACGGTGTCAC GCCTGTAATC TCAGCACTTT
GTGAGGCTGA GGAGGGCGGA TCACTTGAAG TCAGGAGTTC AAAACCAGCC TGGCAAATG GCAAAACCAA
ATCTTCTTCA ATTATAACCA AATCTTAAAC CAAATCTCTA CTAAAAAATA CAACAAAACA AACAACAAC
AACAAAAACA GAAAAGGAAA CATTAGCCCA GCGTGGTGGC AGGTACCTGA GGTTCCAGAT ACTTGGGAGG
CTGAAGCAGG AGAATCGCTT GAGCCCAAGA GATGGAGGTT GCAGTGAGCC GAGATCATGC CACTGCACCA
CAGCCAGGGT GACAGAGCCA TACTTCCCAG CACATTGGGA GGCCAAAGCT GAAGAATAAT TTGAGGTGAG
GATTTGGAGA CCAGCCTGGC CAACATGGTG AAACTCCGTC TGTACTAAAA ATATAAAACT TAGTGGGGCA
TGGGGGCACA CACCTGTAAT TTCAGCTACT TAGGAGGCTG AGGCAGGAGA ATTGCTTGAA CCCGGGAGGC
GGAAGTTGCA GTGAGCCAAG ATCGTGGCCA CTGCACTCCA GCCTGGGTGA CATAGTGAGA TTCTGTCTCA
AAAAAAATAA AAGAAATTTA AAAAATCACT CTCTTCCAAA GATAGATAAA TAAGACAGCA GATATACTAA
GGAATAACCT CACCAACTTG TCATTGACTG ACATGATTTC TTTTGGCCCA CTTGGCCAGC TAGTCTGGTT
TGGTTTTCTG GAAATGAAAG AAATAATCAG AGTTTAATGA CAGAGAGCGT GAGACCCAGA AGACAAAAG
TAGATGAGGT AAGTCTCTTG AGCGAGACTT CTAGGGATGG GAAATTTGTG GTGATTGATA TGAAATGATT
TTTCCCTTAT CAGGTTCCAG AGGATCGTGT TTATGAAGAA TTAAACATAT ATTCAGCTAC TTACAGTGAG
TTGGAAGACC CAGGGGAAAT GTCTCCTCCC ATTGATTTAT AAGAATCACG TGTCCAGAAC ACTCTGATTC
ACAGCCAAGG ATCCAGAAGG CCAAGGTTTT GTTAAGGGGC TACTGGAAAA ATTTCTATTC TCTCCACAGC
CTGCTGGTTT TACATTAGAT TTATTCGCCT GATAAGAATA TTTTGTTTCT GCTGCTTCTG TCCACCTTAA
TATGCTCCTT CTATTTGTAG ATATGATAGA CTCCTATTTT TCTTGTTTTA TATTATGACC ACACACATCT
CTGCTGGAAA GTCAACATGT AGTAAGCAAG ATTTAACTGT TTGATTATAA CTGTGCAAAT ACAGAAAAAA
AGAAGGCTGG CTGAAAGTTG AGTTAAACTT TGACAGTTTG ATAATATTTG GTTCTTAGGG TTTTTTTTTT
TTTTAGCATT CTTAATAGTT ACAGTTGGGC ATGATTTGTA CCATCCACCC ATACCCACAC AGTCACAGTC
ACACACACAT ATGTATTACT TACACTATAT ATAACTTCCT ATGCAAATAT TTTACCACCA GTCAATAATA
CATTTTTGCC AAGACATGAA GTTTTATAAA GATCTGTATA ATTGCCTGAA TCACCAGCAC ATTCACTGAC
ATGATATTAT TTGCAGATTG ACAAGTAGGA AGTGGGAAC TTTTATTAAG TTACTCGTTG TCTGGGGAGG
TAAATAGGTT AAAAACAGGG AAATTATAAG TGCAGAGATT AACATTTCAC AAATGTTTAG TGAAACATTT
GTGAAAAAAG AAGACTAAAT TAAGACCTGA GCTGAAATAA AGTGACGTGG AAATGGAAAT AATGGTTATA
TCTAAAACAT GTAGAAAAAG AGTAACTGGT AGATTTGTT AACAAATTAA AGAATAAAGT TAGACAAGCA
ACTGGTTGAC TAATACATTA AGCGTTTGAG TCTAAGATGA AAGGAGAACA CTGGTTATGT TGATAGAATG
ATAAAAGGG TCGGGCGCGG AGGCTCACGC CTGTAATCCC AGCCCTTTGG GAGGCCGAGG TGGGCAGATC
ACGAAGTCAG TAGTTTGAGA CCAGCCTGGC CAACATAGTG AAACCCCGTC TCTACTAAAA ATACAAAAAA
AAAATTAGCT GGGTGTGGTG GCAGTCACCT GTAGTCCCAG CTACTTGGGA GGATGAGGCA GGAGAATCGC
TTGAACCTGG GAGGCGGAGG TTGCAGTGAG CCGAGATCGC ACCAGTGCAC TCCAGCCTTG GTGACAATGG
```

```
GAGACTCCAT CTCAAAAAAA AAAAAAAAAA AAAAAAGATA AAAAGTCAGA AATCTGAAAA GTGGAGGAAG

AGTACAAATA GACCTAAATT AAGTCTCATT TTTTGGCTTT GATTTTGGGG AGACAAAGGG AAATGCAGCC

ATAGAGGGCC TGATGACATC CAATACATGA GTTCTGGTAA AGATAAAATT TGATACACGG TTTGGTGTCA

TTATAAGAGA AATCATTATT AAATGAAGCA AGTTAACACT CTAAGAGAAT TATTTTGAGA TAGAAGTGAA

GCTAAGCTAA ACTTCACATG CCTATAATTG GAGGGAAAAA CTAAGGATAA AATCTAGCCT AGAAGATACA

ATAATTAGTC ATAAACATGC ATTGTGAAAC TGTAGAGAGC AGGTAGCCCA AAATAGAGAA AGATTAGATA

AAGAGAAAAT AAGTATCCAT CAGAGACAGT ATCTCTAGGC TTGGGCAAGA GAAAAGTCCA CAGTGATAAG

CAACTCCACC TAAGGCATGA ATATGCGGCA GAGAAAACAG CAATAGTGAA TGAATGCAAA AGGTGCTGAG

CAAATTCCAC ACATGAGTAT TGTGCATGAG TAAATGAATA AAACATTTGC AAAGACCTTT AGAGAAAGAG

AATGGGAGCA TATGTGCGAA ATAAGATAGT TGATTATGAA TAGAAGGTAG TGAAGAAAAG CAAGCTAAGA

AAAAATTCTG TTTATAAAAG AAGGAAAAGA TAGTTTATGT TTTTAGCCTA AGTATAAGAG TCCTACAGAT

GGACTGAAAA AAATCAGTCT GAGAGTATTA GTCACAATTA ATGAAATAAT TACATTTTAT GTATTGAGGA

TGCCAAGATT AAAAGGTGAC AGGTAGATGT TAATTTCCCT AGATTGTGAA AGTGATCACG ACAATCACAC

AACAAATAAT TAAGTGACTT GGTATGCTTT ATTTAATTGT AGGGCCTGAG GTTTTCCATT CTCATTTTTC

TAAAATACAA TTTTGTTTCT CCAAATTTGA CAGCAGAATA AAAACCCTAC CCTTTCACTG TGTATCATGC

TAAGCTGCAT CTCTACTCTT GATCATCTGT AGGTATTAAT CACATCACTT CCATGGCATG GATGTTCACA

TACAGACTCT TAACCCTGGT TTACCAGGAC CTCTAGGAGT GGATCCAATC TATATCTTTA CAGTTGTATA

GTATATGATA TCTCTTTTAT TTCACTCAAT TTATATTTTC ATCATTGACT ACATATTTCT TATACACAAC

ACACAATTTA TGAATTTTTT CTCAAGATCA TTCTGAGAGT TGCCCCACCC TACCTGCCTT TTATAGTACG

CCCACCTCAG GCAGACACAG AGCACAATGC TGGGGTTCTC TTCACACTAT CACTGCCCCA AATTGTCTTT

CTAAATTTCA ACTTCAATGT CATCTTCTCC ATGAAGACCA CTGAATGAAC ACCTTTTCAT CCAGCCTTAA

TTTCTTGCTC CATAACTACT CTATCCCACG ATGCAGTATT GTATCATTAA TTATTAGTGT GCTTGTGACC

TCCTTATGTA TTCTCAATTA CCTGTATTTG TGCAATAAAT TGGAATAATG TAACTTGATT TCTTATCTGT

GTTTGTGTTG GCATGCAAGA TTTAGGTACT TATCAAGATA ATGGGGAATT AAGGCATCAA TAAAATGATG

CCAAAGACCA AGAGCAGTTT CTGAAGTCCT CCTTTTCATC AGCTCTTTAT CAAACAGAAC ACTCTATAAA

CAACCCATAG CCAGAAAACA GGATGTAGGA ACAATCACCA GCACACTCTA TAAACAACCC ATAGCCAGAA

AACAGAATGT AAGGACAATC ACCAGCCATC TTTTGTCAAT AATTGATGGA ATAGAGTTGA AAGGAACTGG

AGCATGAGTC ATATTTGACC AGTCAGTCCT CACTCTTATT TACTTGCTAT GTAAACTTGA GAAAGCTTTT

TTCTCTTTGT GAACCTCAGG TTTTACATCT GAAAATGAGA AATTTGGAAC AAAAGATTCC TAACTGGTCT

TTCTGTTCCC ATATTCTGTG ATTTTTCAAT ATTTAGGATT TTTGGTAATC ACAATTACTT AGTTTGTGGT

TGAGATAGCA ACACGAATCA GAACTATTTG GTGGACATAT TTTCAAAGGA GTAGCTCTCC ACTTTGGGTA

AAGAAGTGAT GCNGGTCGTG GTGGCTCACG CCTGTAATCC CAGCACTTTA GGAGGCCAA GGCGGGTGGA

TCACGAGGTC AGGAGATCGA GACCATCCTG GCTAACACGG TGAAACCCCG TCTCTACTAA AAATACAAA

AAATTAGCCA GGCGTGGTGG CGGGCGCCTG TAGTCCCACG TACTCGGGAG GCTGAGGCAG GAGAATGGCA

TGAACCAGGG AGGCGGAGCT TGCCGTGAGC CGAGATAGCG CCACTGCAGT CCCTCCTGGG CAAAAGAGCA

AGACTGCGTC TCAAAAAAAA AAAAAAAAA AAAAAAGAA GTGTGTGGAG TAGCAGGACA CCTGCAACAA

TAATATTTTT CTAAATCCCT CTGAAAAATG CTAATCAAAG GGTTTTTTTC CTAAAAATTG TCTTAGAAAT

AAAATTTCCC CTTTGGGAGA CCGAGGCTGG CAGATCACGA GGTCAGGAGA TAGAGACCAC GGTGAAACCC

CGTCTCTACT AAAAATACTA AAAATTAGCC GGGGNGTGGT GGTGGGTACA CCTGTAGTCC CAGCTACTTG
```

GAGGCTGAGG CTGGAGAATC ACGTGAAC-3' (FRAG. NO: _) (SEQ. ID NO: 2504)

Human Histidine Decarboxylase Nucleic Acid and Antisense Oligonucleotide Fragments 5'-TCT CCC TTG GGC TCT GGC TCC TTC TC TCT CTC TCC CTC TCT CTC TGT CGC CTC CGC CCT GGC TGC TGG GGT GGT GGT GC TTT TGT TCT TCC TTG CTG CC GCC CCG CTG CTT GTC T TC CTC G CTC TGT CCC TCT CTC TCT GTB CTC CTC BGG CTC CBT CBT CTC CCT TGG GC-3' (FRAG. NO: 1700) (SEQ. ID NO: 1711)

5'-GGC TCT GGC (FRAG. NO: 1701) (SEQ. ID NO: 1712)

5'-CCC TTG G (FRAG. NO: 1702) (SEQ. ID NO: 1713)

5'-TT TGT TCT TCC (FRAG. NO: 1703) (SEQ. ID NO: 1714)

5'-TCT CCC TTG GGC TCT GGC TCC TTC TC-3' (FRAG. NO: 1024) (SEQ. ID NO: 1034)

5'-TCT CTC TCC CTC TCT CTC TGT-3' (FRAG. NO: 1025) (SEQ. ID NO: 1035)

5'-CGC CTC CGC CCT GGC TGC TGG GGT GGT GGT GC-3' (FRAG. NO: 1026) (SEQ. ID NO: 1036)

5'-TTT TGT TCT TCC TTG CTG CC-3' (FRAG NO: 1027) (SEQ. ID NO: 1037)

5'-GCC CCG CTG CTT GTC T TC CTC G-3' (FRAG. NO: 1028) (SEQ. ID NO: 1038)

5'-CTC TGT CCC TCT CTC TCT GTB CTC CTC BGG CTC CBT CBT CTC CCT TGG GC (FRAG. NO: 1029) (SEQ. ID NO: 1039)

Human Beta Tryptase Nucleic Acid and Antisense Oligonucleotide Fragments

5'-CTT GCT CCT GGG GGC CTC CTG GTC CCT CCG GGT GTT CCC GGC GGG CCT GGC CTG GGG CBG GGG CCG CGT BGG CGC GGC TCG CCB GGB CGG GCB GCG CCB GCB GCB GCB GBT TCB GCB TCC TGG-3' (FRAG. NO: 1704) (SEQ. ID NO: 1715)

5'-GCT CCT GGG GGC CT-3' (FRAG. NO: 1705) (SEQ. ID NO: 1716)

5'-CGT BGG CGC-3' (FRAG. NO: 1706) (SEQ. ID NO: 1717)

5'-T GGC CTG GGG-3' (FRAG. NO: 1707) (SEQ. ID NO: 1718)

5'-CTT GCT CCT GGG GGC CTC CTG-3' (FRAG. NO: 1030) (SEQ. ID NO: 1040)

5'-GTC CCT CCG GGT GTT CCC GGC-3' (FRAG. NO: 1031) (SEQ. ID NO: 1041)

5'-GGG CCT GGC CTG GGG CBG GGG CCG CGT BGG CGC GGC TCG CCB GGB CGG GCB GCG CCB GCB GCB GCB GBT TCB GCB TCC TCG-3' (FRAG. NO: 1032) (SEQ. ID NO: 1042)

Human Tryptase-I Nucleic Acid and Antisense Oligonucleotide Fragments

5'-CTT GCT CCT GGG GGC CTC CTG GTC CCT CTG GCT G TT CCC GGC CCT GGB CTG GGG CBG GGG CCG CGT BGG CGC GGC TCG CCB GGB CGG GCB GCG CCB GCB GCB GCB GGC TCB GCB TCC TGG CCB CGG BBT TCC-3' (FRAG. NO: 1708) (SEQ. ID NO: 1719)

5'-CT CCT GGG GGC CTC CTG-3' (FRAG. NO: 1709) (SEQ. ID NO: 1720)

5'-B TCC TGG CCB CGG BBT TCC-3' (FRAG. NO: 1710) (SEQ. ID NO: 1721)

5'-GTC CCT C-3' (FRAG. NO: 1711) (SEQ. ID NO: 1722)

5'-CTT GCT CCT GGG GGC CTC CTG-3' (FRAG. NO: 1033) (SEQ. ID NO: 1043)

5'-GTC CCT CTG GCT G TT CCC GGC-3' (FRAG. NO: 1034) (SEQ. ID NO: 1044)

5'-CCT GGB CTG GGG CBG GGG CCG CGT BGG CGC GGC TCG CCB GGB CGG GCB GCG CCB GCB GCB GCB GGC TCB GCB TCC TGG CCB CGG BBT TCC-3' (FRAG. NO: 1035) (SEQ. ID NO: 1045)

Human Prostaglandin D Synthase Nucleic Acid and Antisense Oligonucleotide Fragments 5'-GGT GTG CGG GGC CTG GTG CC CCT GGG CCT CGG GTG CTG CCT GT GCG CTG CCT TCT TCT CCT GG GTC CTC GCC GGG GCC CTT GCT GCC CTG GCT GT GCC CTG GGG GTC TGG GTT CGG CTG T CCC CBG CBG GBC -continued CBG TCC CBT CCB CEG CGT GTG BTG BGT BGC CBT TCT CCT GCB GCC GBG-3' (FRAG. NO: 1712) (SEQ. ID NO: 1723)

5'-T TCT CCT GCB GCC GBG-3' (FRAG. NO: 1713) (SEQ. ID NO: 1724)

5'-CTT GCT GCC CTG GCT GT-3' (FRAG. NO: 1714) (SEQ. ID NO: 1725)

5'-TCT TCT CCT GG-3' (FRAG. NO: 1715) (SEQ. ID NO: 1726)

5'-GGT GTG CGG GGC CTG GTG CC-3' (FRAG. NO: 1036) (SEQ. ID NO: 1046)

5'-CCT GGG CCT CGG GTG CTG CCT GT-3' (FRAG. NO: 1037) (SEQ. ID NO: 1047)

5'-GCG CTG CCT TCT TCT CCT GG-3' (FRAG. NO: 1038) (SEQ. ID NO: 1048)

5'-GTC CTC GCC GGG GCC CTT GCT GCC CTG GCT GT-3' (FRAG. NO: 1039) (SEQ. ID NO: 1049)

5'-GCC CTG GGG GTC TGG GTT CGG CTG T-3' (FRAG. NO: 1040) (SEQ. ID NO: 1050)

5'-CCC CBG CBG GBC CBG TCC CBT CCB CBG CGT GTG BTG BGT BGC CBT TCT CCT GCB GCC GBG-3'

(FRAG. NO: 1041) (SEQ. ID NO: 1051)

Human Cyclooxygenase-2 Nucleic Acid and Antisense Oligonucleotide Fragments

5'-GGG CGC GGG CGB GCB TCG C TTT GGG CTT TTC TCC TTT GGT T TGB GCG CCB GGB CCG CGC BCB GCB

GCB GGG CGC GGG CGB GCB TCG CBG CGG CGG GCB GGG-3' (FRAG. NO: 1716) (SEQ. ID NO: 1729)

5'-G GCB GGG-3' (FRAG. NO: 1717) (SEQ. ID NO: 1730)

5'-TCC TTT GGT T-3' (FRAG. NO: 1718) (SEQ. ID NO: 1731)

5'-GGG CGC GGG CGB GCB TCG C-3' (FRAG. NO: 1042) (SEQ. ID NO: 1052)

5'-TTT GGG CTT TTC TCC TTT GGT T-3' (FRAG. NO: 1043) (SEQ. ID NO: 1053)

5'-TGB GCG CCB GGB CCG CGC BCB GCB GCB GGG CGC GGG CGB GCB TCG CBG CGG CGG GCB GGG-3'

(FRAG. NO: 1044) (SEQ. ID NO: 1054)

Human Eosinophil Cationic Protein Nucleic Acid and Antisense Oligonucleotide Fragments 5'-CCT CCT TCC TGG TCT GTC TGC CBG BCB BBT TTG GGB BGT GBB CBG TTT TGG BBC CBT GTT TCC CBG TCT

CTG BGC TGT GGC-3' (FRAG. NO: 1719) (SEQ. ID NO: 1732)

5'-TTC TCC TTT GGT T-3' (FRAG. NO: 1720) (SEQ. ID NO: 1733)

5'-T TTC TCC TTT GGT T-3' (FRAG. NO: 1721) (SEQ. ID NO: 1734)

5'-GGG CGC GGG CGB GCB TCG C-3' (FRAG. NO: 1042) (SEQ. ID NO: 1052)

5'-TTT GGG CTT TTC TCC TTT GGT T-3' (FRAG. NO: 1043) (SEQ. ID NO: 1053)

5'-TGB GCG CCB GGB CCG CGC BCB GCB GCB GGG CGC GGG CGB GCB TCG CBG CGG CGG GCB GGG-3'

(FRAG. NO: 1044) (SEQ. ID NO: 1054)

Human Eosinophil Derived Neurotoxin Nucleic Acid and Antisense Oligonucleotide Fragments 5'-GCC CTG CTG CTC TTT CTG CT TCC CTT GGT GGG TTG GGC C GCT GGT TGT TCT GGG GTT C TTG CTG CCC CTT CTG TCC C TGT TTG CTG GTG TCT GCG C 5'-CCC CBB CBG BBG BBG CBG BCB BBT TTG GGB BGT GBB CBG

TTT TGG BBC CBT GTT TCC TGT-3' (FRAG. NO: 1722) (SEQ. ID NO: 1735)

5'-TTC CTG T-3' (FRAG. NO: 1723) (SEQ. ID NO: 1736)

5'-CTC TTT CTG CT-3' (FRAG. NO: 1724) (SEQ. ID NO: 1737)

5'-CCC CTT CTG TCC C-3' (FRAG. NO: 1725) (SEQ. ID NO: 1738)

5'-GCC CTG CTG CTC TTT CTG CT-3' (FRAG. NO: 1047) (SEQ. ID NO: 1055)

5'-TCC CTT GGT GGG TTG GGC C-3' (FRAG. NO: 1048) (SEQ. ID NO: 1056)

5'-GCT GGT TGT TCT GGG GTT C-3' (FRAG. NO: 1049) (SEQ. ID NO: 1058)

5'-TTG CTG CCC CTT CTG TCC C-3' (FRAG. NO: 1050) (SEQ. ID NO: 1057)

5'-TGT TTG CTG GTG TCT GCG C-3' (FRAG. NO: 1051) (SEQ. ID NO: 1059)

5'-CCC BBB CBG BBG BBB CBG BCB BBT TTG GGB BGT GBB CBG TTT GGG BBC CBT GTT TCC TGT-3' (FRAG. NO: 1052) (SEQ. ID NO: 1060)

Human Eosinophil Peroxidase Nucleic Acid and Antisense Oligonucleotide Fragments 5'-GCG CTC GGC CTG GTC CCG G GGG TCT CCT CTT GTT GTT GC TTG CGC CTC CTG CTG GGG GT CC CTC TGT TCT TGT TTT GGG GGC GGG CCC GGC CGT TGT CTT G GTT TGG GGG TTT CCG TTG GGG TTC TCC TGG CCC GGG CCT TGC CC GGC CGT GGT CCC GGC TTC GTTCCT GTC TCC GTC TCG GCT CTT CTG GGG CCT TGC GCT GTC TTT GGT G 5'-GCB CCG TCC BGT GBT GGT GCG GTB CTT GTC GCT GCB GCG CTC GGC CTG GTC CCG GBG

BGC CACCGCTCCT GTCAGCCAAC AAATATCCAT TGAGCGACAC CTGTGTCCCA GGTGCTGCTC TGGGCCCTGG

GAGAAGTGCA TCAGTGGGCT TGGTAGTAGA GGGTAGGGAT GGAGTGAAGG GTAGGCAGGA AGAATGTCCC

CAGGCTGGTA GGAGGTGGGG TGGGGGGTTT CAGTCTCAAA ACTCCCATGA AAACCAGAGA GAAGTTTCAG

AACTCCACCC AAGAGGCTGG GTTTCTAGGG CCCAGAGCTG CCCTCCCCCA CCCTAGAATG GCTATAAAA

GTCCCTTCCC AGCTACGTCC AGAGAAGAGC TGGAGGAAGT GAGAGGTCGG CTGGGGGTCC TCAAAGTGAG

AGGGGAGCAG AGGATCCTCC CGTGCAGGCT GTGGATGTCA CTCACTTCCC AGCTGGTGAA GCCTCGCTGC

AGAGATGCAT CTGCTCCCAG CCCTGGCAGG GGTCCTGGCC ACACTCGTCC TCGCCCAGCC CTGTGAGGGC

ACTGACCCAG GTAATAGTCC CCTAGACAGG CAAGGAGGAG GGAGGGGAAA TGGAAGGGGA AGCACTTGGG

TCTTGGAGGG GGTCTTGTGG CTTGCTGAAC CCTGAGTCCC CATCTCTTTG AACAGCCTCC CCTGGGGCAG

TGGAGACCTC GGTCCTGCGA GACTGCATAG CAGAGGCCAA GTTGCTGGTG GATGCTGCCT ACAATTGGAC

CCAGAAGAGG TGGACTTGGG TCTGGGGGCT GCATGGGCCT GGGAGGATCA GT TAATACCTTG TGGGGTCAGG

GAGCCCATGT CCCGTGCTGA TGTTATTTCC CCACCAGGTC CGGGCTGTCT CCAACCAGAT TGTGCGCTTC

CCCAATGAGA GACTGACCTC CGACCGTGGC CGAGCCCTCA TGTTCATGCA GTGGGGCCAG TTCATTGACC

ATGACCTGGA CTTCTCCCCG GAGTCCCCGG CCAGAGTGGC CTTCACTGCA GGCGTTGACT GTGAGAGGAC

CTGCGCCCAG CTGCCCCCCT GCTTTCCCAT CAAGGTACCT ACCCTCAGCC AATCTCCCAT GCCCTTGTGT

GGCCTCCCCC AAAGGCAAGG TGCTGGGGGT GGGGATCTGG AAGACTGGAG CACCATCCTT AAGGAGCTGC

CTGTGGAGCT AGGGTATGAG ACAGAGACAC AAG CACTGTCTCC TCTTCCATCT CAGATCCCAC CCAATGACCC

CCGCATCAAG AACCAGCGTG ACTGCATCCC TTTCTTCCGC TCGGCACCCT CATGCCCCCA AAACAAGAAC

AGAGTCCGCA ACCAGATCAA CGCGCTCACC TCCTTTGTGG ACGCCAGCAT GGTGTATGGC AGTGAGGTCT

CCCTCTCGCT GCGGCTCCGC AACCGGACCA ACTACCTGGG GCTGCTGGCC ATCAACCAGC GCTTTCAAGA

CAACGGCCGG GCCCTGCTGC CCTTCGACAA CCTGCACGAT GACCCCTGTC TCCTCACCAA CCGCTCGGCG

CGCATCCCCT GCTTCCTGGC AGGTCAGACA GGGAGGAAGG TGGTGTCTTC CCAGGAAACA GCCATCCCTG

GGTCCCAAC TGGAAGCAA TGGTGGGATG TGGTGAAGGT ACATGGTTTG GGACCTCAGT ATTAGGCACA

CCATAAGCAT GGATCTGTGC AC TGAAGAGATG GAGGTCCAGT GAGGGCCAGG AGTTTGGCCC ACCCCGTCTC

TCCCATCCCC AGCCCTGGGT CTACCCTGGT AGAAAGACAT TTCTCTGGGA AAGGCTGCAG TAAATCTGAG

CTTGGGGTTT TCAAGGTGAC ACCCGATCAA CGGAAACCCC CAAACTGGCA GCCATGCACA CCCTCTTTAT

GCGAGAGCAC AACCGGCTGG CCACCGAGCT GAGACGCCTG AATCCCCGGT GGAATGGAGA CAAACTGTAC

AATGAGGCTC GGAAGATCAT GGGGGCCATG GTCCAGGTAA GGAGCTCTGC ATCCCAGCAT CCCCC CTTTGTATCT

CCACCCACCA ATAGTAAATT AATGTTGTCA CATTTGACGT GATGACAATA AGAATATGT CTGAGCCACC

CTTTGAAAAG GCAAGGGTAT GGGTGAGTAG CCTCTGGGA ATGTTCCTCC TGTCTTCCCT TCCAGATCAT

CACCTACCGA GACTTTCTGC CCCTGGTTCT GGGCAAGGCC CGGGCCAGGA GAACCCTGGG GCACTACAGG

```
GGGTACTGCT CCAATGTGGA CCCACGGGTG GCCAATGTCT TCACCCTGGC CTTCCGCTTT GGCCACACAA
TGCTCCAGCC CTTCATGTTC CGCTTGGACA GTCAGTACCG GGCCTCCGCA CCCAACTCGC ATGTCCCACT
TAGCTCTGCC TTCTTTGCCA GCTGGCGGAT CGTGTATGAA GGTGACCAGG TTTTCCAGGG GGCAAATGGG
GGTGAGGGTG GGGAGCATGC CCTCCCCTAG GTGG TCCAGCTGCT TCATGTCTCT CCAGAACTCT GTTTCCTGAC
AAACGTTACT AACATACCCG ACTGGCTTGT CCAGCTCTGG GCTAGCTTGG CATCATGTGA TAACCCAAGT
AGCTTCCCAG AGGCTGGTCC AATCTGTGCT GCTCACATTC CTGCCACCA GGGGCATCG ACCCCATCCT
CCGGGGCCTC ATGGCCACCC CTGCCAAGCT GAACCGTCAG GATGCCATGT TAGTGGATGA GCTCCGGGAC
CGGCTGTTTC GGCAAGTGAG GAGGATTGGG CTGGACCTGG CAGCTCTCAA CATGCAACGA AGCCGGGACC
ACGGCCTTCC AGGTGAGGGG GCTGTCCACC TCTTCTCCCA GCTTTGCTCG GCCAGGCTG CTCAAGGGGT
TCTGGGAAGA CCCTGGTACC CGACTGCCTG GTAGGTTCTG GTGGCAGAAA CGAGGTGTTT TCACCAAAAG
ACAGCGCAAG GCCCTGAGCA GAATTTCCTT GTCTCGAATT ATATGTGACA ATACCGGTAT CACCACGGTT
TCAAGGGACA TCTTCAGAGC CAACATCTAC CCTCGGGGCT TTGTGAACTG CAGCCGTATC CCCAGGTTGA
ACCTATCAGC CTGGCGAGGG ACATGAGGCT TCTGCAGGTA AGGGGAGGCC ACCTCCAGCA CCCTGGGCTG
GTTAAGCCTC ACATCCTTCC CTGGATGGAT GGCTGAGTCC TCTTAGGTCT CTAAGCAGAG AAAACAGAAC
TTGTCACTAG GTACTCTTTC CAAGTGGCTT CCCAATGTGC TAGTTTCTGG GCTGACAGTC AATTCCAGGC
CCTAGGACTT TGGGGGGAAA TTAGGAGCAT CCAACTA GAATTCCGTG GCCAGGACCC CTGCCAGGGC
ACTGACCCAG CCTCCCCTGG GGCAGTGGAG ACCTCGGTCC TGCGAGACTG CATAGCAGAG GCCAAGTTGC
TGGTGGATGC TGCCTACAAT TGGACCCAGA AGAGCATCAA GCAGCGGCTT CGCAGCGGTT CAGCCAGCCC
CATGGACCTC CTGTCCTACT TCAAACAACC GGTAGCAGCC ACCAGGACAG TTGTTCGGGC CGCAGATTAT
ATGCATGTGG CTTTGGGGCT GCTTGAAGAG AAGTTACAAC CCCAGCGGTC CGGACCCTTC ATTGTCACTG
ATGTGCTAAC AGAACCACAG CTGCGGCTGC TGTCCCAGGC CAGTGGCTGT GCTCTCCGGG ACCAGGCCGA
GCGCTGCAGC GACAAGTACC GCACCATCAC TGGACGGTGC AACAACAAGA GGAGACCCTT GCTAGGGGCC
TCCAACCAGG CTCTGGCTCG CTGGCTGCCC GCCGAGTATG AGGATGGGCT GTCGCTCCCC TTCGGCTGGA
CCCCCAGCAG GAGGCGCAAT GGCTTCCTTC TCCCTCTTGT CCGGGCTGTC TCCAACCAGA TTGTGCGCTT
CCCCAATGAG AGACTGACCT CCGACCGTGG CCGAGCCCTC ATGTTCATGC AGTGGGCCA GTTCATTGAC
CATGACCTGG ACTTCTCCCC GGAGTCCCCG GCCAGAGTGG CCTTCACTGC AGGCGTTGAC TGTGAGAGGA
CCTGCGCCCA GCTGCCCCCC TGCTTTCCCA TCAAGATCCC ACCCAATGAC CCCCGCATCA AGAACCAGCG
TGACTGCATC CCTTTCTTCC GCTCGGCACC CTCATGCCCC CAAAACAAGA ACAGAGTCCG CAACCAGATC
AACGCGCTCA CCTCCTTTGT GGACGCCAGC ATGGTGTATG GCAGTGAGGT CTCCCTCTCG CTGCGGCTCC
GCAACCGGAC CAACTACCTG GGGCTGCTGG CCATCAACCA GCGCTTTCAA GACAACGGCC GGGCCCTGCT
GCCCTTCGAC AACCTGCACG ATGACCCCTG TCTCCTCACC AACCGCTCGG CGCGCATCCC CTGCTTCCTG
GCAGGTGACA CCCGATCAAC GGAAACCCCC AAACTGGCAG CCATGCACAC CCTCTTTATG CGAGAGCACA
ACCGGCTGGC CACCGAGCTG AGACGCCTGA ATCCCCGGTG GAATGGAGAC AAACTGTACA ATGAGGCTCG
GAAGATCATG GGGGCCATGG TCCAGATCAT CACCTACCGA GACTTTCTGC CCCTGGTTCT GGGCAAGGCC
CGGGCCAGGA GAACCCTGGG GCACTACAGG GGGTACTGCT CCAATGTGGA CCCACGGGTG GCCAATGTCT
TCACCCTGGC CTTCCGCTTT GGCCACACAA TGCTCCAGCC CTTCATGTTC CGCTTGGACA GTCAGTACCG
GGCCTCCGCA CCCAACTCGC ATGTCCCACT TAGCTCTGCC TTCTTTGCCA GCTGGCGGAT CGTGTATGAA
GGGGCATCG ACCCCATCCT CCGGGGCCTC ATGGCCACCC CTGCCAAGCT GAACCGTCAG GATGCCATGT
TAGTGGATGA GCTCCGGGAC CGGCTGTTTC GGCAAGTGAG GAGGATTGGG CTGGACCTGG CAGCTCTCAA
```

```
CATGCAACGA AGCCGGGACC ACGGCCTTCC AGGGTACAAT GCTTGGAGGC GCTTCTGTGG GCTCTCCCAG

CCCCGGAATT TGGCACAGCT TAGCCGGGTG CTGAAAAACC AGGACTTGGC AAGGAAGTTC CTGAATTTGT

ATGGAACACC TGACAACATT GACATCTGGA TTGGGGCCAT CGCTGAGCCT CTTTTGCCGG GGGCTCGAGT

GGGGCCTCTT CTGGCTTGTC TGTTCGAGAA CCAGTTCAGA AGAGCCGAGA CGGAGACAGG TTCTGGTGGC

AGAACGAGGT GTTTTCACCA AAGACAGCGC AAGGCCCTGA GCAGAATTTC CTTGTCTCGA ATTATATGTG

ACAATACCGG TATCACCACG GTTTCAAGGG ACATCTTCAG AGCCAACATC TACCCTCGGG GCTTTGTGAA

CTGCAGCCGT ATCCCCAGGT TGAACCTATC AGCCTGGCGA GGGACATGAG GCTTCTGCAG GAGTCTATCC

CAAGTCTCCA ACTTTTGGAG ACAAGGGGAA GGGGAGGACC ATGAGGCTGC CTTGTCTCCC TGGAGCAAGT

GCAGGCTCGT GACGCTTCTG CTGGCTACAG CTCAGAGCTG GGTTCCCCAG CCAGGAGTGA AGGCTGGGGG

CTCCTATCAG CAATGGACCT TCCGCCTTGG GAGCCTCTTA GGTATTAGGC TATGAATCAG CGCCACGTGC

AAAGGCTTGG GAGCCAAGCC ATGTGGTCTT GCACCCCAGG CAAGAAAAGT CAGCTGGAGG GTTTACAGCA

CTTTCTACTG TTTCCCAGCC CTCCCTCCCC TCCCTCACCA TGACTAAGAG ACCACTCGGT CCTAGCCTCC

AGACACCCCA CAATACTCCT CTGAGCCTGA GGCCAGGCAG CATGCTCTGC TTCTACCAAT AAAGCACTGC

CGGAATTC-3' (FRAG. NO: 1726) (SEQ. ID NO: 3008)

5'-CACCGCTCCT GTCAGCCAAC AAATATCCAT TGAGCGACAC CTGTGTCCCA GGTGCTGCTC TGGGCCCTGG

GAGAAGTGCA TCAGTGGGCT TGGTAGTAGA GGGTAGGGAT GGAGTGAAGG GTAGGCAGGA AGAATGTCCC

CAGGCTGGTA GGAGGTGGGG TGGGGGGTTT CAGTCTCAAA ACTCCCATGA AAACCAGAGA GAAGTTTCAG

AACTCCACCC AAGAGGCTGG GTTTCTAGGG CCCAGAGCTG CCCTCCCCCA CCCTAGAATG GGCTATAAAA

GTCCCTTCCC AGCTACGTCC AGAGAAGAGC TGGAGGAAGT GAGAGGTCGG CTGGGGGTCC TCAAAGTGAG

AGGGGAGCAG AGGATCCTCC CGTGCAGGCT GTGGATGTCA CTCACTTCCC AGCTGGTGAA GCCTCGCTGC

AGAGATGCAT CTGCTCCCAG CCCTGGCAGG GGTCCTGGCC ACACTCGTCC TCGCCCAGCC CTGTGAGGGC

ACTGACCCAG GTAATAGTCC CCTAGACAGG CAAGGAGGAG GGAGGGGAAA TGGAAGGGGA AGCACTTGGG

TCTTGGAGGG GGTCTTGTGG CTTGCTGAAC CCTGAGTCCC CATCTCTTTG AACAGCCTCC CCTGGGGCAG

TGGAGACCTC GGTCCTGCGA GACTGCATAG CAGAGGCCAA GTTGCTGGTG GATGCTGCCT ACAATTGGAC

CCAGAAGAGG TGGACTTGGG TCTGGGGGCT GCATGGGCCT GGGAGGATCA GT-3' (FRAG. NO: _) (SEQ. ID

NO: 2483)

5'-TAATACCTTG TGGGGTCAGG GAGCCCATGT CCCGTGCTGA TGTTATTTCC CCACCAGGTC CGGGCTGTCT

CCAACCAGAT TGTGCGCTTC CCCAATGAGA GACTGACCTC CGACCGTGGC CGAGCCCTCA TGTTCATGCA

GTGGGGCCAG TTCATTGACC ATGACCTGGA CTTCTCCCCG GAGTCCCCGG CCAGAGTGGC CTTCACTGCA

GGCGTTGACT GTGAGAGGAC CTGCGCCCAG CTGCCCCCCT GCTTTCCCAT CAAGGTACCT ACCCTCAGCC

AATCTCCCAT GCCCTTGTGT GGCCTCCCCC AAAGGCAAGG TGCTGGGGGT GGGGATCTGG AAGACTGGAG

CACCATCCTT AAGGAGCTGC CTGTGGAGCT AGGGTATGAG ACAGAGACAC AAG-3' (FRAG. NO: _) (SEQ. ID

NO: 2484)

5'-CACTGTCTCC TCTTCCATCT CAGATCCCAC CCAATGACCC CCGCATCAAG AACCAGCGTG ACTGCATCCC

TTTCTTCCGC TCGGCACCCT CATGCCCCCA AAACAAGAAC AGAGTCCGCA ACCAGATCAA CGCGCTCACC

TCCTTTGTGG ACGCCAGCAT GGTGTATGGC AGTGAGGTCT CCCTCTCGCT GCGGCTCCGC AACCGGACCA

ACTACCTGGG GCTGCTGGCC ATCAACCAGC GCTTTCAAGA CAACGGCCGG GCCCTGCTGC CCTTCGACAA

CCTGCACGAT GACCCCTGTC TCCTCACCAA CCGCTCGGCG CGCATCCCCT GCTTCCTGGC AGGTCAGACA

GGGAGGAAGG TGGTGTCTTC CCAGGAAACA GCCATCCCTG GGGTCCCAAC TGGGAAGCAA TGGTGGGATG

TGGTGAAGGT ACATGGTTTG GGACCTCAGT ATTAGGCACA CCATAAGCAT GGATCTGTGC AC-3'
```

(FRAG. NO: _) (SEQ. ID NO: 2485)

5'-TGAAGAGATG GAGGTCCAGT GAGGGCCAGG AGTTTGGCCC ACCCCGTCTC TCCCATCCCC AGCCCTGGGT
CTACCCTGGT AGAAAGACAT TTCTCTGGGA AAGGCTGCAG TAAATCTGAG CTTGGGGTTT TCAAGGTGAC
ACCCGATCAA CGGAAACCCC CAAACTGGCA GCCATGCACA CCCTCTTTAT GCGAGAGCAC AACCGGCTGG
CCACCGAGCT GAGACGCCTG AATCCCCGGT GGAATGGAGA CAAACTGTAC AATGAGGCTC GGAAGATCAT
GGGGGCCATG GTCCAGGTAA GGAGCTCTGC ATCCCAGCAT CCCCC-3' (FRAG. NO: _) (SEQ. ID NO: 2486)

5'-CTTTGTATCT CCACCCACCA ATAGTAAATT AATGTTGTCA CATTTGACGT GATGACAATA AAGAATATGT
CTGAGCCACC CTTTGAAAAG GCAAGGGTAT GGGTGAGTAG CCTCTGGGGA ATGTTCCTCC TGTCTTCCCT
TCCAGATCAT CACCTACCGA GACTTTCTGC CCCTGGTTCT GGGCAAGGCC CGGGCCAGGA GAACCCTGGG
GCACTACAGG GGGTACTGCT CCAATGTGGA CCCACGGGTG GCCAATGTCT TCACCCTGGC CTTCCGCTTT
GGCCACACAA TGCTCCAGCC CTTCATGTTC CGCTTGGACA GTCAGTACCG GCCTCCGCA CCCAACTCGC
ATGTCCCACT TAGCTCTGCC TTCTTTGCCA GCTGGCGGAT CGTGTATGAA GGTGACCAGG TTTTCCAGGG
GGCAAATGGG GGTGAGGGTG GGGAGCATGC CCTCCCCTAG GTGG-3' (FRAG. NO: _) (SEQ. ID NO: 2487)

5'-TCCAGCTGCT TCATGTCTCT CCAGAACTCT GTTTCCTGAC AAACGTTACT AACATACCCG ACTGGCTTGT
CCAGCTCTGG GCTAGCTTGG CATCATGTGA TAACCCAAGT AGCTTCCCAG AGGCTGGTCC AATCTGTGCT
GCTCACATTC CCTGCCACCA GGGGGCATCG ACCCCATCCT CCGGGGCCTC ATGGCCACCC CTGCCAAGCT
GAACCGTCAG GATGCCATGT TAGTGGATGA GCTCCGGGAC CGGCTGTTTC GGCAAGTGAG GAGGATTGGG
CTGGACCTGG CAGCTCTCAA CATGCAACGA AGCCGGGACC ACGGCCTTCC AGGTGAGGGG GCTGTCCACC
TCTTCTCCCA GCTTTGCTCG GGCCAGGCTG CTCAAGGGGT TCTGGGAAGA CCCTGGTACC-3' (FRAG. NO: _) (SEQ. ID NO: 2488)

5'-CGACTGCCTG GTAGGTTCTG GTGGCAGAAA CGAGGTGTTT TCACCAAAAG ACAGCGCAAG GCCCTGAGCA
GAATTTCCTT GTCTCGAATT ATATGTGACA ATACCGGTAT CACCACGGTT TCAAGGGACA TCTTCAGAGC
CAACATCTAC CCTCGGGGCT TGTGAACTG CAGCCGTATC CCCAGGTTGA ACCTATCAGC CTGGCGAGGG
ACATGAGGCT TCTGCAGGTA AGGGGAGGCC ACCTCCAGCA CCCTGGGCTG GTTAAGCCTC ACATCCTTCC
CTGGATGGAT GGCTGAGTCC TCTTAGGTCT CTAAGCAGAG AAAACAGAAC TTGTCACTAG GTACTCTTTC
CAAGTGGCTT CCCAATGTGC TAGTTTCTGG GCTGACAGTC AATTCCAGGC CTAGGACTT TGGGGGGAAA
TTAGGAGCAT CCAACTA-3' (FRAG. NO: _) (SEQ. ID NO: 2489)

5'-GAATTCCGTG CCAGGACCC CTGCCAGGGC ACTGACCCAG CCTCCCCTGG GGCAGTGGAG ACCTCGGTCC
TGCGAGACTG CATAGCAGAG GCCAAGTTGC TGGTGGATGC TGCCTACAAT TGGACCCAGA AGAGCATCAA
GCAGCGGCTT CGCAGCGGTT CAGCCAGCCC CATGGACCTC CTGTCCTACT TCAAACAACC GGTAGCAGCC
ACCAGGACAG TTGTTCGGGC CGCAGATTAT ATGCATGTGG CTTTGGGGCT GCTTGAAGAG AAGTTACAAC
CCCAGCGGTC CGGACCCTTC ATTGTCACTG ATGTGCTAAC AGAACCACAG CTGCGGCTGC TGTCCCAGGC
CAGTGGCTGT GCTCTCCGGG ACCAGGCCGA GCGCTGCAGC GACAAGTACC GCACCATCAC TGGACGGTGC
AACAACAAGA GGAGACCCTT GCTAGGGGCC TCCAACCAGG CTCTGGCTCG CTGGCTGCCC GCCGAGTATG
AGGATGGGCT GTCGCTCCCC TTCGGCTGGA CCCCCAGCAG GAGGCGCAAT GGCTTCCTTC TCCCTCTTGT
CCGGGCTGTC TCCAACCAGA TTGTGCGCTT CCCCAATGAG AGACTGACCT CCGACCGTGG CCGAGCCCTC
ATGTTCATGC AGTGGGGCCA GTTCATTGAC CATGACCTGG ACTTCTCCCC GGAGTCCCCG GCCAGAGTGG
CCTTCACTGC AGGCGTTGAC TGTGAGAGGA CCTGCGCCCA GCTGCCCCCC TGCTTTCCCA TCAAGATCCC
ACCCAATGAC CCCCGCATCA AGAACCAGCG TGACTGCATC CCTTTCTTCC GCTCGGCACC CTCATGCCCC

```
CAAAACAAGA ACAGAGTCCG CAACCAGATC AACGCGCTCA CCTCCTTTGT GGACGCCAGC ATGGTGTATG
GCAGTGAGGT CTCCCTCTCG CTGCGGCTCC GCAACCGGAC CAACTACCTG GGGCTGCTGG CCATCAACCA
GCGCTTTCAA GACAACGGCC GGGCCCTGCT GCCCTTCGAC AACCTGCACG ATGACCCCTG TCTCCTCACC
AACCGCTCGG CGCGCATCCC CTGCTTCCTG GCAGGTGACA CCCGATCAAC GGAAACCCCC AAACTGGCAG
CCATGCACAC CCTCTTTATG CGAGAGCACA ACCGGCTGGC CACCGAGCTG AGACGCCTGA ATCCCGGTG
GAATGGAGAC AAACTGTACA ATGAGGCTCG GAAGATCATG GGGGCCATGG TCCAGATCAT CACCTACCGA
GACTTTCTGC CCCTGGTTCT GGGCAAGGCC CGGGCCAGGA GAACCCTGGG GCACTACAGG GGGTACTGCT
CCAATGTGGA CCCACGGGTG GCCAATGTCT TCACCCTGGC CTTCCGCTTT GGCCACACAA TGCTCCAGCC
CTTCATGTTC CGCTTGGACA GTCAGTACCG GGCCTCCGCA CCCAACTCGC ATGTCCCACT TAGCTCTGCC
TTCTTTGCCA GCTGGCGGAT CGTGTATGAA GGGGCATCG ACCCCATCCT CCGGGGCCTC ATGGCCACCC
CTGCCAAGCT GAACCGTCAG GATGCCATGT TAGTGGATGA GCTCCGGGAC CGGCTGTTTC GGCAAGTGAG
GAGGATTGGG CTGGACCTGG CAGCTCTCAA CATGCAACGA AGCCGGGACC ACGGCCTTCC AGGGTACAAT
GCTTGGAGGC GCTTCTGTGG GCTCTCCCAG CCCCGGAATT TGGCACAGCT TAGCCGGGTG CTGAAAAACC
AGGACTTGGC AAGGAAGTTC CTGAATTTGT ATGGAACACC TGACAACATT GACATCTGGA TTGGGGCCAT
CGCTGAGCCT CTTTTGCCGG GGGCTCGAGT GGGGCCTCTT CTGGCTTGTC TGTTCGAGAA CCAGTTCAGA
AGAGCCGAGA CGGAGACAGG TTCTGGTGGC AGAACGAGGT GTTTTCACCA AAGACAGCGC AAGGCCCTGA
GCAGAATTTC CTTGTCTCGA ATTATATGTG ACAATACCGG TATCACCACG GTTTCAAGGG ACATCTTCAG
AGCCAACATC TACCCTCGGG GCTTTGTGAA CTGCAGCCGT ATCCCCAGGT TGAACCTATC AGCCTGGCGA
GGGACATGAG GCTTCTGCAG GAGTCTATCC CAAGTCTCCA ACTTTTGGAG ACAAGGGGAA GGGGAGGACC
ATGAGGCTGC CTTGTCTCCC TGGAGCAAGT GCAGGCTCGT GACGCTTCTG CTGGCTACAG CTCAGAGCTG
GGTTCCCCAG CCAGGAGTGA AGGCTGGGGG CTCCTATCAG CAATGGACCT TCCGCCTTGG GAGCCTCTTA
GGTATTAGGC TATGAATCAG CGCCACGTGC AAAGGCTTGG GAGCCAAGCC ATGTGGTCTT GCACCCCAGG
CAAGAAAAGT CAGCTGGAGG GTTTACAGCA CTTTCTACTG TTTCCCAGCC CTCCCTCCCC TCCCTCACCA
TGACTAAGAG ACCACTCGGT CCTAGCCTCC AGACACCCCA CAATACTCCT CTGAGCCTGA GGCCAGGCAG
CATGCTCTGC TTCTACCAAT AAAGCACTGC CGGAATTC-3' (FRAG. NO: _) (SEQ. ID NO: 2490)
5'-TC GGC CTG GTC CCG G-3' (FRAG. NO: 1727) (SEQ. ID NO: 1740)
5'-TGG GGG TTT CCG TTG-3' (FRAG. NO: 1728) (SEQ. ID NO: 1741)
5'-TG GTC CCG GBG BGC-3' (FRAG. NO: 1729) (SEQ. ID NO: 1742)
5'-GCG CTC GGC CTG GTC CCG G-3' (FRAG. NO: 1053) (SEQ. ID NO: 1061)
5'-GGG TCT CCT CTT GTT GTT GC-3' (FRAG. NO: 1054) (SEQ. ID NO: 1062)
5'-TTG CGC CTC CTG CTG GGG GT CC-3' (FRAG. NO: 1055) (SEQ. ID NO: 1063)
5'-CTC TGT TCT TGT TTT GGG GGC-3' (FRAG. NO: 1056) (SEQ. ID NO: 1064)
5'-GGG CCC GGC CGT TGT CTT G-3' (FRAG. NO: 1057) (SEQ. ID NO: 1065)
5'-GTT TGG GGG TTT CCG TTG-3' (FRAG. NO: 1058) (SEQ. ID NO: 1066)
5'-GGG TTC TCC TGG CCC GGG CCT TGC CC-3' (FRAG. NO: 1059) (SEQ. ID NO: 1067)
5'-GGC CGT GGT CCC GGC TTC GTT GC-3' (FRAG. NO: 1060) (SEQ. ID NO: 1068)
5'-CCT GTC TCC GTC TCG GCT CTT CTG-3' (FRAG. NO: 1061) (SEQ. ID NO: 1069)
5'-GGG CCT TGC GCT GTC TTT GGT G-3' (FRAG. NO: 1062) (SEQ. ID NO: 1070)
5'-GCB CCG TCC BGT GBT GGT GCG GTB CTT GTC GCT GCB GCG CTC GGC CTG GTC CCG GBG BGC-3' (FRAG. NO: 1063) (SEQ. ID NO: 1071)
```

Human Intercellular Adhesion Molecule-1 (ICAM-1)
Nucleic Acid and Antisense Oligonucleotide Fragments 5'-GCG CGG GCC GGG GGC TGC TGG G GGT TGG CCC GGG GTG CCC C GCC GCT GGG TGC CCT CGT CCT CTG CGG TC GTG TCT CCT GGC TCT GGT TCC CC GCT GCG CCC GTT GTC CTC TGG GGT GGC CTT C GCT CCC GGG TCT GGT TCT TGT GT TGG GGG TCC CTT TTT GGG CCT GTT GT GGC GTG GCT TGT GTG TTC GGT TTC TGC CCT GTC CTC CGG CGT CCC CGG BGC CTC CCC GGG GCB GGB TGB CTT TTG BGG GGG BCB CBG BTG TCT GGG CBT TGC CBG GTC CTG GGB BCB GBG CCC CGB GCB GGB CCB GGB GTG CGG GCB GCG CGG GCC GGG GGC TGC TGG GBG CCB TBG CGB GGC TGB G-3' (FRAG. NO: 1730) (SEQ. ID NO: 1743)

5'-GGG GGC TGC TGG G-3' (FRAG. NO: 1731) (SEQ. ID NO: 1744)

5'-T GTC CTC CGG CGT CCC-3' (FRAG. NO: 1732) (SEQ. ID NO: 1745)

5'-G CCB TBG CGB GGC TGB G-3' (FRAG. NO: 1733) (SEQ. ID NO: 1746)

5'-CTC TGG GGT GGC CTT C-3' (FRAG. NO: 1734) (SEQ. ID NO: 1747)

5'-GCG CGG GCC GGG GGC TGC TGG G-3' (FRAG. NO: 1064) (SEQ. ID NO: 1072)

5'-GGT TGG CCC GGG GTG CCC C-3' (FRAG. NO: 1065) (SEQ. ID NO: 1073)

5'-GCC GCT GGG TGC CCT CGT CCT CTG CGG TC-3' (FRAG. NO: 1066) (SEQ. ID NO: 1074)

5'-GTG TCT CCT GGC TCT GGT TCC CC-3' (FRAG. NO: 1067) (SEQ. ID NO: 1075)

5'-GCT GCG CCC GTT GTC CTC TGG GGT GGC CTT C-3' (FRAG. NO: 1068) (SEQ. ID NO: 1076)

5'-GCT CCC GGG TCT GGT TCT TGT GT-3' (FRAG. NO: 1069) (SEQ. ID NO: 1077)

5'-TGG GGG TCC CTT TTT GGG CCT GTT GT-3' (FRAG. NO: 1070) (SEQ. ID NO: 1078)

5'-GGC GTG GCT TGT GTG TTC GGT TTC-3' (FRAG. NO: 1071) (SEQ. ID NO: 1079)

5'-TGC CCT GTC CTC CGG CGT CCC-3' (FRAG. NO: 1072) (SEQ. ID NO: 1080)

5'-CGG BGC CTC CCC GGG GCB GGB TGB CTT TTG BGG GGG BCB CBG BTG TCT GGG CBT TGC CBG GTC CTG GGB BCB GBG CCC CGB GCB GGB CCB GGB GTG CGG GCB GCG CGG GCC GGG GGC TGC TGG GBG CCB TBG CGB GGC TGB G-3' (FRAG. NO: 1073) (SEQ. ID NO: 1081)

Human Vascular Cell Adhesion Molecule 1 (VCAM-1)

Nucleic Acid and Oligonucleotide Fragments

5'-CCT CTT TTC TGT TTT TCC C CTC TGCCn TGT TTG GGT TCG CTT CCT TTC TGC TTC TTC C CTG TGT CTC CTG TCT CCG CTT TTT TCT TC GTC Tn GTT GTT TTC TCT TCC TTG CTG BGC BBG BTB TCT BGB TTC TGG GGT GGT CTC GBT TTT BBBB GCT TGB GBB GCT GCB BBC BTT BTC CBB BGT BTB TTT GBG GCT CCB BGG BTC BCG BCC BTC TTC CCB GC C BTT TTB BGT TGC TGT CGT-3' (FRAG. NO: 1735) (SEQ. ID NO: 1749)

5'-C TGT CGT-3' (FRAG. NO: 1736) (SEQ. ID NO: 1749)

5'-TGC TTC TTC C-3' (FRAG. NO: 1737) (SEQ. ID NO: 1750)

HSVCAM1AS1: 5'-CCT CTT TTC TGT TTT TCC C-3' (FRAG. NO: 1074) (SEQ. ID NO: 1082)

HSVCAM1AS2: 5'-CTC TGC CTT TGT TTG GGT TCG-3' (FRAG. NO: 1075) (SEQ. ID NO: 1083)

HSVCAM1AS3: 5'-CTT CCT TTC TGC TTC TTC C-3' (FRAG. NO: 1076) (SEQ. ID NO: 1084)

HSVCAM1AS4: 5'-CTG TGT CTC CTG TCT CCG CTT TTT TCT TC-3' (FRAG. NO: 1077) (SEQ. ID NO: 1085)

HSVCAM1AS5: 5'-GTC TTT GTT GTT TTC TCT TCC TTG-3' (FRAG. NO: 1078) (SEQ. ID NO: 1086)

CTG BGC BBG BTB TCT BGB TTC TGG GGT GGT CTC GBT TTT BBBB GCT TGB GBB GCT GCB BBC BTT BTC CBB BGT BTB TTT GBG GCT CCB BGG BTC BCG BCC BTC TTC CCB GGC BTT TTB BGT TGC TGT CGT (FRAG.

-continued

NO: 1079) (SEQ. ID NO: 1087)

Human Endothelial Leukocyte Adhesion Molecule (ELAM-1)

Nucleic Acid and Antisense Oligonucleotide Fragments

5'-BBG TGB GBG CTG BGB GBB BCT GTG BBG CBB TCB TGB CTT CBB GBG TTC TTT TCB CCC GTT CTT GGC TTC TTC TGT C CGT TGG CTT CTC GTT GTC CC TGT GGG CTT CTC GTT GTC CC CCC TTC GGG GGC TGG TGG GGC CGT CCT TGC CTG CTG G GTT CTT GGC TTC TTC TGT CCG T TGG CTT CTC GTT GTC CC TGT GGG CTT CTC GTT GTC CC CCC TTC GGG GGC TGG TGG GGC CGT CCT TGC CTG CTG G CCTGAGACAG AGGCAGCAGT
GATACCCACC TGAGAGATCC TGTGTTTGAA CAACTGCTTC CCAAAACGGA AAGTATTTCA AGCCTAAACC
TTTGGGTGAA AAGAACTCTT GAAGTCATGA TTGCTTCACA GTTTCTCTCA GCTCTCACTT TGGTGCTTCT
CATTAAAGAG AGTGGAGCCT GGTCTTACAA CACCTCCACG GAAGCTATGA CTTATGATGA GGCCAGTGCT
TATTGTCAGC AAACGTACAC ACACCTGGTT GCAATTCAAA ACAAAGAAGA GATTGAGTAC CTAAACTCCA
TATTGAGCTA TTCACCAAGT TATTACTGGA TTGGAATCAG AAAAGTCAAC AATGTGTGGG TCTGGGTAGG
AACCCAGAAA CCTCTGACAG AAGAAGCCAA GAACTGGGCT CCAGGTGAAC CCAACAATAG CAAAAAGAT
GAGGACTGCG TGGAGATCTA CATCAAGAGA GAAAAAGATG TGGGCATGTG GAATGATGAG AGGTGCAGCA
AGAAGAAGCT TGCCCTATGC TACACAGCTG CCTGTACCAA TACATCCTGC AGTGGCCACG GTGAATGTGT
AGAGACCATC AATAATTACA CTTGCAAGTG TGACCCTGGC TTCAGTGGAC TCAAGTGTGA GCAAATTGTG
AACTGTACAG CCCTGGAATC CCCTGAGCAT GGAAGCCTGG TTTGCAGTCA CCCACTGGGA ACTTCAGCT
ACAATTCTTC CTGCTCTATC AGCTGTGATA GGGGTTACCT GCCAAGCAGC ATGGAGACCA TGCAGTGTAT
GTCCTCTGGA GAATGGAGTG CTCCTATTCC AGCCTGCAAT GTGGTTGAGT GTGATGCTGT GACAAATCCA
GCCAATGGGT TCGTGGAATG TTTCCAAAAC CCTGGAAGCT TCCCATGGAA CACAACCTGT ACATTTGACT
GTGAAGAAGG ATTTGAACTA ATGGGAGCCC AGAGCCTTCA GTGTACCTCA TCTGGGAATT GGGACAACGA
GAAGCCAACG TGTAAAGCTG TGACATGCAG GGCCGTCCGC CAGCCTCAGA ATGGCTCTGT GAGGTGCAGC
CATTCCCCTG CTGCAGAGTT CACCTTCAAA TCATCCTGCA ACTTCACCTG TGAGGAAGGC TTCATGTTGC
AGGGACCAGC CCAGGTTGAA TGCACCACTC AAGGGCAGTG GACACAGCAA ATCCCAGTTT GTGAAGCTTT
CCAGTGCACA GCCTTGTCCA ACCCCGAGCG AGGCTACATG AATTGTCTTC CTAGTGCTTC TGGCAGTTTC
CGTTATGGGT CCACCTGTGA GTTCTCCTGT GAGCAGGGTT TTGTGTTGAA GGGATCCAAA AGGCTCCAAT
GTGGCCCCAC AGGGGAGTGG GACAACGAGA AGCCCACATG TGAAGCTGTG AGATGCGATG CTGTCCACCA
GCCCCCGAAG GGTTTGGTGA GGTGTGCTCA TTCCCCTATT GGAGAATTCA CCTACAAGTC CTCTTGTGCC
TTCAGCTGTG AGGAGGGATT TGAATTATAT GGATCAACTC AACTTGAGTG CACATCTCAG GGACAATGGA
CAGAAGAGGT TCCTTCCTGC CAAGTGGTAA AATGTTCAAG CCTGGCAGTT CCGGGAAAGA TCAACATGAG
CTGCAGTGGG GAGCCCGTGT TTGGCACTGT GTGCAAGTTC GCCTGTCCTG AAGGATGGAC GCTCAATGGC
TCTGCAGCTC GGACATGTGG AGCCACAGGA CACTGGTCTG GCCTGCTACC TACCTGTGAA GCTCCCACTG
AGTCCAACAT TCCCTTGGTA GCTGGACTTT CTGCTGCTGG ACTCTCCCTC CTGACATTAG CACCATTTCT
CCTCTGGCTT CGGAAATGCT TACGGAAAGC AAAGAAATTT GTTCCTGCCA GCAGCTGCCA AAGCCTTGAA
TCAGACGGAA GCTACCAAAA GCCTTCTTAC ATCCTTTAAG TTCAAAAGAA TCAGAAACAG GTGCATCTGG
GGAACTAGAG GGATACACTG AAGTTAACAG AGACAGATAA CTCTCCTCGG GTCTCTGGCC CTTCTTGCCT
ACTATGCCAG ATGCCTTTAT GGCTGAAACC GCAACACCCA TCACCACTTC AATAGATCAA AGTCCAGCAG
GCAAGGACGG CCTTCAACTG AAAAGACTCA GTGTTCCCTT TCCTACTCTC AGGATCAAGA AAGTGTTGGC
TAATGAAGGG AAAGGATATT TCTTCCAAG CAAAGGTGAA GAGACCAAGA CTCTGAAATC TCAGAATTCC
TTTTCTAACT CTCCCTTGCT CGCTGTAAAA TCTTGGCACA GAAACACAAT ATTTTGTGGC TTTCTTTCTT

```
TTGCCCTTCA CAGTGTTTCG ACAGCTGATT ACACAGTTGC TGTCATAAGA ATGAATAATA ATTATCCAGA

GTTTAGAGGA AAAAAATGAC TAAAAATATT ATAACTTAAA AAAATGACAG ATGTTGAATG CCCACAGGCA

AATGCATGGA GGGTTGTTAA TGGTGCAAAT CCTACTGAAT GCTCTGTGCG AGGGTTACTA TGCACAATTT

AATCACTTTC ATCCCTATGG GATTCAGTGC TTCTTAAAGA GTTCTTAAGG ATTGTGATAT TTTTACTTGC

ATTGAATATA TTATAATCTT CCATACTTCT TCATTCAATA CAAGTGTGGT AGGGACTTAA AAAACTTGTA

AATGCTGTCA ACTATGATAT GGTAAAAGTT ACTTATTCTA GATTACCCCC TCATTGTTTA TTAACAAATT

ATGTTACATC TGTTTTAAAT TTATTTCAAA AAGGGAAACT ATTGTCCCCT AGCAAGGCAT GATGTTAACC

AGAATAAAGT TCTGAGTGTT TTTACTACAG TTGTTTTTTG AAAACATGGT AGAATTGGAG AGTAAAAACT

GAATGGAAGG TTTGTATATT GTCAGATATT TTTTCAGAAA TATGTGGTTT CCACGATGAA AAACTTCCAT

GAGGCCAAAC GTTTTGAACT AATAAAAGCA TAAATGCAAA CACACAAAGG TATAATTTTA TGAATGTCTT

TGTTGGAAAA GAATACAGAA AGATGGATGT GCTTTGCATT CCTACAAAGA TGTTTGTCAG ATGTGATATG

TAAACATAAT TCTTGTATAT TATGGAAGAT TTTAAATTCA CAATAGAAAC TCACCATGTA AAAGAGTCAT

CTGGTAGATT TTTAACGAAT GAAGATGTCT AATAGTTATT CCCTATTTGT TTTCTTCTGT ATGTTAGGGT

GCTCTGGAAG AGAGGAATGC CTGTGTGAGC AAGCATTTAT GTTTATTTAT AAGCAGATTT AACAATTCCA

AAGGAATCTC CAGTTTTCAG TTGATCACTG GCAATGAAAA ATTCTCAGTC AGTAATTGCC AAAGCTGCTC

TAGCCTTGAG GAGTGTGAGA ATCAAAACTC TCCTACACTT CCATTAACTT AGCATGTGTT GAAAAAAAAA

GTTTCAGAGA AGTTCTGGCT GAACACTGGC AACGACAAAG CCAACAGTCA AAACAGAGAT GTGATAAGGA

TCAGAACAGC AGAGGTTCTT TTAAAGGGGC AGAAAAACTC TGGGAAATAA GAGAGAACAA CTACTGTGAT

CAGGCTATGT ATGGAATACA GTGTTATTTT CTTTGAAATT GTTAAGTGT TGTAAATATT TATGTAAACT

GCATTAGAAA TTAGCTGTGT GAAATACCAG TGTGGTTTGT GTTTGAGTTT TATTGAGAAT TTTAAATTAT

AACTTAAAAT ATTTTATAAT TTTTAAAGTA TATATTTATT TAAGCTTATG TCAGACCTAT TTGACATAAC

ACTATAAAGG TTGACAATAA ATGTGCTTAT GTTT GATCAAAAT TTTACCTATT ATGCATTTGA TATATAAATA

AGTATATAAA TGCACACACA GACACAGCAA TGATGGTGAA CAGTCTTCAT ACAATTATAT GGATGAATCT

CATAAAAATGC TGAGTTAAAG AAATCAGACC AAAGAACATA TACTGAAAGA TTCTCTCTAT ATACAAAGTT

CAAAAATAGG TGGACCAATT CATGGTGGTG TTAGAAATCA GAAGAGAGGC TACCTTTGTG GGGAGGGGAC

AGTTTAATGC CCAGAAGCGG TAAATAAGGA ATCCTCTGGG GAGTGGTAAT GATCTGGATG CTGGCTACAG

GATGTGTTGG TTGTAAAAAT GCATTTTTTT ATATCTAGCT TTTTCCATGT GTATATTATA CTTCAAAGAA

GTTCAGTTAA TAATTTCTCA TGTCACTGTA GAGTAGCTCA GTTAGCCCCA GCAAGCCTCT GGCTTAATCT

TGTTTTACCT TAAGCCATCA GTCATTTACA AGTAGGAAAA TTCACAGGGA AGTTAGAGT ATAAAATCCA

GAATGAAGGT TTACTGGGTA AGAGTCTCTC CATTTTCCAA AGCCCGTTTA TTTCTTGATT CCAGTTCTTA

AGAAGTCTCA GCATTGTGTC TTTTTCATGT ATCTTACAAG AAGACAGCAT GTGCTTCTAA CACCTGATAC

ATTGTATCTA CCAGCACTTG GTAAACGAAA AGAACCACA TTTTTCTTGT AGGAGAAATT TGGTGCCTAT

TTCCTACCAG GCACCAATAA GTGGGACCAA TAGGTGGGAT TAAAGATACA GTAGAAAGTA TTTAAAACTT

GCCAGGGGC AATAGTCTGA AAATAAGTAA ATTGGTGCTA TAGAATGGAA GTTACAGGCT TCTTTCTTTT

TTCCCACAAG ATCTGCTCCT TGAGCCCCTA GAGACTTTTC TGTCTGTTAC TGTTTCTTCA TTCCTCATCT

GCAGAGCCAG CCCTGAGAAG TGCAGACCAA AGCCAGGGAA GGCTCTGCAA AGATGTACAA ATGGAAGTCA

CCTTAATAAC CTCTGACTGC TGCGCATAAT ACATTTCACT CAAAAGAGGG GTTAAACAAT GGAACAGAAT

ACAGAGGCCA GAAATAATGC TGAACACTGA CAACCATCTG ATCTTTGACA AAATCCACAA AAACAAGCAA

TGGAGAAAGG ACTCCCTATT CCATAATGGT GCTGGGATAA CTGTCTAGCT ATATACAGAA GATTGAACCT
```

```
GGGCCCCTTC CTTACATCAT ATACAAAAAA TAACTCAAGA TGGAGTAAAG ACTTAAATCT AAAACCAAAC
ACTATAAAAA CCCTGGAAGA TAGCCTGGGA AATACCATTC TGGACATAGG ACCTGGCAAA GACTTCATGA
CAAGACACCA AAAGCAATAG CAACAAAAAC CAAATTGACT AATGAAACTA ATGAAACTCT TTAGTTGTAC
AACAGATAGT TTATCTGTAC AACAAAATAA ACTATCAACA GAGTAAACAA CCTACAGAAT GGAAAAATTT
TTTGCAAACT ATGCATCTGA CAAAGGTCTA ATATCCAGAA TCTATAAGGA ATTTAAACAA ATTTACAAGC
AAAAAAATGA CCTCATTAAA AAGTGGGCAA AGGACATGAA CAGATGCTTT TCAAAATAAG ACATTCACAC
ATCCAACAAC CATATGAAAA GATGTTTAAC ATCACTAATC ATTAGAGGAA TACAAATCAA AAGCATAATA
AGATACCATC TAATACCAGT AGGAATGACT ACTATTAAAA AGTCAGACAA TAACAGATGC TGGTGAAGGT
TGTGGAGAAA AGGGAATGTT TATGCACTGC TAGTGGGAAT GTAAACTAGT TCAGCCATTG TGGAAGAGAG
TGTGGTGATT CCTCAAAGAA TGTAAAACCG AACTGCCTTT CAATCCAGCA ATCCCATTAT GGATATACA
CCAAAAGGAA TAGAAATTGT TTTACCGTAA AGGCGCATGC ATGCATATGT TCATTACAGC ACTATTTACG
ATAGCAAAGA CATGGAATCG TCTAAATGCC CATCAGTGGT AGACTAGCTA AAAAAAAAAA AATGTGGTAC
ATATACATCA CAGAATAGTA TGCAGCCATA AAAATGAACA AGATCATCAT GTCCTTTGCA GCAACATGGA
TGTAGTTGGA GGCCATTATC CTAAGCAAAT TAATGCAGGA ACAGAAAGCC AAATACCACA TGTTCTCATT
TATAAGTGAC AGCTAAATAT TGAGTACACA TGGACACAAA GAAGGGAACA ATAGACATGG GACCTACTTG
AGAATAGAGG GTGGGAGGAG GGTGAGGATC AAAAAGTACC CATAGGACAC TGTGCTTATT ACCTGGGTGA
TGAAATAATT TGCACACCAA ACCCCTGTGA CACACAATTT ACCTATATAG AAAACCTGTG CATGTACCCC
TGAACCTAAA AGTAATGGT GGGGGGTGG GGTTAAGCTA CTTTGTGGTA TAAATCTGAG CATTCATATT
AAAATAAAAT ATTTACCTCA TTAGAGTAAT TAACATTTAT TAAGCAAAGA GCCAAGTACC TTACACACAT
GATGTTTAAT CTCACAATGA TCTTTAATCT CATAACAACC GTCCATTGTA TGTACATATG TGGAAATTGA
GCCTTGGAGA GATTAAATGC ATGGGCATG CCATTTGACT AGAAACTGGA AGCATCAGGA TTTAAACTCA
GTTCTGAATG GTTTTGTAGG CTTTGTTTTT TCCACATTAT AGCATGGCCT GCCATGAAGA ACAGGTCCTT
TCTGGTGTTT GTCTTGTTTG GTTAAGTGA AGCAAATATT TATTTAAATA TTCAAGATAT GCTGTTAAAT
TTTTACTCAA AAATTTGAGT ACAGTATGGA TCTTCTGAAG CCAAATAACT CTTATTCAAT GCTTAGTTGA
GAAATTTTAT GGAGTAGTTC TCAATTTTTA TGTAGTTCCA CTGCAAAGGT AAGTCTTATG GAAAGATTCA
CTGTAATTTT TTTTCCTCAT TTGGACATCA GCTTTTCTT TTCCTCAGAC CCGCTGAAAG ATAATTTTTA
AAATAAAAAC CTTGTTTTTA TATCAAGTGG GGACATTTTT TCCAAATGAA AACCGTGTAT TCATTTTATA
TGATAAAATC AATGTTATTA TTTTTAAAAT TTTGATTTAA AAATCATTAA AAATAAATTT TCAGATATTA
CCTGAAATTC TACCATCCAG AGATAATAGT GCTTAAAGAT TTGATATATA GACACACACA CATATATACA
TATATATCAT CCTAAACTTC TTTGTATAAA TGTATATAAA GTTTTTAATA AAAACTAGGA GATTAATGCC
CTTTGAATGA AAATAAATAC AATGTGTATG CTTTAACATC TTGCCTTTAC TTTATAACAT TTATCACAGC
AGTCATGAGA TAATGATTTA CATGGTCATT GTTAGTAAGC TAATAGCTAA GTGCATGAAC TCTGGAGCTA
GCCTCCCTGG ATTTTAATCC CAGATCTGTC ACTGACCAGC TGAGCAATAC TAGGTAAATT GCTCTTGTTC
CTTAGTTTCT TCATCTGTAA AATAGAGATA AAAATAATAT CCACCTCATA GGATTGGTGT GAGCATTAAA
TGAGCATACG TATGTAGGCC ACTTAACAAC AATGCCTTCA CATACTGAAC ACAAATATAC GAGCTGTTGT
CTTATTGGGC TCATGTTTTT CCTACCACTA AGCCGCATGC ATGCAAGGAC CATGTTGGTT TTGTTCCACA
TTGCATCCCC AACCTGGTAT ACAGTGTGCA TTCAATAGTT GTTGACTATT ATTACTAGTG GCATTTAACA
AATATCTGTT AAATGAGTGA AGAAATACCC ATTTACTGCA AGTGTGTCTA ATATTGATGG CATAATGGGG
GAAACTCAAA CTCTGGAGTC AAACAGGTTT TAAAACCTTA TTCCCTCATC CTCAGTTATT GACGTTTTTT
TTTTGGCAGG TGTGTGTGTG GGACAACTTA TTGAACTTTT CTGAATTTCC AGCTTCGCAT ATATAAAATA
```

-continued

```
GAGATAGTGA TTCATTCTTG CAATGTATGG ATTTGAGACA ATTGTGTAAG TTTATCAATA AATAGTAGCT

ATTTTTGTAT AAGTATTACA TATAATATCC AGGCCACTGC TTTGCATAAC CCAAAAGGGG CACCATTCAT

GCAGAATACA ACATAAATGG TGTCCCTGGA GCAGTGCAGT ATAGGAACCC TGAGGGGACC TACAGTATAC

TTTATAGTTC ATAGATTACA AATTATCCCT TTATCAGAGT CTCTCAAGGT TGGATGTATT TGAGGTCCAT

AAGAGCAATT TAGGATTAAC AGTAGCTGCA GAAACCATCT GCAGTGATAT TCTCATTTTA AATCCGCGGG

AAAGAAGACA GCTATAAACT TGGGACCTGG GTTTAAGCAT TTTAAATGCC AAGTTCACCA TTTTCTAAAA

CACAACAAAT ACCCAGTGAG AGAGGGAGAA GGGAAGTAAA TGCCTCTGAA TAAGCAAGTT AATGTCAGTA

GTTGTACTGT ATGCATATTG ATGAACAATA GAGGAACCAA TGTCCAATCA GATGAGCAGG ATATTTGGCA

ATAACAAGTT GCCTTTGAGG AAAAATGATT TTCTTGGCAA GTTCTTTATC AGCATTACAA AGCTAAAAGC

TACGCTTATC ATCACTTATA CTAGCATACC CTGTTGTGCA AATGCTGTCT GTGTTTGCAT CTGCTATTGT

TGATGCCTGG TGCATGAATC AGGACTCCAG CCCACAAGTT TTCCCAGAAC TTTCTTATGG CCATCATCTT

TAAGTGTCTG GTGAACAGTC ATAGTTTGGT ACACAAAAGG GTCAACCTGG GGGATGGCTA GGGTTTGACT

CAGTCGTTAC ATTTCAATAG AGCAGGAAGG GGAAATGGTG GCCTGTAACC TCAGGGAATT TTGCCAGTTG

GTCCACCCCA CTCTCTCTCT CCTGCTCTGA GGAAGTGGCA CAGCCTAGAA CAGCACCACA GGTGAGAGAA

ATGCAAACCC TAACCAGAGA AGCAGACTCT TTGCCAGTAG TAATAGTTCA GGACCACCAC CAGCTTTTAT

TAAAATTTTT AATAACACTC AAGTATTGGC AGAAAGAAAT AATCTTGGGT TAACTATAAC TAGAATATTG

ACTCTTCCTC TGTGGAAGAA TCAGCCAATC ACATTTGTTT ACATCAGTTC CCCTGAAGAA GAAAAATACA

CTGATGTTGC AGCAAGACAA ATTTAAGCTA GATGTAAATA ACTTCCTTTA GCCTGTAATG CTAGGCTAAT

TACATATTGG AACTATTTTT TCAGGGAAGA ATTGTGTAGG GTTTCAGGGA AGAATTCTGA AGAAAATATA

GAGCTGAAAT GATCTTGCAG CTCACTGAAA CTGCAGGGTT TAGATCCACA CTGATACTCG TTCTATTATC

ACTGTAATGA AGGCTGATGG AATAAGTAAA AATGTTTTGT ATTAGTATGT TTTTACACTT ATTTGCAAGG

CATAAATAGG TTAGGTTTTG ATCTTAATTT AATTCTAACA TGTATTGTGC ACAAGCTGTG AGCAGTTTTC

AGGAGTTAGG TATCTGGCCA TGACTGATTT TCAGGAGTT AATCATCTGG TAGAAGGGTC ATACACAATA

GGAAGATGTG TGTGACAGGT TGTGATCATT ACTATAATCA CACAGAGAGC TGTAGAATTT TAGGCTGGCA

GGGTGGCTCA CGCCTGTAAT CCCAGCACTT TGGGAGGCCA AGGCAGGCGG ATCAAGAGGT CAGGAGATGG

AGACCATCCT GGCTAACACG GTGAAACCCC GTCTGTACTA AAAATACAAA AAAAAAAAAA AGCCAGGCGT

GGTGGTGGGC GCCTGTAGTC CCAGCTACTT GGGAGGCTGA GGCAGGAGAA TGGCGTGAAC CCGGGAGGTG

GAGCTTGCAG TGAGCCGAGA TCGCATCACT GCAATCCAAC CTGGGCGACA GAGGGAGACT CAGTCTCAAA

AAAAAAAAAA AAAAAAAGTC ATGTTAGATC CAGAGGGGTA GCAACTGGGG CTGGGCTGTC AGTCAACTCA

GTCAACTCAG TCAACTCTGC TCCCCCACAG GAGATGCCAG TGATGCATTT TCATGGCCAA CATTGTCAGT

CAGCATCATT GAATTACTCC TGATTATAGA GACACAGCTG CAAACGATTC CCCATTAAAT ATGATGTTTC

TTGCAATGTT TGGAAGGTAC TCCTTTTTAG TAAGGGAAAT CCCCTCTTCT GGCTTGCTGA AAGTTTTTTC

TTTCCATTTT AAAAATCGTG AATTCCTTTT TGCAATATTG AGGTGGTTAT ATGGTTTCTC TTCTCTAATC

TGTTAATATG GTGATTTAAT GGTTAGAAAT TTTCTAATGT AAATTCCACT CATATTGCAG AAATAAACCT

AAACTGAGCA TGAGGCTATA TTTTTTATTT GCTTCTATAT TTGGTTGCTA TACAGTATTA TGTTTAAGAT

TTGTTCACAT ATATTGTGA ATGGGATTGG ACTATTTTTC CTTCTTGCCG ATTTTTATCT GGTTTTTAAA

TTAAGGATAT TTTAGACTTA TGAAATATTT GGCAAACAAT CCTTGGCAAG TAATTTTTTG GGGAATTTGT

TTTGGCTATT TTGAGTATTA CCCAATATAT TTTAATTAAG TTATTCTTAA TGTTTTCTTA ATTAAAAAAA

TTACCTACTC TAGAGATATT CTTTATGTAC TCCAGATTTT GTCTATTTAT ACCACTTTTC TTTTTTCCTC
```

```
GATGAGTGTC ATAGATGTTC ATCTATTTTT TTATCTTCTT TGATCTTCTC TTATTCCTTG TTTCTATTAA
CTTCTGAAGT TTATTATTTT CTTTTTTCCA CTTCCTTATG GTTTATTCTT TCAATTTTTC TCTAACTTCT
TAAGTTGGGT GTTTAATTTT TAGCTTGCTT TGCTTTTTTA GGATAAGCAT TAAAACTACA AATTTTCCTT
GTTATTCTTT TGCTGCACCC CAAATTGTTG ATATTTCTAT TGTCTAATTT CTATTCAATT AGAATACTTT
AAAGTTTCTT TTTGGTTTTT AAAAACTAAC TTTTTAAATT GACAAATAAA AATTGTGTAT ATTTATTGTG
CACAGCATAT GGCTTTGAAA TATATGTACA TTGTGGAATG GCTAAATTTA GCTTATTAAT GTATGCATTA
TCTCACATAC TTATCATTTT TTGTGGTGAG AGCTATGTGA CTTTTGAACT TATGAGTTAT TTAAATATTT
TTAAATTATT AAGCATATTG GGATTTTAAG TAATTTACCT TTTTATTATT AACTTATAAC AAGTAGAACA
GTTAACCTGT ATGATTCTAC ATCATTGAAA TTTATTGACA TTTGCTTCAT AGTCTATTAT ATGGTCTACT
TTTGTTCATG TTACATCTGT AGTAGAATTG GCTAATAGTT GAGTAAAGTA CACATATGTC TATGAAATCA
AGTGTAATCC AGAGAAAAAG AGAAATTTAC TGAATATATT GTTCTAGGTG CTATTATATG TTGTCATGTT
TAATCCTCAC CACAATTGTA TGAGGCAGCC ATAATTAATT CCACTTTACA CATGAGGAGC CTGAGGGTTA
AAAAAAAAGC TAGCTCTACT ATTTGTAAAG AATGAAGCAA AGATACAAAT GAAGGCCCAC ATATCCTATA
ACTAGATATT TAAGCATTTT AATTCAAGCT TTAAAACTGC TAAATAAAAT GTGCTCCAAT TTCTATATTG
ACAGACATAC CTTCCTAATG AGCTGGGGTT CGAATTTAGA AATCTTTGAT GCTTCAGAGT CCACACTGAA
ATGTGGAGGC ACATAGTGAG TTGGTCCCCA GCCTTCAGTC CACCCACCTT CTCTTTACTA AATCACCTTT
CACATACATG TATGAACACC CCAGCCTCCA AGTCCAAACC CTAAACAAAA TGGGACACCC TTGTGCATAC
ACAGAGACAC AGCCCATCCT CAGGAAAACC TGGAAAAGTC CATACAAGTT CTGGAAGCAA GCTTGGGACG
GTTTCAGTAG TGTGGTCTAT AAGGGAGGCC TCAGAAGACA GGTTTTCTTA ATTCTGTGAA CTTCTCCCAC
AGTAGAAAGG GTGCTGGAGG AGGGTCAGAG TGAGGACTTC TAAAGCATGG GTCCTGAGTA GGGGCCACTC
TTGCCCAAGT CTAAGAAGGG TACTAGAATA GCACACTACT ACTAGATACT AGAACCCAGA TACAAGCACA
GGTCTTCTGA AATTAATAAT AATAATAACT ATTACCATTA TTATACCAGT AGCTGTCATT TATTTAGTGC
TTATTATTTG CCAGTCACTG TTCTAAATTC TTTACATGTA TTATACAACT GCCATATAAC TGCCATATGA
GGGATGTACC CTCATTGTCA CCATTTTACC GATGAGAAAA CTGGCATAAA ACGTTTAAGT AACTTGTCCA
AGTTACAGAG CTTAGTGAAG CCACAATGTT GCTCAATTTG CTCTCAAACT TCAAAGGGAT GGGAAGGACA
CCTAAGTCAT AGAGTCTTTA AGAATCAGAG CTAGAAGGAA TCTTAGATGT TATCTAGTCA GCCTCCTCCC
ATTACAGTCC AAGAGAAGAT GGCCCTGAGT TACTTGTAGC TATTTTTGCA TGTGAATTGC AAGTGAATAT
ACATTCTACT GAAGATAAAA GATATTTAAA GATATCGCTG GATATAGGAA CAGTGGTTTT AAATCTCTAG
GCTTTAACTT TTCTCAGAAC AAGAAATCCT TTTTGGTTTT AATCTATATG CACATCTGTA TTTTTCTCAA
TTATCGGGTA GTAAAATATA ACTTTTCTTC TGTAATATTT TTTAACTTTA ATGAGTGTTC CTCATAATAG
AAAAGTTTGG AAACCATTGC TATGGGTATA TACTTTCTAA AGGGATAGTA ATTTCTCTAG AATATTCATT
TAATGCTCCA GAAGTAATTA GCACAATTGT GCAAGTCTGT GCATCATCAA CTATACATTC TGCCTGTTTA
CTCCAAATCC ACATGAAACT GATTATACAG TCAAAGGCGA GCCCAGTGGA GAGGCATTTT TGGAGACTTC
CTGGTACATT GAGACAGGGT CGGCCAGTCT GCGTTAGGGT CTTGGTCAAA ACTGCATTTC TGAAACTAAA
CTCAGATTGC TTTCTTTTAA GGGGTCAGAA CTGATTCAAA TCTACATTTT TAAAAGCCTT AGATGTGGGG
CTTTTCCTAT TCCCAGTCTC CGCTATTGGT CTTTGTGAAT CCACAGGCAA TTTGGCCACA TCCTTGACTC
TCTCTTATAT TAAGAATTAA ACAGCTAAGT TCATGCAGAG GAAATATAAC AAAGGAGGGA CTTTCCTACA
AGATCTTTGA AAAATGGAAC ATTTGCATAA GTCATATTTA GCCAGAACTG TTGTTTTATA TTTTCCTTTC
TGAATACTTT GTTACACCTC CTCCCAGCCA ACCCCCCCCC TCCCTGACCC CAACTAGTCA GAGACCAAAG
CCTTCACAAT GGTTTACACT TGAACCTTCC TGGCCCCACC CTCATCATCA CGCCTGAATA ATTACATTCA
```

-continued

```
CTGACTGGTC TCCCCTGCTT CCGTTTATCT CCACTCCTAA ACCCTCTGAC ACCTTAATCT TCCCAGAATA

CCATTGTGAT CCTGTTCCAC TCTTGCTCAA GTTTTCCCAG AAACTAGAGT ACAAACTTTA TAAGCTTTAG

AGTTGAAAGC CACTCTATCT CTTTTTCATC CCCAGGTCTC TGCCAAGGCA GTATAACCTG TCCAACATCT

CTAACTTCAA TACCTTTGTC TTAGATACTA GACTCTCCTC CTGGTTTCTA ATTAAACCTG ATCTAGGATC

TAATTTTGCC TCTGAATTCT GTTGCCCTTT GCCAAGTGAT CTCTTCCTCC TCTGAGCCGC AGCATCTCTG

AGCTTGCACA CTTAGCATAG CCATAGCACA CACAGCCTTA GCTTGCAGTT CAGGGTGTTT ACCTTCCCTC

CCCTTCCAGA TGCTGGATCC CCAGGGATAG GAACTCTGCC CTTATGTGTC CATAGCCCCT GGTAGTATGT

CTTGCAGTCG TACATTTTCA GCAAATGTTT AATTGGTTAA TTGAAGACAA CTGTCCCATG CCTTAAGCCT

CTCTTTTTGC TAAACATGCC TGTGTCCTTT GTCATTGAAC AACTATTTTG ATCTATTTTC TTCCTGACAT

AGGGGTCAGT TCCGAGGATG CTGAAATCAA GAGACATAGC TTATTCTCTC AAAATTGCTT TCAAGAGTGA

TTTTGTTGTG AATTGAGAAC TGGCTGCCTA CTTTTGGACT ACCCACTTCA GCAAGAGTGT TTGAAACCAA

ATCTATTCTA AGTAATTTTT TATTCCCTTT TCTCTATGGC ATTAGACACA CAGCTCTTTT AAACTACCTT

TCGTTATCTA TTAAACAGAC ATTCAGTAAC TCTATAGACA CTGTCTAGCT ATATGAACTT AGACAAACTA

ATATCTCTGA GCTTCAGTTT CTTAAAATTT AAAATGAGGA CAATACCATC TATGGCCGGG GATTAAATGC

TATGAGGAAT GTAAACCAGA TGTCAGGTAC CATCTCTCTA AAATCCAGAT AAAATGAATT AAAAATACTG

GCCGCAAACC CTCTCTAAGA GTTCTCAAAA TTCTCAGAGA GCTTAATTTT CATGCTCACC ATAGCACCGA

TTTTCTTCTA AATATTTTGT TTCTACCAAA ATATTTTGTC CCAATTTTGC CTTTTATGGC TATTTCTTCA

TATCCACTTT CCCAAACTAA AGAAGCAGCC CCTTCACCTT AAACTCCTCC TTCAAAGCAA CCTAAATACA

GGTCTGGGTT TGTATTCCTA GTGGGATGTT ACAGAGGTTA GTGTGATGCA GAGGAGGAGT CATGCTGTTT

AAATCCATAC TAGTCCCCAG AGGCCAGGCT GCTTCTGCCA CCCCTACCCC TCCCGCCACA GAGCTCTTCA

GCTTCTCACA TTTCTAGTTC TTCTCTCTCT ACTTTCATTA CCTTCTCTCT TTTTTTTTTT CTTCTCATGT

GCTCACGGGA GCAGAGAAAA TTAACTCCTC TAAGTTTTCT TAACACAGAG TGCCTTAATT ACATATTACT

ATTGTTTGAG TTCCTGCCAA CACTACGTCT GTAGGGTCAC ACCTGCTATA TTAGAGGCTT ATCAAAAAAA

GATAGCTTTC TCCTAAAAAG GGATTTGGAT GCCTACTAAG ATAACTGGAT GCCAAGATAA GTTTAACCTA

ACAAACTTTA TTATTATTAT TATTATTATT ATTAGAGATA GGTACTTATT CTGTCACCCA GACTGCAGTG

CAGGGATGCA ATAATAGCTC ACTGCAGCCT CAAAGTCCTG AGTTCATGCA ATCCTTCTGC TTCAGCTCCC

TGAGTAGCTA GGACTACAGG CATATGCTAC TCTGCCCAGC TACTTTTAAA AAAATAATTA GGGATGGGGT

CTTGTTGTAT TGCCCAGGCT CGTCTCAAAC TTCTGGTTTC AAGCAATCCT CCTGCCTTTT ACCTCCCTAA

TTGTTGGAGT TACAGGCATG AGCCACAGCA CTCAACCAAG ATTTAAAAAC TTTTAAAAGA AATCACATTA

CTTACTGTTA TCATCATTAT GGTTACTACC AGTGTTAAAA CAATTGGTAT TGAAAACACC ACTACCAGAT

CAAGCTTCAA ACCAAGATGT CAAGTAAATA TTATTGTCAG ACCTCTGAGC CCAAGCCTGC AGGTATACAC

CCAGATGGCC TGAAGCAAGT GAAGAATCAC AAAAGAACTG AAAATGGCCG GTTCCTGCCT TAACTGATGA

CATTCCACCA TTGTGATTTG TTCCTGCCCC ACCTTGACTG AGGGATTAAC CTTGTGAAAT TCCTTCCCCT

GGCTCAGAAG CTCCCCGACT GAGTACCTTG TGACCCCCAC CCCTGCCCAC AAGTGAAAAA CCCCCTTTGA

CTGTAATTTT CCACTACCCA CCCAAATCCT ATAAACAGC CTCACCCCTA TCTCCCTTCG CTGACTCTCT

TTTCAGACTC AACCTGCCTG CACCTAGGTG ATTCAAAAGC TTTATTGCTC ACACAAAGCC TGTTTGGTGG

TCTCTTCACA CAGACCATGT GACATTTGGT GCCGTAACTC AGATCGGGGA ACCTCCCTTG GGAGATCAGT

CCCCTGTCAT CCTGCTCTTT GCTCCATGAG AAAGATCCAC CTATGACCTC TGGTCCTCAG ACCAACCAGC

CCAAGGAACA TCTCACCAAT TTTAAATTGG GTAAGTGGCC TCTTTTTACT CTCTTCTCCA GCCTCTCTCA
```

-continued

```
CTATCCCTCA ACATCTTTCT CCTTTCAATC TTGGCACCAC GCTTCAATCT CTCCCTTCCC TTAATTTCAG

TTCCTTTCTT TTTCTGGTAG AGACAGAGGA AACGTGTTCT ATCTGTGAAC CCAAAACTCC AGCACTGGTC

ATGGACTTGG AAAGACAGTC TTCCCTTGAT GTTTAATCAC TGCAGGGATG CCTGCCTGAT TATTCACCCA

CATTTCAGAG CTGTCTGATC ACTGCAGGGA CGCCTGCCTG GATCCTTCAC CTTAGTGGCA AGTACCACTT

TGCCTGGGTG GCAAGCACCA CCTCTCCTGG GGGGCAAGCA CCACCTCTCC TGGGGGGCAA GTACCCCCA

ACCCCTTCTC TCCATGTCTC CACCCTCTCT TCTCTGGGCT TGCCTCCTTC ACTATGGGCC ACCTTCCACC

CTCCATTCCT CCCTTTTCTC CCTTAGCCTG TGTTCTCAAG AACTTAAAAC CTCTTCAACT CACGTCTGAC

CTAAAACCTA AATGCCTTAC TTTCTTCTGC AATACCGCCT GACCCCAATA CAAACTCAAC AATGGTTCCA

AATAGCCTGA AAACGGCACT TTCAATTTCT CCATCCCACA AGATCTAAAT AATTCTTGTC GTAAAATGGA

CAAATGGTCT GAGGTGCCTG ACATCTGGGC ATTCTTTTAC ACGTCGGTCC CTCCCTAGTC TCTGTTCCCA

ATGCAACTCA TCCCAAATCC TCCTTCTTTC CCTCCTGCCT GTCCCCTCAG TCCCAACCCC AAGTGTCGCT

GAGTCTTTCC AATCTTCCTT TTCTACTGAC CCATCTGACC TCTCCCTCT TCCCCAGACT GTCCTCCTC

AGGTCGCTCC CCGCCAGGCT GAATCAGGCT CCAATTCTTC CTCAGCGTCC GCTCCTCCAC CCTATAATCC

TTCTATCACC TCCCCTCCTC ACACCTGGTC CAGCTTACAG TTTCATTCTG TGACTAGCCC TCCCCCACCT

GCCCAACAAT TTCCTCTTAA AGAGGTGGCT GGAGCTAAAG GCATAGTCAA GGTTAATGCT CCTTTTTCTT

TATCCAACCT CTCCCATCTC AGTTAGTATT TAGGCTTTTT TTCATCAAAT ATGAATACCT AGCCCACTCC

ATGGCTCATT TGGCAGCAAC TCCTAGACAT TTTACAGCCT TGGACCCAGA GGGGCCAGAA GGTCATCTTA

TTCTCAATAT GCATTTTATT ACCCAATCCA CTCCCAACAT TAGAAAAAGC TCCAAAAGTT AGACTCCGGC

CCTCAAACCC CACAACAGGA CTTAATTAAC CTTGCCTTCA AAGCGTACAA TAATAGAGTA GAGGCAGCCA

AGTAGCAACA TATTTCTGAG TTGCAATTCC TTGCCTCCAC TGTGAGAGAA ACCCCAGCCA CATCTCCAGT

ACACAAGAAC TTCAAAATGC CTAAGCCACA GTGGTCAAGC ATTCCTACAG GACCTCCTCC ATCAGGATCT

TGCTTCAAGT GCCAGAAATC TGGCCACTGG GCCAAGGAAT GCCCTCAGCC TGGGATTCCT CCTAAGCCAT

GTTCCATCTG TGTGGGACCC CACTGGAAAT CGGACTGTCC AACTTGCCCA GCACCCACTC CCAGAGCCCC

TGGAACTCTG GCCCAAGGCT CTCTGACTGA CTCCTTCCCA GATCTTCTTG GCTTAGTGGC TGAAGACTGA

TGCTGCCTGA TCGCCTCAGA AGCCTCCTGG ACCATCACAG ATGCTTTTGG TAACTCTTAC AGTGGAGGGT

AAGTCCGTCC CCTTCTTAAT CAATGCAGAG GCTACCCACT CCACATTACC TTCTCTTCAA GGTCCTGTTT

CCCTTGTCTT CATAAATGTT GTGGGTATTG ATGGCCAGGC TTCTAAACCC CTTAAAACTC CCCAACTCTG

GTGCCGATTT AAACAACATT CTTTTATACA CTTCTTTTTA GTTATCCCCA CCTGCCCAGT TCCCTTATTA

GGCTGAGACA TTTTAACCAA ATTATTTGCT TCCCTGACTA TTCCTGGACT ACAGCCACAT CTCATTGCTG

CCCTTCTTCC CAACCCAAAA GTGGCAACTC CTTTGCCACT TCCTCTCATA TCCCCCTACC TTAACCCACA

GGTATGGGAC ACCTCTACTC CCTCCCTGGC AACAAATCAC ACCCTCATTA CTATCCCATT AAAACCTAAT

CACCCTTACC TGGGTCAACG CCAGTATCCC ATCCCACAAC AGGCTTTAAA GGGATTAAAG CCTGTTATCA

CTTGCCTGTT ACAACATGTC CTTTTAAAGC CTGTAAACTC TCCTTACAAT TCCCCATTT TACCTGTCCA

AAAACTGGAC ATGCCTTACA GGTTAGTTCA GGATCTGTGC CTTATCAACC AAATTGTCTT GCCTATCCAC

GCCATGGTGC CAAACCCATA TACTCTCCTA TCCTCAATAC CTCCCTCCAA AACCCCTCCA TAACCCTTAT

TCTGTTCTGG ATCTCAAAAC ATGCTTTCTT TACTATTCAT TTGCACCCTT CATCCCAGCC TCTCTTCACT

TTCACTTGGA CTGACCCTGA CACCCATCAG CCTCAGCAAC TTACCTGGGC TGTACTGCCG CAAGGCTTCA

TGGACAGCCC CCATTACCTC AGTCAACCCA AATTTCTTCT TCATCCATTA CCTATCCAGG CATAGTTCTT

CATGAAAACA CACGTGCTCT CCCTGCTGAT CATGTCCAGC TAATCTCCCC AACCCCAGGA CTGGCAAATT

GACTTTACTC ACATGCCCCA AATCAGGACA CTAAAGTACC TCTTGGTCTG GGTAGACACT TTCACTGGAT
```

-continued

```
AGGTAGATGC CTTTCCCACA GGGCCTAAGA AGGCCACCGT GGTCATTTCT TCCCTTCTGT CAGACATAAT
TCCTTGGTTT GGCCTTCCCA CCTCTATACA GTCTGATAAT GGACAAGCCT TTACTAGTCA AAGCACGCAA
GCAGTTTCTC AGGCTCTTGG TATTCAGTGA AACCTTCATA CCCCTTACCG TCCTCAATCC TTAGGAAAGG
TAGAACTGAT TAATGGTCTT TTAAAAACAC ACCTCACCAA GCTCAGCCTC AACTTAAAA AGGACTGGAC
AGTACTTTTA CCACTTGCCA TTCTCAGAAT TCGGGCCTGT CCTCGAAATG CTACAAGGTA CAGCCCATTT
AAGATTCTGT ATGGACGCTC CTTTTTATTA GGCCCCAGTC TCATTCCAGA CACCAGCCCA ACTTGAACTG
TGCCCCAAAA ACTTGTCATC CCTACAATCT TCTGTCTAGT CATACTCCTA TTCACCATTC TCAACTACTT
GTAAATGCCC TGCCCTTTTT TACAGTGCTG ATTTATACTT TTCCTCCAAA CCATCATAAC TGATATCTCC
TGGTTTTACC TCAAACCGCC ACCCTTAAGT CTCTCTTAAA GTGGATAGAA GATCTTCAGT GACAAGGTAC
ACTCCAATAC TTTCACCCTA ATAAAGCCCT ATTCTTTACT TTTATATTCA CTCTTATTCT TGTTCCCATT
CTTATGCCAC TCTCTACCTC TCCCCAGCTA TCTCCACCAC ACTATCAATC TCACTCACTC TCTCCTAGCC
ATTTCTAATC CTTCTTTAAC AAACAATTGC TGGCTTTACA ATTTCTCTTT CCTCCAAAAT CACCGAGTCC
TCAATTTACT CACTGCTAAA AAGGGGACT CTGCATATTT TTAAATGAAG AGTGTTGTTT TTACCTAAAT
CAATCTGGCC TGGTATATGA CAACATAAAA AAAACTCAAG GATAGAGCCA AAAACCTTGC CAACCAAGCA
AGTAATTATG CTGAACCCCC TTGGGCACTC TAATTAGATG TCCTGGGTTC TCCCGATTCT TAATCCTTTA
ATACCTGTTT TTCTCCTTCT CTTATGCAGA CCTTGTGTCT TCCATTTAGT TTCTCAATTC ATACAAAACC
GTATCCAGGC CATCACCAAT CATTCTATAC GACAAATGTT TTAAGGGAGG AGACCACCCC TCATATTGTC
TTATGCCCAA TTTCTGCCTC CAAAGAAAGA AGTAAAAATG AAAAGGCAGA AATGAAATCC ACAGGCAGAC
AGCCTGATGC CACACCCTGG GCCTGGTGGT TAAGATCAAC CCCTGACCTA ATCAGTTATG TTATCTATAG
ATTACAGACA TTGTATGGAA AAGCACTGTG AAAATCCCTG TCTTGTTCTG TTCCTCTAAT TACCAGTACA
CGCAGCCCCT AGTCATGTAC CCCCTGCTTG CTCCCCCTGC TTGCTCAATC AGTCATGACC CTCTCACGCA
GACCCCCTTA GAGTTGTAAG CCCTTAAGAG GAAAAGGAAT TGTTCACTCG GAGAGCTCGG TTTTTGAGAC
ATGAGTCTTG CCAATGCTCC CAGCTGAATA AAGCCCTTCC TTCTTTAACT CAGTGTCTGA GGGGTTTTGT
CTGTGTCTTG TCCTGCTACA GTTTCATCTA ACAACCCCAT AATATCACCC CTTACCACAA AATCTTCCTT
CAGCTTAATC TCTCCCACTC TAGGTTCTCA CGCCACCCCT AATCCTGCTC GAAGCAGCCC TGAGAAACAT
CGCCCGTTAT CTCTCCACAC CACCCCCAAA AATTTTCACT GCCCCAACAC TTTACCACTA TTTCGTTTTA
TTTTTCTTAT TAATATAAGA AGATAGAAAT GTCAGGCCTC TGAGCCCAAG CCTGCACGTA TACATCCACA
TGGCCTGAAG CAAGTGAAGA ATCACAAAAG AAGTGAAAAT GGCTGGTTCC TGCCTTAACT GATGATATTC
CACCATTGTG ATTTGTTCCT GCGCCACCTT GACTGAGGGA TTAACCTTGT GAAATTCCTT CCCCTGGCTC
AGAAGCTCCC CCACTGAGCA CCTTGTGACC CCCACCCCTA CCCACAAGTG AAAAACCCCC TTTGACTGTA
ATTTTCCACT ACCCACCCAA ATCCTATAAA ACAGCCCCAC CCCATCTCCC TTTGCTGACT CTATTTTTGG
ACTCAGCCCA CCTGCACCCA GGTGATTCAA AAGCTTCATT GCTCACACAA AGCCTGTTTG GTGGTCTCTT
CACACCGACA CGCGTGATAA TTATTATATT ACTTTTAACT AAAACCCTTT CAGAGTCTCG CAGGGAAGGC
TGTATATATC TCATAAAATG TTGGGGCCCA CTGGATCAGA CAAGGCCACA AAGGCCAAAG GGAAGTAAAG
ATCTCATTAT TTCTCCTAAT AATTTCCCTG TCCTTTGTCA TAAATGGTGG GTAGGCTGTT ATGGTGATGG
CAGATTTTCT TTCCATAAAA TGTCCATAAT AGGACATTTG AACAGAAGGG AAAAATCAAA TTGCTGAAGT
TGAAAGAGGG CAATGCAAAG AACTTTGGAG AAAGAACTGT ACAGAGAAGT CAACTGGCAG ATGGGAGGAA
GTTTAAGGGG AAAAATATAG ATGTCTAAAG AATACATTTA TTCATTTTCC ACAGTGCAAT TTGGACAAGA
AGCCTCTTTC TTGCTTCTTT CTATTCTCAT TAAATCATTA GAGCTCAAGC AATCCTTCTG CCTCAGCTTC
```

-continued

```
CCGACTAGCT AGGACTACAG GTATGTGCTA CTATGCCCAG CTAATTTTTT AAAAATTAGA TTTTAATTTG
GTGAACTATT TCTGTAGGAA ACTACAATAA TACAGCCCAG GCACATTGAT CTTGGGTGAA CAAATCAGAA
GGAATGAATA ATTCTGTGTT CCTGGGACTC TGACAATTTC ATGAACTTGG TACTCTGAGT AAAGCATAGG
AGGAGTTATT TCATAAAATG TGGAGCACAA TCATGTGACA AGATAATGG GATCCCCATT TCATAAATAA
ATCTGAAGTT CAGAGAGAGT AACAACTGGC CAGGGTCACA TCACGGAGAC AGAGGCAGGG TTCCCACTGA
TGCCTCTGAC TCCCTGTCCC AGGCCCTTCC TCCTCCCGCA AGCAGAAGTG CAGGGGGCAG AGCTGACCCT
GTGCAGTGAA AATCTGAGGG CTGAGTTCCT ATTGGAACAC AAGTGAAAGA CTTCCTGGCT TCTAATCTCA
GGATAAGGAC TCAGAGCTCC ATCTGTTCCA GCCTTAGGAT AAGAACCAGA ATCTTACACC ATGAAAGCAT
GAAAGGTAAG ATTTGAGTGA GGAAAAAAAA AAAAAAAGTC TGTGTTTCAG ATTCAGTTCA CAAAGCAGTT
TCATACTTAA GGTACCATCA CAATAACCCT GTGGGGTAAG CAAGGCAAAT TTCATTCTTG TTTTATGGGC
ATAGGAAGTA AGTCTCAGGG AGGTTAAGAC CAAGGTTTCT GGAGAATTTT ATATTATGAA TCTTGATTTA
TGGGATTACT ATTATGTAAT TCCTAAGATC ATATAGGAAT CCTAGAGCTT GAATATAGAA CTTTATTTTT
AAATCTATAT ACATCATAAT TACAAGGAGT AGTGTCCATT TGGGTTCCTT GGCCCTGATG TGTTAGTGGA
ATAAACATTT TTGTCAGGGT TGCCATGTGT GTCTGTGCAC GTGTGCACTG TACACCTCCA GGGGATGTAC
CCTAAACCAC ATGAATGTGA TTTGCACATC CAAGATTTAC AGTGTACTAT AGGGAGAATC TTTTGCAACA
GCTTTTGCTA TAATACAGAA TCTGAGATGT CTTTGAGAAA GAAAGTGTA ATCATTACCA AAAAATTATT
CTCATAATGT GTGCAAATTT GTATGAAATC TATATTGGCC ATGGGACAAG GAGGTATTTC CAGCTAGCTT
CTGAAAGGGC TCTATTCTCT CATAAGAATT CAGCTGTTGA CATTAGGTGA TATCTGCCCA GGTCATCAGA
TGCCATAGAG AAAGAGGGTT TGCTGAAACT TATATCAGCA GTGCACTGTA TGCTCTTTCT GATTTATTTG
AACATTCATT TATTGAGTGT CAAGTAATGC ACTAGATACT CCAGGGATCT GACACAAACT CTGCCCTGAA
GGAGCATGTA ATCTCACTGG GGAGAAAACA AAACATATGA TAATTTCAAA ATAACAAACT AGGCAAACTA
GTTAACACTT AAAAAGCAGG CTTTATTCAA ATGCAAAATT GCATGTTACA GGGTAACCTT TCAGTAAGAA
GCCAGGAAGA GGAGCTCATC ATGGGTTGGA TTAGTAAAGG ACTAGTTATA AAAGAAGTGG TGGGGTTGAG
GGAGGCCTGA GATGAAATTT AAAGAATATG TAGAATCTAG GTAAGTGGAT AAAAGGTCTG GGGGCAGGGG
AAAGGAGAGC ATTTCATTGT GAATCAAGGA ATTTCTCCAC CTGTTTTAAC TCTTCCATAT GACATCAAAG
AGATGTCACT TGCAGCTAGC ATTTCAGTGA TGTTTTCTTA CTAATAATAT CGTGATAAAA GAAACATTGA
CTATAAGAAA TAGGAATGGG TCTCATAAAA GGAAACAGCA AAACCCCCAA ACTAAAAAAC AGCGCAGGCT
ATTTCTCTCT TCTCTCCTTT TGCTTGGCAC TCATGAGATG CTAGGTGTGG AAGTCAGCCA ACTGAAAAAG
AGAGGTGGCT GAAGAAGGTG GGGAGGCTGA AGCCAGTTAA ATAGGATGGT CCAATTCACA GACGGCGAGG
CTACAGTGCA AATAGGACTC TTTCAACTTG AGCAGGACCC CATTACTTCA CTGGAGTTAG AAAGAAAGGA
GAGCGTAGAC TTTTTGAACT TTCTATAAGA GTGTACCTCC ACAGTATACA GAAGACGACG TGAAATTTGA
TCTGCAAGAA AACTGAGTCC ATATTCACAT ATGTATCAAA TTTGCACTTC ATTTAGAAGT GTCTGTCATC
AAGTACAGCA CTGAATTGAA ACTGAAAACA AGAGTCAAGA AAGAGCAAAG TCAGCCATCT TTATATTCCA
CATGAATCCT TTCCCTTTAT GGTCTTATTT GTTTCTCCTC AGAAAAGACA AAAAGCTGAG CTGTATAAAC
ACCTGTGGGC TGGGGGTTGA GGGATAAATG AGGGGCGAAA TGGAAGCTGA AGGAACTGTT GGTCAGGTAG
AAATCTTCCC AGATGCACTG AAGGAAACAC ACTTCATGTT TGACGTAGGA GGTGCCACCA CACAAAACGT
TTCATGGAAG GATTTAAAGG ATCTCATGAT TTTTAGTATT CCAAGAATTT TCTTTCACCA AGGGCGATTT
AATATGGGTC ATTCATACTG AAAGAAAAAC AAAAGATAAT AAGAGTTTAA AAATTGCAAA ACTTGGAGTG
TTAGTAGTAA AGGTAAATAT TCATTAGAGA TGAGAAGAGG AGCAAGGAAA TGCTTTCAGC TGGAAATCTC
AGACAAGAGG CCAGGCTTTA GGAACCTCTG AAGATGAACA AATGTAAGCA AACCCTAGTA GCAGCACTTC
```

```
TCAGATTTTC ATGTGCTTAC CACTCAGAGA TGGTGTTAAA ATGCAGACTC TGATTCAGTA GGTCTGAGTG
GAGCCTGAGA TTCTGCACCC CTAACAAGCT CTTTAGTGAT GCTTATGCCA CTGGCGCACA GACCCCACTT
GGAGAAATTT TTGTGGTGCA TACGGTCTTT GTCTCCAGAT CTAATGAGTC TGAAGGACAG TGTAGATTGA
TTTTTTAAAT TTATGTTTAT TTTAATTTAA TTTAATTTAA TTTATTTATT TATTTATTTT TGAGATGGAG
TCTCACTCTG TTGCCCAGTC CGGAGTGCAG TGGCACGGAG GCAGCTCATG CAACCACGGC CTCCTGGGTT
CAAGCGATTC TTCCGCCTCA ACTTCCTGAG TAGCTGGGAA TACAGGCACG TGCCAGCACA CCCAGCTAAT
TTTTGTATTT TTAGTAGAGA TGGGGTTTCA CCACATTGGC CAAGCTAATC TCAAACTCCT GACCTCATGA
TCCACCTGCC ACGGCCTCCG AAAGTGCTGG GATTACAGGC GTGAGCCACC GAGCCCAGCT GTAGATTGAT
TTTGAGCAGT GGAAAGTCAA GGAATTAGAA GGCATGCTTA AATGGAAAGT GAAATTGGAG AAAATTTAAA
CTCATGAAAT AGTGGTGGTT ATAAACTCGT GATAAATTAT ATCCTGGGAT ATAATTTAAT GAGATGGTAA
CACATTTAGT TTAAAGAAAT AAGTGACACT TTTTTTGTGT GACACAACTG TCTTATTCTT GGAAAGGACA
AGGAGAGAAT GAAATATGGT ATGTCTTCAC AGCACCTTTC AAAGGGAGAA CCAGATTCTG AGGAGCTGGT
CTCATGATGA ACTGTCAGGG TAAACCACAG TTCAGCAGCT GCAAATGTGC TTGCCAAAAT AGAGACAAAA
AAATGTTTCT GAAAACAAAA TTTCACATAT GCCCTCCTCT GAGGTTGGCA TCATATCTTC CTGTGTATCT
TGGGTGTAGC TTCTATCCTG CCAGAATTTA GACAGTAGAA ACCAAATGAG GTGATAAACA GAGTCATTTT
GCAGAAGAGT CAAAATAACC CAGCAAGAAA TGAAACCACA AATGCCCAAG GAGTCATTCA TTCACCATTC
AAAAGCTAAT AGAAATGAAC ACAAACTACT ATGAAAATTC ACCCAAGAAC TTAAAAAAAA AAAAAAAGGC
TCATGGTGTT TAGTGTGATA GTATTCATTT TACCTTTGAC TTGTTCTAAA AACACACCAT ACTTCTACCC
CACCCTTCCT CAGTGCCGTC ACACAATGGT TTCAGTGTGA AAAAAAAAAC CACGTTACTG GAAAAGGAGG
GTGCCTGGGA CTTGCCACTC TAAGCTGGTA GTCAAGGGTC TTGAGTTCTA AAAGCATACG CGTTAAGAGC
ATGATTCCTG GATCCAAATG AGTATGGATC TCAGCATTGC CATTTATTGT GACCTCAGGC TATTTTATTT
CTCTGTGCCT GTTTCTTTAT CAGTAATGAA GATGTTCATA GACCCTTCTC CCACAGACTT AAAGGCATAT
TTCATGATTT AAGACATGTA AACCATTCAT AACAGTATAC AACATGGAAT TAATATTTGA TAAAGGTTTA
TGATTATTGT AACTAACTCT GTCACTTGCT CAAGGCCTAT AGAAAACTTA CTTAATTAGT TCAACTACAA
AAAGAGTTTG AATGTGATAT CCACCAAGAT CATATTCAGA CCTAGAATTC TGTGATTCTT ATGAATTAAT
ACAGCCTTGG TCAATAAATG AGAGCTGGGC AAATAATTCT TCTTTGCTAG GCCTTTCTAG ACCATCTGGT
GAAGCATTCA AGACTTATGT TATTGGGGCC AGCCTTCCTT TCCAACTTCA ACTCCACAAC TCCTCAATAA
GCCATGGGCT CAAGAAAGTT CTGCTCAGTG GCCCCTGAAA AATGCTTTCA TAGTCTCACT ACCATACCAC
TGCTTACACA ATTTCCTTCC TACAGACTGC CTTCCTTTCC TGCTTTTCTC CATATACCTA AATCCTATCT
ATTCTTCATA AGCAACCTTC TTTATAACAT TTCTATAAC CACCAAGCCA AATGACCTTT TCCTTCTTAA
ATATAGCACC CATTGGCCAT TACCATGCTC TGCCTTGTAT TTTTCTGATT TTTTTCTTTC TATATTCCTG
TCTTAACTCC CCAGCTAGGT AATAATTTTC CTGAAATCAG GGACCAGGCT GACTCCTCTT GCTGTCTCAA
GAAAGCTTAG CAGTTTCCAA CACAAAAATG TTCAATAAAC AACTATTAAT TGACTGATTA TAAAAAATCA
GTGAACCATT AAACTTAATA TAGCAATTTG CTTAGCATGG TAATTAGCTT TTTGCTAATA TTCTTCCAGC
CAGTCTCTCC TCCTGTGCCT CAAGGACATC TTAAAAAAAA AAAATCTAGT TGATCTGCTT CCATCTAGTG
GCAATTAAAA CAGGTGGTTC CGGTAGCCAG AAAAACAGCTC TGGGTAGATT GTGCCAGAAA ATACTTTCAC
TCAGTAGGTG CGAGTTTGAA AGAAATCTTC ACATCTGTGG GTTTCCTGCC ACAGACATAG GGAGACCAGC
CCAGAGAAAG AAGCCTTTCC TCACTAGACT CCATTTGCAC TAGTAAAGAG AAGACAGAGT AATTAAAAAG
AATAAAAAGA ACCTCCACTG ATCGTACATC CTCATCCAGT TACCCCTGCC CCACTTCTCC TTCACAGCCA
```

```
AACATTTTAA AAGAGATGAC TGCTTGTTCT GTCTCTACTT TCTCATCCTC AGTAATGCTC AATGCTTGGC
CGTCTGACCT CTGTCTTGAT GTCTGCACTG CAAATAGTCT CCCCACTGAC ACCCCTGTTG CATCCAGGGG
ATACTTACTG GTTCTCTTGG CAATGTTTGA AACCGTTCCC CTTTCTTTGT TTCCTTGGCA TTCATTACCC
CACACTCTTT CTCCTCTTCC TTCTCCCTGC CTGGCAACAT CTTTTCATTT CTCTTTCCCT TAGGTGACTT
ATTAGATAAT GATGTTCCTC TGGCTCCCAT ACTCTCTCCC AGGTCCTCTT CCATTCTTAA AGCACTCACA
CCCTCCCTGG ATGATAGTAC CCACTCCTGA GATGGCAGTT ACCTCCTGAA ATGTGAGGGA CCCAAATCCA
CTTCTCCTGC CATAGCCTCT GTGCTTTGGA TAGGTCCAAT GAGCCACAGT GAATGATGTG CATACACCCA
AAGCTCAGTA CAAAACTGAA CCCATGATCT TTACCTCCAA AACCTCTCAT TCTTTTATGT TCCCTTCTCA
GAAGTAAACA GGACTACCAT CCGCCAGTTT CCAGGTGAGA AAGATGATAA TTTGATTCTT CTCTCTCACT
TTTAGCCAAT TAACAGACAC ATTCAGTTAA TATCACCTCC TCTTATTTGA TGAACCCATT CTTACTACTA
GTTCCCTAGA CAGGCGCCAT CGGTTTTAAT CTAATAACTG CAAATGCCTC CAAAACAAGT CTCTTTGAAT
CCAGGCTCAC CTGTCTCCCA CACTTGCCAT ACTGCTCTGC AGGGTGACCT TATAAGATGC AGAGGTAAG
GCTACTCACT GTTTAAACCC CTTTAGTGAT ATCCCAAAAG ACCTCAAGAT AAAGCCCATA TCACATGGCT
TATACATTAG TTTATGATCT GGCTTCTGGT GCCTCATTTT TCCCCACTTT TTCCTTTGCA TTCTAAGCAA
TGGCCCATAC TAAGTTTGTG ATTGGTAGGA TGGTTGCCCA AACCAGCATC CAATCCCTTC AGAAATCATC
TCACTTCATT TCTAGCATTT TAAAGGAAGC TCAGTTGTCC AGCTGGGTAC TGAATATGTC ACCAAAGTCC
TCCTTTCATA GTTTATTTTA CTTAAACTCT CCTTCCTAAA ATTCCAGAGC AAGTCACTAA ACCCTAGATA
CTGAGAAATA TTTTTCCATC TTCATTTCTG CCAGGTGGGC CATCAACTTT CACATGTCTG CATCTCCTCC
CACTGTGCTA TTTCTCCAGT AGAAGAAATT TGAGCTTCAA GACCAAACTG AAAAATACTT GCCTCCTTGG
GGAAGCTGTA GGTAGAATTC ATGCTCCCTA TCTTTCCCAC ATTTCTGAAG ACAATGCCT GTTAGAGCAA
TTGAATGCAA ATAGTCAATT GAATAAGCAT TTATTCATTT CTCAATAAGT GCTTGTTCAA TTGAATATTT
CTTAAATAAT ATATTTAAGA ACAAGAAGAA CACACCACAA TGTTTTTAAC CCTCAGAAAA AATTCTGAGG
TAATCAGAAA AATCTCCCTT TACATAAACT GCCCTTTTCT AATAGGGATT ACTTGTTCGT TCATTCATTC
ATTCAGCTCC ACTAGCACCA AAAAGCACAG CTCTGAAAGG AAGCTAGTAG ATTTATCACC TTATCTGGTC
ATTTGGATGA GGACCCCAGG TAAATAAACT ACTATGGGGT TAATGTGTCT AGCTAGAGCA GGAAGTAACT
TAAGGAAGTA GAGAATGAAT CAGCAGATGT GGAAACTCCT CGCCACTAAT AAAACTTACC TTCTCTTGGA
TTTCTTGCCT GAAAATAGAA AATAGAGAAA AGGCATTAGC AAAAATTAGA CAATTTAAAG TTTTTCAAGT
AAGGGAGAAG GAAGACTCCC ACTCTCAAAA CTGTCTTTTG AAGTATATTA GGTATTTGTT AGGTGGACCC
TATCTGTGTC AAAGGAGATT TGAGGAACTG GCTTAATAAA CAGTGGTAGA CACTAATACA GAACAGACAT
GTTGATGCAG ATGCCTCCTG AGGTTCCATT CCATTCTCCG TGCTACTCAA GAAGACAGAA TTGCTAAATT
GCCTGGTGGC AAGACCCAAT ATGTCCATTC AAGTGTTTAT CCCTTCCCAA TCTGCCATCT CATCCTACCT
GCAGATTCTT CCCTTGAGGG ACAGCTGCTA ATACTGTAAA ACTATGTGCC ATTACAGCTC ACAGCATCAT
CTCTATGAGA ATCCACAAGA GAATTTCACT TTGGTCTTGT TGGTAGGAAT TGTGCAGCCT CATCTGAGTA
ACTAATGTGT TTTTATCTTA CAAACACAAG GAATATCACA TGGTTCTCCT TTGACTGGCT GTAAGGAAAC
TCAGAGCTAG ATCTGAGACC CTCTCCTACC AAGTATATAA AACTTTGTGA CATACATTTT TGTGCCATAA
CTTCAACCTT GGTTCCAAAT GATTTTTGTA CCCTAAGTTT AAATTTGGCT TTCTTTTTTT TTTTTTTGTA
CTCAATAAAA CATCAAGCTC ATTTATTATT GCGAAGAGCG AAACAACAAA GCTTCCACAG CGTGGAAGGG
GACCCGAGTG GGTTGCCCAA ATTGGCTTCT TTTTCTTACT TTTTAATTAA TTTTAATTTG CTATACTGAA
CACATTTTGT ACTGTTCTCA CATTCTTTTT GAAAAAGCA GAATATAAAT AAGTAGAATAA CTTAAAAAAA
ACTCTTTGAG CAGAAAGAAT CATTTGGGAG GCAATATATT TCAGTGGCTG TAAAGTGGCA TTCTAGAATC
```

-continued

```
ATCCTACCCA GGTGAAAGCC CTATTTTGCC ACCTGTAGTG TAGTGTGTAT TTGAACAGCT ACTTTCTTTT
CTAAACTACA ATTTCTTCAT CTGTTAAAGA GGCATAATAA TTGTATCATC CTCATTGGGT TGATAAAATA
AAATATTTCC AAGTATTTAG TTCAGGTCCT AGCACGTAGA CAGTGTTGCA TTACTGTTTT AATCCTTTAA
AGTATTAAAG ACTACTATTT GAAATCTTTT CTTCTAAAAT TCAGCCTGCT GATGACCAAG TGCACTTGAG
CAGGGGGAAT CAAATCTGAA TTAATTTCAG ATTCTGGGTA GCTTCACATA AATATTTTTT TTAGGGATGA
TGAACCTAAC AGCAATAGAT GAGTAAGAAT CTGTTCCTAC TGAGAGAGTT TCATTTTGAA GAAAAAGGAA
CTAAGGGGGC ATGTGTTCAG TTTCATGCCC TGGTCTAACC CTGTGTGTTG GTTCTGGTGG GAAATTCTTC
CAACCGAGGA AAAAACCAGT TCACAAATCT GAAGACCAGT GATTTTAGAA GATGTATCTG GACTGGAGTC
TAATCTCTGA CTCTGGGTCC TGCTGATATG GTATTTTTGA GATTTGGCCT AAAACATCAT TGCCCTGGTT
TCCTTATTTA CCAAACAGGG CCAATGGTAG TGACTAATCA GAAAATGATA ATGCCTGGTG CACAAAATGT
GTCTAGATGA GCCCATGCAC AAGGACACAT GTTTCTGGAA CTGTTCCTTA TTCCTTTCCT AAAAGAAAGG
AGGGAAAGTC TCCATACTAA GACTACTAGG GCAGGGGACA AAGTGCTAGA GTCAGAAGAT TCATCTGAGG
ACAGAAGAAT AGGGGTGAAG GCTCTAGTCA CTTCATTGGC TACCATGCTC TAAATAGTTA CCTGTGCCCT
TTTTCTAACT ATTAGAACCC AAAAAGCCTA TAAATTCTCT CTCTCTCTCT CTCTCTCTCT GTGTATATAT
ATACATATAC ACACACACAT AGACACACAC ACACACCTAA ACACACACAT AGAGATTTAT GACTTTTTAC
TTTTATCCTT GTAAATGCCA TTAACTATAT TTTGTCTTAG ATTTAGCCTG GGAATGTAGC CATTATTTCT
ACCATTGCCT CCATAGGAAA AATACTCTTC ATGTTTTAAA GGACCAACCT ACAACTAAAA TCTTTGGAAA
GCAGAATCAT TTGTAAGTTG GTGAAAATGG AAGATGTTGT TTTATAAATG AAGACTTTTT TTTTTTTTTT
TTTTGAGACA GGGCCTCACT CTGTTGTGGA GTGCAGTGGT GCTGTCATGG CTTACTGCAG CCTTGACCTC
CTGGGTTCAA GTGATCCTCC CACCTCAGTC TCCTGGGTAG CTGGGACTAC ATGTGCATGC TACCATGCCT
GACTAATTTT TTGTATTTTT GTAGAGATGT GGTTTCGCCA TGTTGCCCAG GCTGGTCTTG AACTCGTGGG
CTCAAGTAAT CCTCCTGCCT CAGCCTCCAA AAGTGCTGGG ATTAGAGGTG ACAGCCAAGG TGCCTGGCCC
ACAGATGAAG ACTATTTAAT GTTATCTTAA AGATACCCTA AGCTTCCTAC CAAGCCAGTG ATCTTTTGGG
GCTTCTGTTT TCTTTGTTGG CATAACTGTA ACTAGCCTAA CTGCCCGTTA TCTGTTTCCT GTTTGCCCCA
CACTGATTCC CACAGCAGTT TTCAAGTTAT CGGTTTGAGA TCTTGTACAG AAATGACTCC AAGGTAAAAA
ATTTAAAAAC AACCCCTCTA ATTTTTTTAC CCTTGCTTAT AAAACAGCCT TAGCCAGCTA ACCCCTCACT
ACATGCAAAT GAGTTTGATT CTATTCTTTT GATTCTACAA ACACTTATTA AAAGATTTTA GAATTCGGAA
ATAAATAGCT TCCTTATTAA GGTGACTTAC AGCCCCAAAG TCCTTAAAAT TATTTAGACA ATAGCCACCT
TATCCCAGGG GGCAGTGTGT AATAACCCAC CCTGTTCTCT ATCCGTCAGT TCTGCCATCA TCGCCCAAGG
TAGGAAGAAA GACAGGACAA CCGGGGTCAA GATTTGAAGT CTCAATGGAA AGAATAATCA GTGGTTGGAG
AAAACTGTCA TTCTTCTTTT GCCTTAATGC AGTACTTGAT ACTTATACTT AGTACTGTAT AGTACTTAGT
ACTGTATAAT ACTATAAGAT AGTGAGATTC AATCAGCACA GAATTTCTAA TAGCAAGGGC AGAGACATTT
TAACTGCTCA GTGCTCTCAG GTTATACATA GCTAATGAAG TTCTTGCATA TCAACAATCC CCACCCCCCT
CACACACTTT GTCTTTCTGG ATTGGTTAGA AAACTTACCT AGCGCCCACT ATTCTCAAAT TTAAATGAAA
GATAAGATCA GAGTGGCACG CAATTAGGGA CTGATAAATA ATATTTTTGT AATTGCCAGT GTAAATGGAC
AGGGGGCAAC CTTTACATAC CATATTCAGT GAACAGAATA CGTACTAACT AATTTGATGG AAGGAAAATT
AAAATGACAA TCAACTGAGC CCACAGAAAG GCAACACAGA GCAGTTGGTT AGCAATTGTT TCGAGATCAT
CCCTGAACTT GAAACAGGTA TATCTTTTTT TTTTTTTTTT TTGAGACAGA GTCTCACTCT GTCACCAGGC
TGGAGTGCAA TGGTGCGGTC TCAGCTCACT GCAACCTCCG CCTCCCGGGT TCAAGTGATT CTTCTGTCTC
```

```
AGCCTCCCGA GTAGCTGGGA TTACAGGTGC CCGCCACCAC GCCTGGCTAA TTTTTGTATT TTTAGTAGAG
ACAGGGTTTC ACCATGTTGG CCAGGCTGGT CTTGAACTGC TGAGCTCATG ATCCGCCCGC CTCGGCCTCC
CAAAGTGCTG GGATTACAGG CATGAGCCAC CACACCTGGC CAAAACAGGT ATATCTTAAA AGCTGCCCAA
TGTCCATGAA TGTTACAGCC TTGAATGGTT CTTCCAGGTG AGTTTGGCCA AATGTGGCAC CATACACCCA
AGGCCTGCTG CAGGCTAGTG GGTTGCTCAC ACTTTAAAGC TGAGACACAC TCATGCCTTA AGGTAAAGGG
AGTGATAATC TGGGCAGCAG ATGTTAACTT CTCAAGGCAG TCCTCCTTCT CTTTTCCTCT CCAGTGACGG
ATGGTTGGAA AGCATATATG GTGCATTTGG TTAGAGCTGT GGCCTTGGTG AATAGATACT TGGGAGAATA
CATGGGAATT TCTCCCAGGG TTAATGCAAT GCCCATGTGT TGGGAACCAG GTGACTCTTG AAGAGGTCAG
GTATTTGGGA GCAGTGCCTT GAAACCTTAG TGGACATTAG ACCCACTTCC TAGTGGAATT GTAGCATTGA
AATCCAAGGC ATGTAGGCTC TTAGAGGACA GAGATAGTGT GTCATTTTTT CAGAATTAAT TAAGAGCAGG
CCAGGCGTGG TGGCTCACAC CTGTAATCCA AGCCCTTTGG GAGGCCAAGG CAGGCAGATC ACGAGGTCAG
GAGATCGAGA CCACTCTGGC TAACACAGTG AAACCCCGTG TCTACTAAAA ATACAAAAAA TTAGCTGGGC
ATGGTGGCAC GCTCCTGTAG TCCCAGCTAC TTGGGAGGCT GAGGTGGGAG AATAGCTTGA ACCCAGAAGG
CGGAGGTTGC AGTGAGCTGA AATTGCACCA CTGCACTCTA GCCTGGTGAC AGAGTGAGGC TCTGTCTCAA
AAAAAAAAAA GTATTAAAGA ATTACATAAG AGCAAAGAAC CATTAGAATA TCTCACTTAG TTGTTATCAG
CCTAGCAAGC TGCCTTGAAG GTAATAGACA TTTTTAAAAG TTTATCAGAT GAAAAGCGAA AATCAGCCAA
CCTGTTTTAA TGAAGGTGTG TCCTGGGCTG ATTTACATGT CTCCAGGGAC TGATGGCTCT AGAATGTAAA
GCTTGGCATC CTGCTTGTGT TGAATCTATC ACATTTAATT TCCTGTGGGT TTCTTTTTTT TTTCTTTTTC
ACTTTAAAGT TGTGTTCTTT TCATGTGAAG TTAAACTCAC ATACCTTTTT TTAATCTCCT TGCCAGCCAA
ATGATAAATG CCAACCCAGA GAATGCAGTA ACCATGACTG CCACTGGAAT GAAGAGGGGG TTATAATCAC
CCTCCTTAAT CATTGAGAAA CTTTTGTCCA ATTCTGAAAG AGAAATCAGT AAGGCACATA GCATGAGACC
ACCAGCATTA TTTGCTTAGT CTATCTCATG ATATTTGACT TTTTTCCTCC TTACATCTCC CAGTAGTAGC
CCATTTGATG CCATTTGACA GATGAGGAAA CTGGCATGGG AAGGCCCCTG ATGAGTCTAC AGCATAGGCA
AAGACTGGAC CAGCCTTGCT AGTCTAATGC CTACAGAATC TCAATGCCCA GATTTGTGGT TCATAGAGTT
CCTGAAAATG CACCTAAAAA TGTTGGCAAG AATGGTCATC GTTGTATTTA GCTCCATGGA CTTGTTCAAT
GACTGGAACT CTGAAACACA GAGAAGAGCT AAAAGCCTAA TACAACTTCA GGAAAAATAA AAGCCAATGA
TCTGAACTGG ATAATTCACC AGTCAAAGGA AATCATTAAT GCTTTTACTT TAAAGCAGTT GTGCAAAAAT
AAGCACTTGA TTTTTACATG CCAAGGACCT GCACTAATTT CTTTCCAATG CAGTAGTTAC CACTTCCCTC
TACTTCCTTC ACGAATAAGT AAAAGGGCAT GTTTAGAGAT ACTCTTGTAA GTGTAAACTA AGTTCATTTG
GGAGCCTCTA TTTGAAAATA CTGGTATAAA AAAAAATCTG TCTCCTGATA CTAACATTTG AAGGAATCTA
CTTTTTTACA TATTGGCAGA GGGTCTGATT CTATCCTTAG TTCTTCCCAT TACTTTGATG AACCTTTTCA
AGGTGATTTG ATCCCCACAC CCAAATATAT GATTGAGAGA AGGCTCAAGT TCCCAGGAGC TCCAGACAGA
AGGTACCTGT TGGCTTGATG AAGATGAGGA GGAAATGAAC ACTAGCTAGG CCTTAAAGGG AAATGTCTCT
GATAGGCCTA ATACACAGTC CTCTGCTAAA GGCCTCCCTG CCTCTCTCTG CTCATCCACT CTACTCCCTG
GCCCTGGGCA CGCAGCACAC AGAGATCAGC ATTTCTGACA GCTTCTGTAG ATCCTACCAT TTAAAGACTT
TTGTCATCCA TGCAGATAGT CTCAGGAGCA GACACAGGTA GCTATTCTTT CACATGCTAG CTTAACATGC
ATTTGCTTTA GCACCTATTG CCAGGCACTG TGTCAGGTGG AGGGTATACA AAGATGAACA AGACATGATT
CTTCTCATAT ACAGATAGAT TTTGGAGGCA TTAGCTTAGT GATGATTCAG GAGTATCCAT TATTTGGGGA
AGTAGGTGGT CATTAGTGAC CTTTTACAGG CATTTCAATG GGCTAACAGA GATGTTAGAT TGTAGTGGAA
TAGAAGAATG GGTAAAAAGT AAATCAGTGA GTTCAGATTT TAGGAGTTAA GATGGCAAGA GGTGAGAACA
```

```
AAAAAAGGAA ATGATTGTCA TTAAAGGAGG AGGAAAGACC AGCCAAAGAT TTTACAGTGA GTTAAGCATA

CAAATTTATT TCTAGGCCAC ATATTCTTAG CAAAACAACA TGTAAATGTT TATGTATGTC TTTCCTCATA

TCTGCTCATC CATCAGCTCC ATCGTTAAGA TTTCAGTTTT CCAGGACAAA CTTACTCACT TTGACATATT

GGACTAGGAT TTGACCAGAT TCCAGATGAT TCACAAATGG TTTTCTTCTT CCCAATTAAC TCAGTTCCTT

CTGAGCAGAT GAAGGTACAT GCAGAGGTAA AGCTGAAGCT GGCCAGGGGA TGGCTACAGT TCATGATCCC

CAAATCTGGT GCTGATAGAG GCTCACACTG AATCACTTCA ATGAAAAGA AAAAAAAAAA AAAGACAAAA

CAGTATTTCT GAGTAGAGAC CCTCCCTTGA GCAAAGGATT TTTAGCCAAA GCTGCCTGAC TACATTACTT

GTGATATTGC TTCCAGGCTT TATTTTCTTG AGAATGATGG TGGGTGGTGA ATGAGAGATG AAGGCAAGGA

AGCATTGAAA GCTGTGGGGA GAGGAGTAGC TACTCCAGGC TGCTGCCCTA GCTAAGGTGA CCCTCCCCTT

CTGCTGGAAG TACCATGCCA TATGGCCTCT GCATCAAGGG CTCTTATGGG ATATTCTCAG AGAATCTCTG

CCGTTTCATC TGTTCTGATA TCTACCCAAG CATTTTGAAA AACATCCCAA TTCACTGAAG CAAGTCCAAC

TTCCGTAAAT TCCAGTAGGT GGGTTGACAG TTTTATAATT TCAATAAGGG ATTTTGATAG CACTTCTAAG

AATTAAACTA CTTAAACTAA TGCATCAGGA GCATACTTGT AGAAAGTTA ACCAAAACTT CGTAAGTTCA

GATGACATTG GTTTTCTCCC ATATGGAGAT AAGGTTGGCA GTTAAAAATG AAAAAAAAAA AAAACCTAC

CTTATTTCAA ACTTGAAAAG ATCAAGAGAT TGTGTTTTTG TTTTTCAGTT GTTATTCTCC TAAAAGTTTA

TGCATGAGGA AAAGTAAAAG TGATTTTAAG AATAAGCCAA ATAAACAAC CAAGAAAGAC CTCCACTACC

CTGGGAAGGA AACTGGTTGG TATTAAGTAG GACACCACAT AAAACAGGTG TTATTGAGAG GAGAAGAACC

AAAATGTAAC TGAGGTTCAA CAAGACATTA TTTATGCAAT GGCAATGAGA AAAATAAAAA ACACAGTATA

ACCATGCTGT ATTGCTATAA GTCATGTTAC ACACTGGGAG ATGGCTTCAG GGGTATTTGG TTTTTACTTT

TTGTTTGGGA GGTTTTTCAA AAAAATTTAG TTAGAATAAG TCCTTTGAGA AACATCACAG TAGGTTAAAC

AAAGTTAGGT TAAATTAGGC TCCTAAGTTT GACTTCTCAG CAAACTTCTA CTGAATGTTC TGACTGTAAG

CCCAGGATTG CATGACAAAA CCTCTAGTCT GAAGTTACTC ACCTTGACAG TTGGTTCTG GAGATGACCA

GTTTCCAAAT GGTCCACAGG TGGTTTCTTC AATCCCAGTT AAGTTTGTTC CTTCAGAGCA GCTGAAGGCA

CACTGTGAGC TGAAGCTGAA GTTTCCCAAA GGGTGAGTAC AGTCCATGGT ACCCAGCTCT GGGGCCTCCA

AAGGCTCACA CTGAATCACT TCAATAGGGA AAGAAACAGT ATGGGAAGA GTTAAGAGGA ACTGACGCCT

GGATTTGAAT CCTAGCCCTG CCACTTGATA ACCATGTGCC TTTAAACAAG GTTACTTGAA CCCTCCAACT

TCAGTTTCTT CATCTATATA AGAGGAATAA TGAAATTGTG TTATCTTTAT CAAATTGATA TGGAAACTAA

ATGTAATTCA ATTAGCATAA GTCAAGGACC TTAGAACAAA GCCTGACTCA TCAGAAATTC TAAGTAAACA

TTAGCTAGTC TTCATATTAT TATCTTCAGC ATTATCTGTA GTGAGAATCC TTAAAGCCAA ATAGGTGTAA

CTGGGAATGA CCAGCTTAGT CGGGAAATAA CTATACATC AGAGCCCCTG AGTCTACTAG AGTATTGGGA

GCAAGATGTT CAGAGAAAGA GTGGGTCTCC ATAATAAGCC TTCTTTGCAA GGAGAGAATA TAAAAGTCTA

GGAAGCATTT TGACCTCAAT TCTGTCTTCT ATTCTAGCTC AGTTCCAGAA TTTTAACTCT TTTGATTTTG

ACAACCCTCT CCAGAAACTG TATCTATTTC CCTGTTCTGA TTGGTGGTAC AATAGGTAAA TTTAAGACTT

GGAAATCAAA GTTTTCACAT TTTAGACCCT GCCATGCCAT TTAGTAAACA GTACAACTTT CATGTCTTAT

TCCTCATCTG TCAAATTTAA GCCATTATTG CTACCTTGCT CTAGAGACTT CAAGGAAGAA TGGACTCAAG

GAATCAGAAG AATTTTGTA TTTGGAAACT ATATGAGATG AGATTAGGGA GAAACATGGG AACTAAGAGA

AAATGTTATC TTTTTTCATT GATTTAAAGA GTATCTATTA TATATCAAGC ATTACTCTGG GGCTTGAAGA

GCTTAGATTT CACCCTGTAG GACAAAATGG TAGGTAGAAA TTAATGGGTG GATTGTCATG TATGTGTGAT

GTGTTTTAAT TGCTTTTAAT TGATCAGTCT CCCTGTAGTA TGAATAATGT ATTTGAGGGG AGCTAATTTA
```

-continued

```
AAATTGTGGA ACTCATCTAA TAAACTATTG CAAGAATCTA GAAGAAAGAT AATGACGGCA ATGGTAGTAG
AGTTGACAAG TGGAAGACAA ATTAGAAAAA CACTAAGTTG TAAAAATTGG TAGAATGTTA CCCTGCATAA
ATGTTGGGGG AGTTAAGAGA GTCTCATACC AGGGTGCCCA TGTAAATGGT GATTCCACAT ACTGAGATAA
GAAATACGAA GAGAAAAGCT GACTGGGAAC AATTGGTTTT ATAGTCTTTT AAACATCCCA AAGGACATCC
TTAGCATATT TGAGTTCAGA GCTGGAGATA GGCTTATCAG TCCAAAGATC ACATAGATTT GTGAGTCCGC
AAAAGTCAGT AAGTTTGACC AAAGGATACA TGTAGATTAG AGTCAGAAGA GCAATATACA AAAGACAAAA
GCTGAGAAAT TATAGTAGTT TATGGTCCTG GATAAGTGCT CATGAAGGAT CTCAGGAGAA ATGATCACAG
GTAGAAAGAA TGAGAAAAGA GTGATATGAG AGAAACCAAG ACAAAGAAAA GTAAAATGTT AAAAATGAGT
GAAATAGGCA TACCAATAAT TAAAAATGAG TAAAATAGGC ATACCAATAA CATAAGGGTT AAAAAATAGA
GTTCAAAAAT GGGGTGAGGG TAAAGTATTA GGAAGGAGTC ATGGCCCAGG GATCAAGTGA ATGAGTTAG
ATCTATAGAT CTATTTCAGT TGGTTGACAT TTAAATGTAT TTTGGTTTTA ATTCTTTATT GTTTACAAAC
ATTGCTTTTT TAAAAAATTA AATTGTCCAA TTCAATTCAG GCTCACAAGC AAGTGCCTCA TATATACAGG
CATTTTGTGG ATCCCAAAGA TGCAATGATA ATAGGACAC TTACTGATCT CAAGAAGTTT TCAGTACCAG
AGGAGACGGA CAAGTGAACA GATGACTTCA ACATAAGTGG GAGAAATGAG GAAGAAATAT GTGGAGCTAT
CAGAACTAAG AAAGCTTCCT AGAAGAAACT GTCTTTGAAC AATGTCTTAA AGATGACATG TTTTTTGGCC
ATGTGCAAAA TGAGAGAGAA GGCCACCAGC AAAGTCAGTG TGCTACAGAG CACATGTGTT AAGTGTGGAG
AACTGCAAGA AGGAAAGGAA CTACTAGAAG GAAAAAGCAA GATACTTTCT GGGTAACTCA GCCTCCTAAT
GATAAATGGC ATAGTTTCTT CCAGACCTTA GAGTTCTAAT TAATCTAACA AGCTCATTAG ATCGTGAGCT
TCTTGAGAGC GGGAATCTAC CATGCTAATT CCTTATGGTA ACCCTGACAG CTTTTATCCC AACACTGTGC
TTCTTGTGGT ACTCAAAAAG ACTTGTTGAG AAGTGAGTCG AAACTTCATG CTGACTTATG AAATCTTTAC
GGAAAGGTAA CAATATTGTG AAAGCAGAGC TTTCTGATCA AAACTTCCCA TTTCTCAGAG TGGCTAGTAT
CATTTTGTTC CAACCAGCTT CATGATAAGC TATAATGATT CCTGTGACTT TACCTAAGAA GAAGCAAAGA
AAGGAAAGAG ACTTACCAAA CTGACACTGG GGCCCATAGT ACCCCACATC ACAGTTGCAG GTGTAATTAT
TGATGATTTC TACACATTCT CCATGGCCAC TGCATGACCA GGGCTGGCAA GAAGCTTTAA GGAGGTCAGA
AAAAAAATAT TTTAATGTGA TTACATTTTA GTACTCAAAG TCATTTCTTT AGACATAGAT AACCTTTTGT
CTGAGATGAT TTAAATAATC AGGAAAGGTT TATTTGTAAA TTCATAGCAT AAAAATCATA TGCTAAAATT
TTTACGTATA AAATACACTA AGCATATAGT CATAGGCATT TATTTGCTTT TGGAATGAAA TTACCAATAC
TAATATTCTG TAACACTTAT AGGAAACTTA GTGGCATACC TTGAAACTCT TGAAATTACT TGTTTTTAAT
GAGTGAGAAG GTTAAATGAT GACCTGACCT CAATCATTTC TGCATGCAAT TATTTCTTGG CAATCCCTTT
CTTTATAGAA ATCAAAGATT AAAAAGTCCA AATTTGCTAA AACGGTAGAG TCCAATTTAT AAGAGACCAA
ATTAACTATG GTTCATTATT AAAACATCAC TTGGAAAATG CTGGCTGTTT TGGAATTGTA GAAGATTTTA
CAGAAATATT CATACACCAA AGATAGTGCA ATTTTTATAT AAAATTATAT AAGGTTAGAC CAAGAAGGAA
GCACGCAGCA CCACACTCTC TACTTCACAA TGTGAAAACT GAGGTGATGT GAGCCTAAGT TTCCAACTGG
CCCCAGCTGT CAGCTTCTCC TCCCCTGCCT TATTATCAAA GGCACTGATT GTCTAGCTCT TCCTCTGTAC
TTCCTACGTA GATCTATCAT TTTGATGTAA CTTGATTTAG GGGTATAGCT TTTGTGCACA GGGACAAATC
TTACACACCA AAAATTCTTA GGAGTGACAC GATGCAAGAT TATATAGAGG CTAGATGTA TTTTAGAATG
AACCAGAAGC TGTTCTCATC CCCCCACCTT TCCATGGGGT AAATCTGAGT ATTCTCTTAA CCGTGGCCCT
TCCTGAGTCT GAGGCAGCAT AGCCGTCTTG TCACTCCCTA CCTGTGTAAC AGAGGGCTGC CTTTAGTTTG
TGGCAGGCGT CATCGTTCCA TTTGCCTGCA TCTTTGTTTC TCTTGATATA GATCTCCACG CAGTCCTCCT
TGTTCTTCTT GTTGTTGGGC TCACCATCTC CCCAGTTCTC TGCTTCTTCA GTAAGAGATT TGTTGGTTCC
```

```
CACCCACGTC CATATTCCTC CTATCTTCCG GATTCCTATC CAGTAGTAAG AACGACTGAA AGGCAGAGTC

TTCTCCAGAT ACTCAATTTC CGCCTTGTTT TGTATGGCAA CTAAATCTGT GTAATTGTCT CGGCAGAATC

TTCTAGCCCT TTGCCAGTTC ATGGGTTTTT CAGAATAATG GTAAGTCCAG CAGTCGGTTC CATGATGTGC

CAGGAAATCT GCAAGACATC AGTGTGACCT ATGCAGACTT ACATAATGTT ACAGCTAAAA AGAACCTAGC

ACTACTCCAG GCTGAGCTAG ACACTTAGAG ATGAGGAAAC AGAGCCTAAG AGTGTATGTG ACCATCTCAG

GATCACAGAA TAGTTGTTTG CAGATTTGAA GTAGAACCTA GACCTTCTGG CTTGAATATA AGATGCTTTT

ATCTAAGGTT CTATTTGAAA CAAATTTAGT GGTTTTCTAG GTTTATTTTC TTATTAATTT TTTTCTCAAA

ATTATTTCAG GTGAAATTTA ACCAACATAT TTTAGACATT CATATTTCTT TTTCTTTGTA GCTGTTAATG

ATTTACAACT AATTACCGTG TAATATCATA TAACTATACA ATTTACGTAT ACTTTTTAAT CCTGGAATCA

TTTCTTGAAG GCCAACACAT ATGTACCTAT GGGAGAAGCA TAATAAGGAC AGGAAGAACA GTGACATACT

TTTAAGTAAC CTCTTTTACA TAAAAAACAT TTTATTTTAC CATAGGAAGA ACTGCTTCTG GAAAAGCCCA

ATATACCACT CAACTCTTAT ATATCTAACT GTATAATTTT TAAAAAGAAC AATTTACAAA GCCAAATGGT

ATAGGATTAT GAAATTCATT AGATCATGTT CTATACACAA AGAGACTCAA CTGATGATGT TTAATAAACA

TATGGACCCA TCAAATATGA GGGCTTTGAA GATATCTAAT TAAACACATA ATTACACAAT GACTTCATAA

TAATATATGG CATTCTAAGC ATGGTATGAT CTACATGAAT CACTATTTAA TACAGTAAAG AAACAGATAT

AATTGATGGT AAAGAGCATC ATAAAATAAA CATTTTGAAC AGAGTTTTGA ATGAGCATTC CACTAGAATG

CAAGTTCTAA GAGGGAAAAA ACTGTTGTGT CCACTGCTGT ATCCTTAGTG CCTAGCATAA ATTTCACACA

TTGTAGGGAC TCAGAAAATA CCTGTTGTAT GAAAAGAGCA CTAAGTTTCT ATGTGACACA GTGCAGACAT

GGCATAAGGA ATGTGTGAAC GGGAGAGTTA GCATGTTTGC TTGGCTAGAG CTGAAAATCC AGGCTAGGGA

GAAAGAAGAC ATTAGTTTAC TTAGGAAATG AAAAACCAAG TTCAAAGCTA TTGCTGGAGA GTCTTCAAGA

ATCAGATATA AAATTTGTCA CAACAATGGG AGAAGGACCA AAAAATGATA AACCCCGTC CCTTAATAAG

CTCGTATTGT AATTGTAGAA ATGACATTAA TGTACACTGA ACTATGAATA AAAAATAGAA AATGAGGTGC

TAAATATTTG GTACAGATTG TAAGTACCTT AACAGAGATT TCTTAATTAA CATTATTCCT TTATAATTGA

GGGATTTTGT GGGGTTATTG GGATTTGAAC TCTACAGCAT GGGCTATTAT AGGTTAAAAA TAGTGTTCAG

GAGTTTCTGG GGAAGAACTA AAGGTAAGAA GAAAAGAGAT GTTTACAGAA GGGATAGAAT TAACAGCTCT

GTGAAATAAT TTTCCCTTAG ACTATGTATA ACTAGTGGGA ATTTAAGAAA AATGAATATA AGTAAAATAG

ACTTAGCGAT ATATAAATAT CATAACATAC CACAACAGAG CATTGTCCAC CCCCACAACT TGAAGATGTT

CCATAAGTCC CTCTGGGTGC TCTGACATTT CCATGGAAAT ATCTGCAAAT GAAATACAAA ATTATATTTA

GATGTATACT CTTAAACCAC ACATTTATAG CCTTTGAGGT GGTGCTTACA ACTTTCTTAA TAATCAGAAT

AAAACACATA TGTCTACTAA CCCTGTCTGA GGTAACAGGT TTCTCAGACA TAGATGAAAA ATTACTTCAA

ATTTACATCA GAACTGATGC ACAGTTTGT TTTGTTCTAT TTTATTTTTA CGCTTTAGTC TCAAGTTGCT

AATCGGTACT GCCCTGAATT TTTTCTATGG TTTGGTAATT TTTATACCTG CTTTTCTGCT GAGCTATTAG

ATAAAACTAT TTAATATTTA CTATGTATAT TTTTTAAAGT ATTGTTGCTG CTTAATTAAC TATTGATGCT

TATATTTAAT GTTATAGCCT CACTCTTGAT CATAATGGGT CAATGCCTCA ATACCTAAA AAAAAAAAA

ATTAGATAGC CAGACACCAG GAAAGAAAAG TATTTCTTTT TTTAATAAAA AGAAATACCT TTTTGAGCAA

CTGAAATGAC AAAGTCACAA ATTTCCTGCA CACCTTAAAA TATACTTAAT GTAAATGACG AGTAATGGG

TGCAGCACAC CAACATGGCA CATGTATACA TGTGTGACAA ACCTGTATGT TGTGCACATG TACCCTAGAA

CTTAAAGTAT AATTTTAAAA AAATTCTATC TTCCAAAGCA TATCACTTCT CAGGTAGACA CAGTGTTTAT

TGCAAAAGAT CTGATTTCAA TAGTATTTCT TCAAGAGTCT CCCCAGAGAC AAAGTCAAGA AGAGGAAATC
```

-continued

```
AGCATATCTG AGAAGAAAGA TTTCAGGATC ACTTTTTTTG AGGGTCTGAG AAAATGTTTA GTTTCTATAT
TATTTAAAAC CAGAATTGAA ATGGGGTGAT TCCTATCCTT GCCACCTGCC TCTACAACCC AAGAGTTTC
TATCTGAGCA TCTAAACGTC TTTTAGGCTG AAAGGCTCAC CATGGCTTTG CTTGGTCCTT CTCTAGTTCT
TCTGCAGCCC ATTGAGCCTC TTGACTTAGC ACAAGGGTCT CAGGTCCTTG CCCAAAGGGA GTGTGCTGTG
CTGCAGGTAG ACTGCACTGA ATGTCAACAG AAAGCCTTGC TTTCTTTCAT TTCTCTAACC CAGTCTCACA
TCCTCCTCCT CCTCCCCTTT TCCCTCCCCT TCCTCCTGCA CTTCTCTTTC CTCTTTCCCC ACCCCTTTCC
TAGACTGGCC TCTATTGCCT CCCACTGAGA CAAAAATGAA CTGCTGATCA GAAAGTAATG TGACTAGATT
CTCTCTTCCT TCCCTCCTTT CTATCCTTCC TTCCATTCTC CTATGCATCT TTCCTTACCC TCCTCCTCCT
TCACTCATTG TTGTTGCTGT TCTTCTTCCT CTTCTTTTTC CTCCTGCTCC TCTTCTTCTA CTTGTTCTTG
TTCTTGTTTT TGTTTGGTTC TTGTTCTCCT CTTCCTCCTT CTCTCTCTCC TCCTCCTCCT TCTTTTCCAC
CACCCTCCCC TATCTTTTTC ATAAATGCTA AACTAACTCT TGGCTACCTG TGGTAAATGG CCCTTGGAAA
TTGCAAATAC TACAAATCAA AACTGCATTT CAGACATATT TATGATGTTT GCAAAACTTC AGTAGAGCTA
AGCAGTGGAC TTGACTCGTT TCGGTTCCTT CACCTCCGTC TTTCCTTGCT CACCACCTAG TGGACGTCCT
TGTTAGTGGC ACTTCCTGAA GTTAACCCCT GAAGAGAGCC CATGCTCTCT AGCTTTTCAC CGTGTAGGTT
TGGGAGCCTA CAAGTACCTT TAATATTCTT GGACTATAAA ATGAGATGGT TTTATAAGAC TGCATGTGAA
ATTAGGACCC ATATGATGAA GGACAATAAA AGGAAGACC CACTGATGTG AGTCAATGAG TCAAATGCAA
ATCAGATTTG CATTTTTAGG AAAATAATAA TAACAACAAC AAAAACTCTG AAGCTCAGCG CCCCATATTT
ATTATATTGT TTAATCTTTA TAACAGCTCT CTGCTATAGA TATGATTATT ATCCCCATTC TAAAGAGTCT
CAAAGAGGTT AAGAAACAAA TTCAAAAACT AGCGAAAGAC AAGAAATAAC TAAGATCAGA GCAGAACCAT
AGGAGGTAGA GACACGAAAA AGCCTTCAAA AAATCAATAA ATCCAGGAGC TGCATTTTGA AAAGATTAAC
AAAATAGATG GACCACTAGC TAGACTAATA AGAAAGAAGA ATCAATAGAC ACAATAAAAA ATGGTAAAGG
GGATATTACC ACTGATCCCG TAGAAATACA AACTACCATC AGAGATTACT ATAAACATCT TTACACAAAT
AAACTAGAAA ATCTAGAAGA AATGGATAAA TTCCTGGACA CATACACCCT CCCAAGACTA AACCAGGAAG
AAGTCAAATC CCTGAATAGA CTAATAACAA GTTCTGAAAT TAAGGCAGCA ATTAATAGCC TACCAACTAA
AAAAAGCCCA GGACCAGATG GATTCACAGC CAAATTCTAC CAGAGGTACA AAGAGGTGCT GGTACCATTC
CTTCTGAAAC TATTCCAGAG AATAGAAAAA GAGGAACTCC TCCCTCACTC ATTTTATGAG GCCAGCATCA
TCCTGATACT AAAACCTGGC AGAGACACAA CAAAAAAAGA AAATTTCAGG CCAATATCCC TGATGAACAT
CATTGCGAAA ATACTCAATA AAATACGGCA AACTGAATCC AGCAGCACAT CAAAAAGCTT ATCAACCACA
ATCAAGTTGG CTTCATCCCT GGAATGCAAG GCTGGTTCAA CATACACAAA TCAATAAACA GAATCCATTA
CGTAAACAGA ACCAATCACA AAAACCACGT GATTATCTCA ATAGATGCAG AAAAGGCCTT GGATAAAATT
CAACACCCCT TCATGCTAAA AACTCTCAAT AAACTAGGTA TTGATGGAAC GTATCTCAAA ATAATAAGAG
CTATTTATGA CAAACCCACA GCCAATAGCA TACTGAATGG GCAAAAACTG AAAGCGTTCC CTTTAAAAAC
TGGCACAAGA CAAGTATGCC TCTCTCACCA CTCCTGTTCA ACATAGTATT GGAAGTTCTG GCCAGGGCAA
TCAGGCAAGA GAAAGAAATA AAGTGTATTC AAATAGAAGA GAGGAAGTCA AATTGTGTCT GTTTGCAGAT
GACATGATTG TATATTTAGA AAATCCCATT GTCTCAGCCC AAAATCTCCT TAAACTGATC AGCAACTTCA
GCAAAGTCTC AGGTTACAAA ATCAATGTGA AAAATCACA AGAATTCCTA TACAGCAATA ATAGACAAAC
AGAGAGCCAA ATCATGAGTG AACTCCCATT CACGATTGCT ACAAAGAGAA TAAAATACCT AGGAATCCAA
CTTACAAGGA ATGTGAAGGA CCTATTCAAG GAGAACTACA AACCACTGCT CAAGGAAATA AGAGAGGACA
CAAATGAATG GAAAAACATT CCATGCTCAT GGGTAGGAAG AATCAATATC ATGAAAATGA CCATACTGCC
CAAGGTAATT TATAGATTCA GTGCTATCCC CATCAAGCTA CTACTGACTT TTTTCACAGA ATTAGAAAAA
```

```
AACTACTTTA AATTTCATAT GGAACCAAAA AAGAGCTTGT ATAGCCAAGA CAATCCTAAG CAAAAGAAC
AAAGCTGGAG GCATCATGCT ACCTGACTTC AAACTATACT ACAAGGCTAT AGTAACCAAA ACAGCATGGT
GCTGGTACAA AAACAGATAT ATGGACCAAC GGAACAGAAC AGAGGCATCA GAAATAACAC CACACATCTA
CAACCATCTG ATCTTTGACA AAGCTGACAA AAAGAAGCAA TTGGGAAAGG ATTCCCCATT TAATAAATGA
TGTTGGGAAA ACTGGCTAGC CATATGCAGA AAACTGAAAC TGGATCCCTT CCTTACACCT TATATAAAAA
TTAACTCAAG ATGGATTAAA GACTTAAATG GAAGACCTAA AACCATAAAA ATTCTAGGAG AAAACCTAGG
CAATACCATT CAGGACGTAG GTATGGGCAA AGACTTCATG ACTAAAACAC CAAAAGCAAC AGCAACAAAA
GCCAAAATTG ACAAATGGGA TCTAATTAAA CTAAAGAGCT TCTGCACAGT AGAAAAAAAA AAACTATCAT
CAAAGTGAAC AGGAAACCTA CAGAATGGGA GAAAATTTTT GCAATCTATT CACCTGACAA AGGGCTAATA
TCCAAAATCT ACAAGAAACT TAAACAAATT TACAAGAAAA AACAAACAAC ACCATCAAAA AGTGAGTGAA
GGATATGAAC AGATGCTTCT CAAAAGAAGA AGTTTATGCA GTCAACAAAC ATATGAAAAA AGCTCATCA
TCACTGGTCA TTAGAGAAAT GCAAATCAAA ACCACAATGA GATGCCATCT CATGCCAGTT AGAATGGCGA
TTATTAAAAA GTCAGGAAAC AACAGATGCT GGAGAGGATG TGGAGAAATA AGAATGCTTT TTACAGTGTT
GGTGGAAGTG TAAATTAGTT CAATCATTGT GGAAGACAAT GTGGCGATTT CTCAAGGATC TATAACTAGA
AAAACCATTT GACCCAGCAA TCCCATTACT GGGTATATAC CCAAAGGATT ATAAATCATT CTACGATAAA
GACACATGCA CACTTATGTT TATTGAGGCA CTATTCACAA CAGCAAAGAG TTGGAACCAA CCCAAATGCC
CACCAATGAT AAACTGGATA AAGATGATGT GGCACATATA CATCATGGAA TACTATACAG CCATAAAAAA
GGATGAGTTC ATGTCCTTTG CAGGGACATG GATGAAGCTG GAAACCGTCA TTCTCAGCAA ACTAACACTG
GAACAGAAAA CCAAACATTA CCCATTCTCA CTCATAAGTG GGAGTTGAAC AATGAGAACA CATGGACACA
GGGAGGGGAA CATCACACAC TGGGGCATGT CAGGGGATGT GGGGCTAGGG GAGGAACAGC ATTAGGAGAA
ATACCTAATG TAGATGACAG GTTGATGAAT GCAGCAAACC ACCATGGCAC ATGTATACCT ATGTAACAAA
CCTGCACGTT CTGCTCATGT ATCCCAGAAA TTAAAGTATA ATTTAAAAAA AGTTAAAAAA AAGAAAGTTG
CCTTAGTCAC ATAACTAGTA AGAGACATGG TTGGGAATTT GAACAGAGGC AATCAGTTC CAAATCCATG
CTCTTGATCA TTAAGCTGAA CTTATGGCAG GAACTTGGAA GACATGGTAA AATGGGGAAA ACGTGGAGC
CAGGGAGACT TGTGAAAGTG CCAGTGCTCC CACTATACCC TGAAAGAAGT ATCTAGACTT ACTTTTTTCT
AAGTCCTCTC CTCTAATTCT CTCAATCTCT CTCTCTCTTT CTCTAAGAGA TGGGAATGCT GCTCTGTCAC
TCAGGCTAGA GTGCAGTGGT GCGATCATAG CTCATTGCAC TCAAGGAATC CTAGGGTCTA GTGCCCCTTC
TCCCTCAGCC TCCCATGTAG CTAAGACTAC AGGCACATGC CCCAACCCTC GACTAATTTT TTTATTTTTT
ATTTTTGTAG AGACAGGATC TCACTATGTT GCTCAGGCTG TAATTCTGTC TTGAAGCTTG TCCAATCAGG
CTTTCAGCCA CACCAATTCC CTGAGACTGC TCTCACCAAG GTCCTACACT TCACTAACAC AAACAGCCTA
TTCTCCATCC TCATCTTACT TCACCAGGGA GCTCCTGGTT TTCCTCCTAC TTCACTGGCT ATTTCTTCTG
TATCATGTGT TGATTCTCCC TCATCTCCCC AACCTCCAAA CCCTTGGAGT ACTCCAGAGA TCACCGCTTT
GCTCTTCTGT GTCTAACCTC ACTAACTTGG TGGTCCAATT CACACTCTTG ACTTTGAATA CCATTTAAAT
GCGAACGAAT TCTAAATTCT GTACAACCAG AACCATTCTC CTGTAGCCAA ATGCCTACTC AACATCTCCA
TCCCCAAACA AATTTAGTTG TTCAATAAGC CTCTCATATT TTACATATCC CAAACTGAAC TTCTGAATTT
CTCCTCCAAT CTGTAGGGCT CTTCCCACAG CCTTTCCATC TCAGTGGATT ATAACTCCAT CCTTCCAGTT
ACTCAGACCA AAACTTTTGG AGTTAACTGA GACACCTCTC TTTTTTTTCA CAAGTCATAT CCAATGTGTC
AACAAATTTT GGTAGTGGAA ATATTGCGGG ATTTTTTAAG AAATCAGAGA GACCGATGGG GTTCAGGAGG
ATATTTATTA TTTAGGTGCA CTGGCCAAGT CAGATTAACA TCCAAAGGAC TGAGCCCTGA ACAAAGAGTT
```

```
AAGTTACCTT TTAAGCATTT TGTGGGGTGG GAGAGAGGGG TATCTGTGCA GGGGGAAGCA TACTACAGAA
GTGAGAAATA AAGACAGTTA TTCAATTAAT TGAGACATGC ATTACATCAT TTCTTACTTT TCAAGAAGAA
ACATGTTTTG CGACTTGAGT TTATCTGTCT AGTGACCTTG CAGCTGCACA GCTAGAGAAA CAGGGTCTTC
ACAATGCCTG GGAAAGGAGG AGAGGTAAGT CTCACTAGCC ACAGAAAAAC AGGCAGTTAA TTTTTAAAGG
GCTCCAGCTC TTTCTCTTTC TCAGGGGAG TTGGGTTTTG TTACATACAA CTGAGTTTCC GCTTACACAT
TATTTAATTT CTTTTAATTC CTGTTCCAAA AGAAGCCAGA TACAAAAGGT TACATGTTGT CTGATTCCAT
TTATATGAAA CATATAGAAG AGGTAAATCC ATAGAGACAG AAAGTAGATT AGAGGTTCCC AGGGGCTGAG
GAAGAAATGG GGACTAACTG CTTATAGGGT ACAGAGTTTT CTTCTGATAA AAATATTTTG GAACTAGATA
GACATTTTGT TAGGCCATTC TTGCATTGTT ATAAAGAATT ACCTGAGACT TGGTAATTTA TAAAGAAAAG
ATGTTTAATT GGCTTACACT TCTGCAAGCT TTACAGGAAG CATGGTGCCG ATATCTGCTC AGCTTCTGGT
AAGGCCTCAG GAAGCTTACA ATCATGGCAG AAGGTGAAAG GGGAGCAGGC ATATCACATA GCAAAAGCAG
GAGCAAGAGA GGGATGTGGG GAGGTGACAG TCACTTTTAA ACAGCCAGAT CTTGTGAAGA CTCATTCACT
ATCATGAAGA CAGTACCAAG AGGATGGTAC TAAATCATTC ATGAGAAACC CCACCCTCAT GATCAAATCA
CCTCCCACCA GGCCCCACCT CCAACACTGG GGATTACAAT TTGACATGAG ATTTGAGTGA AACACGGAT
CCAAACCATA TCAGAGATGG TGGTTATACA ATGCGATAAA CGTCACTGGA TTGTACACTT TAAGATGGTT
GTTTTATGTT GTGTGAACTT CACCTCAATA AAAAAAATA TTTAATGTAC ATTCAGCCAA AAGAAGATTT
GGAATAGGAA AGGTCATGGA GATATATTAA CAGCCATTTG ATGGGTGGTA AGGAAAAGAG TGGTTATTAG
ACTGTTTTGT GGCCCTCAAA AGGTAGAACT AGATCGAGTT GGTGAGCATT ATAAAACCAT CACAAAACCC
TGGAGAGAGG ACCCAGTGCT GAAGAACCGT TTGCCTGCCA TGAGACATGA GGGAAGTACC AGTGAATGCC
ATTGAAAGCA GCATCCCTGG GTCCAAGGGA TGGTCAAAGG ACCACTACCC AACCCTTCCC TAGCCTACGC
CTCCATTACA GATGACCGCA AGATTTATTT GCTCATTGCT GCCAACCAAG GCTGCACTCA CTGCAGTTGC
TATCAGTTTA TCATGGGTAA AAGGAATGTG CAGTAGAGAA CTAACTAACT GCCCACCTAC CTCCACAATC
CTATCAGGAC AAATCACCAT GGCTCACATT TCCTTACATT TGGCATGTAA GCCCCTCTTA CTGTCTGTCA
TCTATCTCCT ACACAGTTCA CCTAAACTGT CTCTCCTGA CCCAACCTTG ATTTTCATCC CAAATGCTTC
CTTGCCATCT CTGGGATTCC TGTCTTCACC ATCACCAAAC TCCCCTCAAT CTTCCAGTTT CCTGTTCAAA
CTTTTCTCCT ACCTCCTTGC TTTGTCATTA GCCCGACTGC CTCCCTAGGA CATCACTTCC CCTGCAGATC
TCTCAAGATG ACAATATTTA TTCTCCACAC AGCACATACT TCAGGGTTGG AAGGCAGGGG CAATCTTCTC
CTTTATAATG AGTGCCTCTT ATATATGTTT ATTCATCTGC CCTCTTGTAA AACACACACA CACACACACA
CAAAGAAGAA ATAAAATAAC TCTGCTTCTT TGAAGCTTGT GACACTGAGA TAAACCATCT CACTGTCCTC
ATTGTAGTGA CCTCTCAACT CCTCATGCAA GATTGGCTTT GGCACCTAGT TCCTGATCTT CCTTTCCCTG
TAAGCACTTC TCATAGTCTT ACGGGACTTC ACCATCCATG GCACAACCAA TACCACAGCC AGATCCTCA
GCTCTCCAAT GACATTTTCC TCCACTAGAC TTGAGCTACC TCCTTCCCTA GGCACAGCCT CAACCTCGAC
AACACCTAAG ACTGTACCGT CTCTAAAGTC ACATGTTCAA ACACTTCACT CTTTAACCAC TGTCTCCTAT
TCTTGCAAGT GTATTGCTCA AGTATCTCAT TGCAATGCTT TTTACTTCTA CCTCATTGAA CCTCCAGGCC
ATTAAACATT TCCTTATTTC TAACCATCAG GTTTCTCCTT ACTTGTTTGT TTGTTTATTT GTTTCTTTTT
TTTTTTTTTT TTTGAGACAG GGTCTCACTC TGTTGCCCAG GCTGGAGTGC AGTGGTATGA TCTCGGCTCA
CTGCAGCCTC CATCTCCCTG GTTCAAGTGA TTCTCATGTC TCAGCCTCCC GAGTAGCTGG GACTACAGGT
GCATGCCACT ACGCCTGGCT AAGATTTGT ATTTTTATTA GAGAAGGGGT TTGCCATGT TGGCCAAGCT
GGTCTCGAAC TCCTAACCTC AGGTGATCCA CCTGCCTCAG CCTCCCAAAG TGCTGAGATT ATAGGCATGA
GCCACTATGC CCCACCTGGT TTCTCCTTAT TTATTTCAAG TCTATGCTGC ACTATTAAAA CTGCCTTGAC
```

```
AAAAATTATA ATAGTGAGAA AATTATGACA GTGAAAGAGA TCTGAAATAA TCAACCCCCA TCTTGCCTTT
ACCTTCCAGA CTGCCCTTAA TAATTCCTGA GCTTGGGCCA AGCTATCTTT GGCAGAAATT TAGTTTATAG
TTTAAATGAT AATAGCCCTT CTCCAAAACT AAACTGCCTT TGTAAAACTA ATAAAAGACC ACCAATGAAA
GGTTAGGAGG ATGAGAGGAG CCTGAATTCT GCTAAGGTGT AGATGTAAAC AATTACCAAC TGTTATTCCG
GAGGTCACAA GATTTGCAAC ATCGCCAATT ACTCCTGCAG ATAACAGCAC TATCATAGAA TCTGATTGGC
CTTTTGAGAT GTCTTTTCAG ATTCTTACAT TTCAACTGGT GGCTCTACCT GGACCCATCA ACAAGTCCTG
TGGCTCCACC CAGAAGCAGA CTTAACATGC ACAAGGACCA TTTTCCACAC CGCTATGATT GCATCCCAAC
CAATCAGCAG CAACCATTCC TCTGCCTGCC AAATTATCCT TGAAAAATCT TAGCCTTAGA ATTTTGGGGG
AGGCTGATTT CAGTAATAAC AAAACCCCGG TCTCCCATTT GGCTGGCTCT GCATGAATTA AATTCTTTCT
CTATTGCAGT TCCCATCTTG ATAAATCACC TTTATCTGGG CAGCAAACAA AAGGAACCCA TTGGACAGTT
ACACTGTTGG CAGATATATC TTGCTTCCAA AATTGGATTT TGTTTAATG AATTTATTCT GTTTTCTTGA
TATTTACAAC TGTGAATGTT GTGTCTGAAT TCTCTTTATT TCTTGTTGAA AAGAACTATA TTGCTACAGC
CAGTACATAC AGATGGATAG CTAATTACTC AACACGGGGG GATGTGACCA TCACCGCACT GTGCAAATGA
ATGTTACCCA TTGTCCACTT TTCCCAAACT ACATAGTGTT ATATGGTATA TGACCCAATC AACGGTGGCA
AAGCTCCAGA ATACCACAT AGACATCAGG GACACTTTAA ACTAATCAGC CTATAGTCCT TTTTCAGTAA
TTTCCAAACC TGGTTGTGCA TCCAAATCAC TTGGTAACAT TAAAAAAACA AAAAAATATA CACGCAACAT
TCGCTCCCAA TCCTACTGAA TCAGAATATT TTGGGTTGGT TCAGGAACAT TCAGGAGTTT TCAGGGTCC
AAGGTTTATA TAATTTGAGG TCTCTCTTTG AGAAAAGGAA CGTAAAAGCG TCTTGCTTTT ATAGATCTTA
CAAAGATGTA TTACCATGTA AACACATTCC TAGGACCCAG GCCCTTGTAA TTTAAAGGTT TATCTAAGTA
ATGGGCCCTG AAGCTTAATT TTCATTATCT TCAGGGCAAA TTACCTGTGG GTTAGGGTTT AGGAATATAT
CTCTCTGTGT ATGTGTGTGC ACATTAGCAT GTACGCTTGT GTGGATTTTT TTTTTTTTT TTTTTTTTTC
TGAGACAGAG TCTCGCTCTG TCGCCAGGCT GGAGTGCAGT GGCGTGATCT CTGCTCACTG CAAACTCCGC
CTCCCAGGCT CAAGCGATTC TTCTGCCTCA GCCTCTTGAG TAGCTGGGAC TATAGGCACG CACCACTATG
CCCAGCTAAT TTTTGTATTT TTAGTAGAGT TGGGGTTTCG CCATGTTGGC CAGGATGGTC TTGATCTCTT
GACCTCGTGA TCCACCCGCC TCCACCTCCC AAAGTGCTGG GATTACAGGC GTGAGTCACC ATGCCCAGCA
CTTGTGTGGA TGTTTTAAGC TCCCAGGTGA GTGAATACAA AACTAGATCT TTCCCTTCTG TAGCATCTGT
ACTGTTTACT CTATGCATCT CAATATTTTT TCTTTTAGTA TCTTTCCTTT TTCTCTCTTA TTACTTCCTC
TTGTGCTATT TTTACACCTC CTTTTTTAAA AATTTTTTC CCTTTTATTT CTATTGACCT TTAGCCCTCA
CAATGATTCC TACAAGCCCC ATTTCTGTAA ATGGGGATTG AAATAATTGC TGGACTTTTG AGAGATAGAT
ATATTAAATT GCAAACTGGC AGTAGTGGGG GCAGTTGATA CATAACTAGG TTTTAAAGTC TAGCCTTCTG
AGACCACTCA TTCCATTTGT GAAAAGTGAT TCTACTTCTT ATTATGAGCC AAAATATGCA TTCATTCACC
CATGCATTGA TTTATTCATT CAATAAATAT TTGTTGGATG TCCACTCTGT ATCAGGAATG TGCTAGGTTC
TGGGAATACA GCAATGAACA AGGTAATTTT TCCCTACCCC TAAGGAACTT AGAGTTTAGT GGGGAAGACA
GACATTAAAC AAACAATTGT GCAAGTAATA ATCTATAATT ATTTATTACA ATTAAAGGAA GGAAGAGACA
TATGGATTAT GAGGGCATTA AAGAGGAGAC CTAGTGTAAG TAGCCAGTTC TCGTGAAGGG ACATGTATTA
GTTGGAGTTC TCCAGAGAAA CAGAACCAAT GGTGTGTGTG TGTGTGTGTG CGTGTGTGCG TGTGTGTGTT
GGGGTGTGGG GGTGTGGTAT TTTTTATAGA AATTGTCTCA CACAATTATG GAAGCTGAGA AGTCCCATGG
CCTGCTGTCT ACGAGCTGAG AACCAGGAAA GCCAGTGGAA TACTTCAAAG TCCAAAGGCC CTGGAACCAA
GAGTGCCAGT GTTGGAAGGC AGGAGAAGAT GGGTGTCCCA GCTTAAAAAG ACAGTGAATT CACTCTTTTT
```

-continued

```
GCTCTACATA GGGCCTCAAT GGGTTGGATC ATGGCCACCC ACATTGGTGA AGGCAATCCT CTTAGTCTAC

CAATTAAATA CTAATCTCTT TGGAAATACT CTCACAGACA CACTGAGAAA TAATGTTTTA TCAGGGTGAT

AGAAATCTTC TGGAGTTAAA CAATGGTGAT AGCTGTACAA TCACATACAT TTTTAAAGGG TGCGTTTTAT

GGAAAGTGAG TTTTATCTAA ATAAAATTTC TAAGAAAGAG ACTTAACACA GAGATAAACA TAAGCACATT

TATTGTCAAC CTTTATAGTG TTATGTCAAA TAGGTCTGAC ATAAGCTTAA ATAAATATAT ACTTTAAAAA

TTATAAAATA TTTTAAGTTA TAATTTAAAA TTCTCAATAA AACTCAAACA CAAACCACAC TGGTATTTCA

CACAGCTAAT TTCTAATGCA GTTTACATAA ATATTTACAA CACTTAAACA ATTTCAAAGA AAATAACACT

GTATTCCATA CATAGCCTGA TCACAGTAGT TGTTCTCTCT TATTTCCCAG AGTTTTTCTG CCCCTTTAAA

AGAACCTCTG CTGTTCTGAT CCTTATCACA TCTCTGTTTT GACTGTTGGC TTTGTTGTTG CCAGTGTTCA

GCCAGAACTT CTCTGAAACT TTTTTTTCAA CACATGCTAA GTTAATGGAA GTGTAGGAGA GTTTTGATTC

TCACACTCCT CAAGGCTAGA GCAGCTTTGG CAATTACTGA CTGAGAATTT TCATTGCCA GTGATCAACT

GAAAACTGGA GATTCCTTTG GAATTGTTAA ATCTGCTTAT AAATAAACAT AAATGCTTGC TCACACAGGC

ATTCCTCTCT TCCAGAGCAC CCTAACATAC AGAAGAAAAC AAATAGGGAA TAACTATTAG ACATCTTCAT

TCGTTAAAAA TCTACCAGAT GACTCTTTTA CATGGTGAGT TTCTATTGTG AATTTAAAAT CTTCCATAAT

ATACAAGAAT TATGTTTACA TATCATATCT GACAAACATC TTTGTAGGAA TGCAAAGCAC ATCCATCTTT

CTGTATTCTT TTCCAACAAA GACATTCATA AAATTATACC TTTGTGTGTT TGCATTTATG CTTTTATTAG

TTCAAAACGT TTGGCCTCAT GGAAGTTTTT CATCGTGGAA ACCACATATT TCTGAAAAAA TATCTGACAA

TATACAAACC TTCCATTCAG TTTTTACTCT CCAATTCTAC CATGTTTTCA AAAAACAACT GTAGTAAAAA

CACTCAGAAC TTTATTCTGG TTAACATCAT GCCTTGCTAG GGGACAATAG TTTCCCTTTT TGAAATAAAT

TTAAAACAGA TGTAACATAA TTTGTTAATA AACAATGAGG GGGTAATCTA GAATAAGTAA CTTTTACCAT

ATCATAGTTG ACAGCATTTA CAAGTTTTTT AAGTCCCTAC CACACTTGTA TTGAATGAAG AAGTATGGAA

GATTATAATA TATTCAATGC AAGTAAAAAT ATCACAATCC TTAAGAACTC TTTAAGAAGC ACTGAATCCC

ATAGGGATGA AAGTGATTAA ATTGTGCATA GTAACCCTCG CACAGAGCAT TCAGTAGGAT TTGCACCATT

AACAACCCTC CATGCATTTG CCTGTGGGCA TTCAACATCT GTCATTTTTT TAAGTTATAA TATTTTTAGT

CATTTTTTTC CTCTAAACTC TGGATAATTA TTATTCATTC TTATGACAGC AACTGTGTAA TCAGCTGTCG

AAACACTGTG AAGGGCAAAA GAAAGAAAGC CACAAAATAT TGTGTTTCTG TGCCAAGATT TTACAGCGAG

CAAGGGAGAG TTAGAAAAGG AATTCTGAGA TTTCAGAGTC TTGGTCTCTT CACCTTTGCT TGGAAGAAAA

TATCCTTTCC CTTCATTAGC CAACACTTTC TTGATCCTGA GAGTAGGAAA GGGAACACTG AGTCTTTTCA

GTTGAAGGCC GTCCTTGCCT GCTGGACTTT GATCTATTGA AGTGGTGATG GGTGTTGCGG TTTCAGCCAT

AAAGGCATCT GGCATAGTAG GCAAGAAGGG CCAGAGACCC GAGGAGAGTT ATCTGTCTCT GTTAACTTCA

GTGTATCCCT CTAGTTCCCC AGATGCACCT GTTTCTGTAA ATATAAACAT GCATGTCATC AGAACACTTA

ATATTCTGCA TACTGATCAT GACAACAAAA TGTACCTTCT AACACAGACA CTCTCACTAG GATAGACCAT

GTAGGAACAT CGAATTCTAT TCAGTTAGGA CAGTGATGAT GTCTACATAT TATACCTCTG TCAAAACCTA

CAGAATATAC AACACAGCAC AGAGTGAATT CTAATGTAGC CTGTGGACAT TAATGAATAA TAATGTATCA

ATATTGGCCC ATCAGTTGTA ACACTAATAT AAGATGTTAA TAACAGGGGG AATTGAAGGG GTGGTGGGA

GATATGTTGG AACTCTTTGT GCTTTCTGCT CAATTTTTCT GTAAACTTAA AACCGCACAC ACAAAAAAAG

TTATTTTAAT TTTTTAAAAA GTATTCAGAG GGACTTGACC TTTCCAAATT CTCTCAAAGC AGGTCGGAGT

AGTTAAGAAC ACAAATTTTA GAACCAGACT GCCAGAGTTT GAATCCTGGC TACACCACTT ACTAGCTTTG

AGATTTCAGA CAATTTACTT AACTTCTCTG TCTCATTTTC TTCATCTGTG TGATAAGAAA TAAAGTAACA

GGCCAGGCCC AGTGGCTCAC GCCTGTAATC CCAGCACTTT GAGAGGCCAA GGCGGGTGGA TCAGGAGTTC
```

-continued

```
AAGATCAGCC TGGCCAACAT GACGAAAAAA TACAAAATCT CTACTAAAAA TACAAAAATT AGCTGGGTGT
GGTGGCAGGC ACCTGTAATC CCAGCTACTC AGGAGGCTGA GGCAGGAGAA TTGCCTGAAC GCAGGAGGTG
GAGGTTGCAG TGAGCCAAGA TCATGCCACT GCACTCCAGT CTAGGCAACA GAATGAGACT CCATCTCAAA
ATTAAAAAAA AAAAAAGTAA AAAGAAAAGA TAAGAAATAT AGTACCAGCC CCTATCTCAG AGTTCCTAGC
TTAGAAAAAT TCCCAGAATA TAATAAGTGC AATGTAAGGG TCAGCTATCT TCATTATTAT TATCTATCAT
AAATGAAATT ACACAATAAA GCTAGATCCG TTTCTTTCCT CTCCTTCTAC AAAAAATAAA GCAACTTTCC
AGAACAATAC CCAGGTGATG ATTTCTCCCC TGCTCCCTCC CTAAGATATT GGCAAGTTTG GAGGGTTCAA
GGAGAAACAG AGCATGTAGA GAAGATACCT CTCTCATAAC CATTTGTGAT TTACAAGTCT TACCTGATTC
TTTTGAACTT AAAGGATGTA AGAAGGCTTT TGGTAGCTTC CATCTGATTC AAGGCTTTGG CAGCTGCTGT
GGAATACATG AGAACACTAG GTAAAGCACT GTCTTCCAAC ATGAAGAGAG AAAAATATGT GGAATGTTCA
ATGGCATGCT TTGTATAAGA ATGCAACTTA CCTGGCAGGA ACAAATTTCT TTGCTGCAAA AGAAAAGACA
AACAACCATT AATTCAGACT AAATGACTTT TAAGGATATA TTAAATCCAG ATACAATATG ACTTAATTCA
TCAAGTGTTG CAAACTCGAT GCTTCAGGGC CTCTGTAATA ATCAGAGCAC AAGCATGGCT CTGTGGCATC
TAGGGTAAAA TGCAAAGTGC ACAGCCATCC AAAGGGCATA GCAGCTTCCT AATGCCAGCA AATAGCTACG
GGGTCATCTT GCCCAATTCA GCTCCCAATT TTTCATGAGA AGTCCAAAGT CTTAATTTAA ATGTGAGATT
TCCTATTTTG TAAACGTCAG AACTTAACTC AAAAATGTTT TAAGTACTCT TAAACATGTA AGCCAAACAA
ACCATGAGTG TAGTCAGATG TGCTTCCATA TTCCTTATGA GAGACTCTCA AATTTAAGCC TGTACTCCAA
ATAAATCTCC TTAGGAAGAA TTTTATCCAT TTTCCTTAGA GTGCTCATCA TGGCAGTTCC ATTGCACAAT
TCCGGGAGGC ATCATATAAT TCAACATGAA TAGCACCCCC TGGAGTTGTA CAATATTAGG CACGACTAAC
ATTTTTATTT CCTGAAACAC TTCCCACACT GAGTTGTACT ACTAACTCTT TTCTTAATAC TTCTGCTTAA
TTATACTGCA TTTTATCCAG ATTCTAATTA TTGTTTAAAT CAGTAAGCAA GACCATGACT TATCAATGAG
AAAGAAATGT ATTTTCAAAA ACATTTTTGA AGTACATTCA TAAACTTCCT CACCTTTCCG TAAGCATTTC
CGAAGCCAGA GGAGAAATGG TGCTAATGTC AGGAGGGAGA GTCCAGCAGC AGAAAGTCCA GCTACCAAGG
GAATGTTGGA CTCAGTGGGA GCTAAGGAAG TAAGAGACGA AGAAAGGTCA TGAGGAAGAA TTGATGTTAA
AGTCTCTCCG TCCTGTCCCT TTGGCCTTTT TTCTGTACAT TCATTACTAG GAGCAGAAGA GCTATCTAGT
TTAATACAAG AAGCAGAGAT GTGGCATTAC AGGCCTTTGA GATCTGCTCC AAGCCACCTT TGAAGCTATT
TCCACCATTG GCAGGCAGAA CTCTAACTTG CCAAGCTCGT TCACAATACC ACACCACACC TTGGTTAATA
AACACTGCAC TTGCTTGCTC TCTTGCTCTC ACTCCCTCTT GTTTTCCATT TCCCCTTTCT CCTCTCCTCT
CTCTGTCTCC TTTTTCCAGT TGTCAGAATT CTACCCTTTC CATCAACATG CAACTTCTGT TTTTTCTCTA
TCCCCATACA ACTTAATATT CACAACTTGT CAACCTGGGC GAACTTTCTG GTTTGGATAT AATGAATAGT
TGATTACTGT AACAAGATAG CTCCCCCTTT TTCTTTTTAA TCACCAGACA ACCACCATCA ATCAATGCAT
CACCTTCACA GGTAGGTAGC AGGCCAGACC AGTGTCCTGT GGCTCCACAT GTCCGAGCTG CAGAGCCATT
GAGCGTCCAT CCTTCAGGAC AGGCGAACTT GCACACAGTG CCAAACACGG GCTCCCCACT GCAGCTCATG
TTGATCTTTC CCGGAACTGC CAGGCTTGAA CATTTTACCA CTGCAAATGT TAGGTACACA GGCAGAGTTT
CAGAAAAATC TACTGGAAAA CTTCCAAAAC TTGCTTAAAA GTCAACAATG AATGTAAAGT GTAAGCGCTA
CTTAGTTTTC AGCATGTAGG AAATTAGGAC CAAACCCCTT TGGGGCAATC TAGGTTCAGA AACTTTATGA
AGTATTTGAC CTGTACCCTA AAAAAGTCTG CACTCAATTC TACCTTGGCA GGAAGGAACC TCTTCTGTCC
ATTGTCCCTG AGATGTGCAC TCAAGTTGAG TTGATCCATG TAATTCAAAT CCCTCCTCAC AGCTGAAGGC
ACAAGAGGAC TTGTAGGTGA ATTCTCCAAT AGGGGAATGA GCACACCTCA CCAAACCCTT CGGGGGCTGG
```

-continued

```
TGGACAGCAT CGCATCTCAC AGCTGGAACA CACGAGAGAG CACTTTAGAA GTTTGTTTGC ATCTCCAGCA
ATACGTTTCC CAAGGTAACC AAGTTCCCAA GCTCTTCAAT AGTTCTTTTT ATCTTAAAAT AAAATAAAAA
CAAAGACTGT ACCTTCACAT GTGGGCTTCT CGTTGTCCCA CTCCCCTGTG GGGCCACATT GGAGCCTTTT
GGATCCCTTC AACACAAAAC CCTGCTCACA GGAGAACTCA CAGCTGGACC CATAACGGAA ACTGCCAGAA
GCACTAGGAA GACAATTCAT GTAGCCTCGC TCGGGGTTGG ACAAGGCTGT GCACTGGAAA GCTGAGACAT
CAAAATGATG GTCAGAAAAT ATTGCAGTGG AACTAGAGAG TACTTGGCGT TTGTTGAGTG AACCCAGTTC
ATTCAAGCAA CACTTGGAGA ACTGAAGATT CTTTATAATT CCCTGGACAA ATGGGAAGAT GGCTGTGTTT
TCTTTGAATT TCAGCCCCCT CACTGATCAT GGCACTAATT AAAAGACTAA TTAATCAGAA CATTAGTTCC
TGAGCACTGT TCTTCTAACA CACAAAATAA ATTATGGTCC AAGGAAAGAT TTCACGCAGT CTGAGGACAA
CATATGGGTC ATGGATGTTT ATAGATGGTG CCAAAAAGAA AGAAAAGAAA GCACCCCTAT AAAATTTGTC
TGTTTTGCAG TTTTGGTTTT GTGTTATGTT TTGCTACTGG AAATCATTCT GTGCTGGCTT TGGCTAGGAC
AAGGCCAGTG CCTGATAGTA AAAACTGCTT GTTTTCAATA TCCTTGCTCT CACTTTAAAG TGAATTAAAA
TTTACTGCTT ATATATGCAT CAATACTATC TCTGTAGCTG ACACCATGCT TGAAACAGTC TCATCACTGC
TAATTATGAG CCATTTCAGA AGACAGGTGT GATGAGAGTT TTACATTCAA ATCATGTTCT CATTATTCTG
CTTTCCGAAT TTTCTAATAT GATTCCTTTA GATTAAGAAT TCTGTCTATT CCATGCTAAT GTCTACAAAG
TTTTATCAGC ACATCACAGT TAAAAAAAAA CAGCAAAGAA TTCATTCTTA ACACATATGA TCCTTTCCCT
GGCCAAACAT TAGTTCTTTT AAATGAATCT CAAAGATACG AGGGTTGCTC ATCAAATCTG ATTTCTATAG
TTAAAGTGGG TATTGGTTTT TTTTTTCACT GTCCAAGTTT GAAGATGGTT GTTCTTTAAG AAAGTATAAA
TCGAAGGATC TCAAGCTTAC CTTCACAAAC TGGGATTTGC TGTGTCCACT GCCCTTGAGT GGTGCATTCA
ACCTGGGCTG GTCCCTGCAA CATGAAGCCT TCCTCACAGG TGAAGTTGCA GGATGATTTG AAGGTGAACT
CTCCAGCAGG GGAATGGCTG CACCTCACAG AGCCATTCTG AGGCTGGCGG ACGGCCCTGC ATGTCACAGC
TGTAACAAAT ATACGCATTG ATATTAGCAC GGCCTAGAAT TAGCTTGCCC ATTTCCAGTA TGGGTTGAGA
GAAAGAATGT TCACAGTAAG TCTCCATGTG GAACAACTCT ACCTTTACAC GTTGGCTCCT CGTTGTCCCA
ATTCCCAGAT GAGGTACACT GAAGGCTCTG GGCTCCCATT AGTTCAAATC CTTCTTCACA GTCAAATGTA
CAGGTTGTGT TCCATGGGAA GCTTCCAGGG TTTTGGAAAC ATTCCACGAA CCCATTGGCT GGATTTGTCA
CAGCATCACA CTCAACCACT GAGGATTTTA AAGAGCACCA TGAATTTTAC AGAAGAATGA TCTTTTCACT
TCCTATTGAG CTGGGTGCCT AACAGAGTGA GGAAGCTGCC TTCAAAGGGT AGATCCCAAA GTCCTATGTC
AATTCTTAGG GACATGCACA GCCAGAATAA AAGCTTTTAT TCTTTTTCAT GGATATTCTA TCTTTTCTGA
TTTCCACTTT GCCTATGCTG AGTGGTCTCT AATCTATGTT ATCATTTACG TGAGGTAAAA ATTTAAAAAA
AATAGATTCC AGATTAGGAG TTATGACTAG TACTGACATA CGTAGGCTAT TCATTTATTT TAGCCCATCA
GAGCCTGAAG AACTGATTTT TCTTTTTTTG GCCTCTGGTT CAGAAAGATA AAATTAAGAG AGAAAAAGAG
ATACTAAGAC TGCTTGACTA TCATGGTCTT AAGTTAGTCC CATGGCTTGG AAAAGTTAAA CAGGGAAACA
AGATGAGAAA TCCATTGAGA TTTCTAGAGC TTTATTGTTT TATGGTCTCC CTTACAAATC ACCAGAGCCT
CAGAAACACC CATTTCAAGC ATAGAATAAA AAAACCTCTC TCAACCCAAG CAGGTACTGG GTTGGCAATA
TACATTGGCT GAGAGAACAA ATTGTATTAA AAACAAAAAC AAAAAAAAAA CTTTCCCTGA AGTTTTGAAA
ATGTAAGTTG AATCAAAAAA CAGAAGCAAT GAGGGATGAG TTACAGAACG TTCTGTGCAT TCTCAGAGGG
ATTTACCATT GCAGGCTGGA ATAGGAGCAC TCCATTCTCC AGAGGACATA CACTGCATGG TCTCCATGCT
GCTTGGCAGG TAACCCCTAT CACAGCTGAT AGAGCAGGAA GAATTGTAGC TGAAGTTTCC CAGTGGGTGA
CTGCAAACCA GGCTTCCATG CTCAGGGGAT TCCAGGGCTG TACAGTTCAC AACTGAAAAA GAAACCCAAA
TCAGTTCTGC TCATCTCTCA CCTTTAACAG ATAAGAACAC TGGAAACTAG AACTACAGTT TGGTTTTTTT
```

-continued

```
TTTTTTTAGT TTAAAAATTT ATAAAATTTC TAATGGAATT TGTAAAATTG ACTGTAATTC TACCCCTTTT

CTTTTATTCA AGAAAATGCT GATCCATAAC AACAACAACA AAAAGCAGT GATGACAACC ATAAAAAAGA

AATATTGAGT GATATGGGGA GAGTAGTGTA ATTGTGTTTA CCTCAAAACT GTTCAAATTA TATGAACAAA

CACAGCAAAC TTAGGTACCA CAACAAATTT CTTGTTACTT TTCTCACAAC TGCTAAAAAT ACTACAGTAA

GCTTCCAACC AGGATGAGAA CCATTCACAA AGCTATATTT CAAATTTAAG TACTAGAATA CATTACAAAT

TTTAAAACCC TAATGCTGCA CTGTCTACTA TAGTAGCCAC TATCTGTGTG GCTACTCAAA TTTAAACTTG

AATTCGTTGA AATCAAATAA CATTTAAAAT TCAGTTCCTC AGTGTCACCA GCCACATTTC AAGTACTCAA

TAACCACATG TGGCTCATAG GTACACACTG GAAAACACAG CTATGGAACA TTTCCATTAT CACAAAAGCT

CTACTGCACA ACGCTGTGCT AAGGAATCTT GGAGAGAAGC TCATCTAACT CTCTTAATGT ACAAATTTAG

GAACTGAGAC CTCATTTCAT TCAAGTGACT TGCTCCATGC TACACGGCTA GTCATTACAG AGCCAGAGGC

CAGAGCATGA ACCAAGATAC CCTGGACTCT GTAACTCACT CATTTCTACT GCAACGTCTT GTTACCACCT

AGATGAGGTG AGTACATGTT CCTCGCAGGG ACACAGAATT ACAGTTTATT GAATGTGTCC TGTGTGCCAG

GCACCATGTA ACCATGAGCC TATGAAGTTC ACACTATTAT TATCCTCATT TTACAATGAG AAAACTGACA

TAGAGAGTTA AACTATCTTG TCAAGGTGCC AAAATAAATA ACTGGTGAAT CTAGGACTCA AACCCAGCAG

GGTCTGACTT CATAGTCTCA GCTCACGATC ACCATATGAC ACCATCTGCA CCAGGGAAGG GAAGGCATGC

AGACCTGACT CTAATGCCAG CTAGGACGTG AGATGGTGCT ACCATCTCAA GTGAAGAAAG AGGCAAGAAC

CAGACTTACT TTGCTCACAC TTGAGTCCAC TGAAGCCAGG GTCACACTTG CAAGTGTAAT TATTGATGGT

CTCTACACAT TCACCGTGGC CACTGCAGGA TGTATTGGTA CAGGCAGCTA CGGAAAATAC AAAGCATGAT

GAGGAGGACT ATTACTGTGC TTATACTGAG TGCCTTTGAT TTTAGAATCA ACAGTGTGCA ACAGAGACAT

CAGCAGTCCT ACAGAGTGCC ATAGACTTTA ACTGAAGTGT TTTACAAAGT TCCAAATCTG AGTTTCAGGC

CCACCTATCC TAAACCTTGA TGCTAATGTA TAGCTGTGGC TGGCACCTAC CGTAGAAAAT TTACTTCTTC

ACAAACTCTG AAGACAGTTC CCCTACCACA AATAAACAAG TAATTAAAAT ATGTATTGTG TGTGTGCATT

TTTATATGTA AAGAACTACA TATTTGCCTA CAGTATTTAT ATATATTTTA TATATATACA TACACACATA

TATGTGTGTA TATGTGTGTA TGTATATATA TAAAATGTAT ATAAATGCTG TAGGCTATAT ATATATACAC

ACACACATAT ATGTGTGTGT GTATATATGT GTGTGTGTGT ATATATATAC ATATCCACAT ATTCTTGCCC

ACATTCACAC AAAACAGCAA AAGAGAGAAA CTTTAGCAGT TAAACAGAAT CTTTTGGAAC ATAAAATGAC

CACAATAGAG AGCAGTTTTT GCATGCTGTA AATTTGCCAA GATGCCCACA CACTGAAACT ACCTCCCACT

GCTGCCGCAA ACTCCCTACC TGTGTAGCAT AGGGCAAGCT TCTTCTTGCT GCACCTCTCA TCATTCCACA

TGCCCACATC TTTTTCTCTC TTGATGTAGA TCTCCACGCA GTCCTCATCT TTTTGCCTAT TGTTGGGTTC

ACCTGGAGCC CAGTTCTTGG CTTCTTCTGT CAGAGGTTTC TGGGTTCCTA CCCAGACCCA CACATTGTTG

ACTTTTCTGA TTCCAATCCA GTAATAACTT GGTGAATAGC TCAATATGGA GTTTAGGTAC TCAATCTCTT

CTTTGTTTTG AATTGCAACC AGGTGTGTGT ACCTTTGCTG ACAATAAGCA CTGGCCTCAT CATAAGTCAT

AGCTTCCGTG GAGGTGTTGT AAGACCAGGC TCCACTCTCT TTAATGAGAA GCACTAGTGG GAGAAAAAGA

AAAGAAATGG TAGAGTTTGG TACTGTTGTG GTTAACTCT GACAACTGTG CTTTTTATTG TCTTATTTTT

GGCAATGTTT GTGACATGGC CCAGACTTTT CTCATCTTTT CAAAAGTAAG AAGTACGTAT GAAGAAACAG

CGACTTATTG TTTATCTCTT TTGTGACTGC CACCCACTAG GTACCTTATC CACACTCACT CACAACATTA

TAGTATACCC ATTTTGTAGT AGAATAATAA TCAGAATAAC TAAGCTTTAT TGAGCACTTA GTATGCACCA

AGAAGCACTG TATGAGGTAC TTTCCATGAA CCATGCTATT GAATCCTCAC AATGCATCTG GGAAATAGGT

CATTATGATC CACACTTTAC ACTTAAGGAA AGGGAGACAC CAAGAGGTAA AGTAAATGAC CCCAAGCCCA
```

-continued

```
GGGAAGAACA CATTGCAGGT AGAGGTCAAG GATGCTGCCA GATATCCTGT GCAGGACAGC CCCAGACAAG

CAAGGATATT TCAGTCTGAA ATATCTATAG TGCGAGAATG AGAAATCTTG GTCTAATGGC ACTGACTTAC

CCAAAGTGAG AGCTGAGAGA AACTGTGAAG CAATCATGAC TTCAAGAGTT CTTTTCACCC AAAGGTTTAG

GCTTGAAATA CTTTCCTGGG GAGATAAAAC ACAAAATGAA TTAAAGAAGG AAATCGTGGG TAGCTAGTTA

CATTATTCTA CCATGATGTT TAAGGCAGCA TCCTAAGATT TTGGGCAAAG GACACTAGTG CAATAATCTT

TATTTCAGAG TTTAATCAAA TAAATAAACA AATTTTAAGA CTTTCATTAT TTAGGTCAAA GAGAAAAGAC

AGGTTTTAGC TACAATACAA TAAGAGCTTG TACAGATGTG GTTTTTATTA GAAGGCCTTT TGCATATCTG

TGTTTCATGG CCCGAGGCTG CCCTTATAAA GCGTTCTGCA CTTACCGTTT TGGGAAGCAG TTGTTCAAAC

ACAGGATCTC TCAGGTGGGT ATCACTGCTG CCTCTGTCTC AGGTCAGTAT AGGAGTTTTG ATGTGAAGTC

AGCCAAGAAC AGCTGAACAC TACTTCGGCT GAGGCCCTTT TATAGGAGGG ATTGCTTCCT GTGAATAATA

GGAGGATATT GTCCACATCC AGTAAAGAGG AAATCCCCAA TGGCATCCAA AAACTTTCCC GGGAATATCC

ACGATGCTTA AAATTACAAT GATGTCAGAA ACTCTGTCTC TTGAAGCTAC TTCACCTTTG TCCATGCCTT

TATATCGTAT ATGCAATTTT ATTAATATGA CAAAAATGCA TGATTTTTAA TTATAATAAC ATAAAGTCTA

TGTCTTTAAA AAGTTGTAAA ACTTTGCTTG TTAGTAGTGT CTCTCATGTA GTTGTGGTAG TAATTAGAAT

TTCAGAAACA GAAGGAAACC AAGAATAGGT TTGTCATCCA TAGTCTACTA CCTTCAATTT CTCATTCATA

GCTGTGGATA ACCAATCACT ACTCATTTTT CTTCCTTTT TCACCTGCCA ATTCAACATA TTTAACATGC

ACTGTCTCAC AGAGGAATGA CTCACAAGGT AGATATTAAT CTTCAGATTT TGCACGGCAG TTATGCCTAA

ATTAAAATAT TATCTAAAAA TAATATCTAA CACTCAAATG GTTAAAATAA TGCCTTATTT TAAAAAAAGA

AAAATGGGAA ATAGATATTT ACATCTGGGA AAGTTTCATG GTTTGTTCAG TGAAAAAAAT AAAAAGGAGG

CCAGGCACAG TGGCTCACGC CTGTAATCCC ACCACTTTGG GAGGCCGAGG CAGGCGGATC ACCTGAGGCC

GGGAGTTCAA GACCAGCCTG ACCAACATGG AGAAACGCCA TCTCTACTAA AAATACAAAA TTAGCTGGGC

ATGGTGGCGC ATGCCTGTAA TCCCAGCTAC TCGGGAGGCT GAGGCAGGAG AATCGCTTGA ACCCGGGAAG

TGGAGGTTGC AGTGAGCCAA GATCACGCCA GTGCACTCCA GCCTGGGAAA CGAGTGAAAC TCTGTCTTAA

AAAAAAAAAA AAAAAAAGAA AAGAAAAGAA AAAAAATAAA ACGGAAAACT ATATATATAT ATTTAATTGG

TCAAAATTTT GTTTAAAATT TTTGAAATGT TAATGTGCAA AGAATAAAAA TTCTTCCACA ATGTTAACAG

TGACTAACTC TGGATGGCAG GATTTGGGAT AATTTTTATA TCCTTCATTA TTATTTTCAG GATTTTAAAG

TTTTTTTCAA TTTCCCTTTT TTTCACCTTT ATAGTAACAA GAATACAGTT TAAAGAAACT TGTCTCTAGG

CCAGGCATGA TGGCTCATGC CTGTAATCCC AGCACTTTGG GAGGCTGAGG TGGGTGGATC ACCTGAGGTC

AGGAGTTCCA GACCAGCGTG GCCAATATGG TGAAACCCTG TCTCTACTAA AAATACAAAA ATTAGCCGGG

GTGTAGTGGC GCATGCCTGT AATCCCAGCT ACTGGGAGC CTGATGCAAG AGAATCGCTT GAACCCAGGA

GGCAGAGGTT GCAGTGAGCT GAAATCACAC CATTGCACTC CAGCCTGGGC GACAGAGCAA GACTCCATCT

CAAAAAAAAA GAAAAAAAGA AAAAGAAAAG AAAAGAAATT TGTTTCCAAA TGCAACAGAA GGAGATGTAT

GTGGTATCCT ATATTCCTGC TCTTCATTTT GACATTTCTT CTGGGTGATT GTATACATTC CCCATCTCTG

CATCTTACCC TATCTAAATG ATGGTAACAG TAAATGGGGA TCATTTTAAT TTCCATATTC TGTAGGTTTT

CAGAGCTCAA GTCAAGCTAA TATTCTATAT CTACAGCCTT TCAAAATAGG AGGTCTATCT AAAAATGTAC

TGTCAGCAGA CCTGAACGAG TAGTGGTAAA AGCCTCGTTT TTCTCTTTAC TTGTTAGCAC TGGTCTTTCT

GTGTTCATAA AGATGTCAAG ACCCAAAAAA AAAACAAGAA AAGAGAAGAA AAATTCCAAA AAAGACAACT

GATTAGAAAA AAATAACTTA ATTAACGAAT TTAATTCAAC CCCTATCAAA AGCATAGAA TTTATTCCCT

CCACCTTACC ACTCTCTTAC ATGATCCAGA TACTGACATT ATTCCAATTC TTTATCCCAC TTTACTTAGC

TCAATGTGGT TGTTGCTTCA ATAAATTCAG AAGAGTAATC ACTCATATAG TGTTTATTTA GATTTTAGGG
```

```
CAGAATGTCA AGTTGGGTTA ATACATTATC TGTATGTATT TTATTTTTAA TAAAGTATGA ATACATAATC

TGCTATTTTT AAAAAGCATG GTCAAATGTA TAGAGTAGCC AAATCTTAAA AAACAATTTA TCTTCGATAT

CAATAAAGTA CCTAATAATT ATATTGCTAA TAGAAATTAG TCGTTAACAT CCCTAGATAA CTAACTTTAT

TATTGCGAAT TTTTCATAAC TAAGTTTATA GTTTATCTCT TCCCCTTTTT AAAATTAGTT CAAAGATATC

TAAAAATAGC CCCAGTGGTG ATGAAGTTTC TATTTTACTT ACATATATAT GTCCTGGACC CCCAATTATA

ATCTCTAACA TTTATTGAGT GCTTACTATG TGCCAGGCCA TATTCTGAGC ATTTTGTATG TTCACCTATT

GATTATTCAA TCCGTACAAC AGCCTATGAA ATAGGTACTC CTATTATCCC CATTTTACAG ATGAGGAAAT

TGAGAATCTG GGGATTTTAT CTCATTCAAA AGCACAGAGC TAAGGGTTGA AACCAGGCAG TTGATATCCA

GAGCCCACTC CCTTACCTGC TACTCCAAAC CATGATTTCT TTTGTTGTTA TGCCCCGAGA TTCCTTGTTC

TACCCAAGTT TCCTGTACTC TTCTTGCCCT CTTCTTCCTG AGACATCCTT GACCATCACA GCTCTCCACT

GAGATAACTG TGTCCTGGGT TCTGAGACAT GGGGGCTGGA AGGGACCCCA GGGACAGTGA GCAGTAGGGA

GAGGATGCAG TGAGAACAGA CCCTGGATCC CCGGTGCATA GGCAGGGAGA AAGTGGACAA AGGAAAAAAC

AAGCAAGGCA GGTGGAGCCA TGCCTAGGTA AAGTTGATCC CTAAGCCACA GTTCCCAGAA GTTCCTGATT

CAAAAGCAAA TTTTCTCTAA GGTCAAAGGG CAAACTGATT ATTCTAAATT CTAAACTGAT TATTTCTAAA

TTGAGAAAGC TTCAGGGAGA GATCCCAATA TTCGAAGGAT AAGAGAAATG AGGAGTGGAA GAGATAGGTG

AGTAACAGTA ACTTAAATGT AGACTATATA TAATATATAA TATATGTAGA GTATATATAT ATAATTACAA

TATATTATAT ATGTGGAATA TATATATTAT TTATATATAT TTATATATTT TATATATATA GATATTTTTA

TATTTTATAT ATAAATATAG ATATTTTTAT ATTTTATATA TAAATATAGA TATTTTTATA TATATTATAT

ATAAATATAT GTAAAATACT GTGAAAGAAG AATAGAATCT TGAGACCTCA AATTCACTAT GCCAAAGGGA

AAGTTAAGCT TGGGAAATGA GTCATGCAAA AACTGCCTTC CTTTTGTTCC CAAATACCTG TAATTTCACA

TGCTTACTTT ATCTTATATA AAATGTAGAT GTACTGAGCA TGAGATCCAT GCATAATTTC CCTCTAGTCC

CTTCTTTTTA CATGTAAAGT GTAGACTCAC TGAGTGTTAC AGAGCCTTGC CACAATGTAA ACACTTGTCT

CATTGCCAAC CCATCTTTCG TTTATTTTCT TCCCCTCCTG CTTGCTCTTT CCCCTCTAAA GATGGAAGTT

CCCAAAACTC TCTTTGGAAA AAGCGCAGGT CACAGATCCT ACAGTGATTT GTGTTTCTTT TACCTGGGAC

AAAATAAACC TCTAATCTGT TGAGATATGC TTCAGTTACT TTTTGGTTTA CAATATGTAC ATGTATGTAT

ATAATTTATA TGTATATAAT ATATGTACTT GTTTTAACCA GAGGTATGTT ATTCAAAATC CATTCATCCT

TACAATTACC TGCATTCTCC CACAGTATTT TCTGTGTCCC TGCCCCGAG GTTGTCACTG CAAATCAGGT

ACATGGATAC TGGGAGCTGA TGGGCTCCCC TCTGGCTACC TGGGCTGCTG AAGGGGCCAT AGACAGACCC

AGCTTTCCTC TCGTGGAGAG GCCCTGGGCC AGCGCTGCGT GGGAGTGGGA TTACAACCAG ACTATAGCTT

CTTCACCTGC TTTTTCCTAT CAGGATTTCA TAAGAGGCAA TTGCTTGTTT TTTGAGGGTG GGGCAAATC

AGGGGGAGTT GAAGAGGAAA TTGGGTAAGA TTTGAATAGT TGGGCATGTT GAATATTATG AATATCATCT

CCCTCTTCAA ATAATCCAAA ATATACCCCC AAGAAACAGG CTGATTAGAG GTGCTTCAAG GCTCCACTGA

ATCTCCCAAG CTCTGAAGAT GTAGCTAGCT GTTACCGGAT TGCCGGTTTT CAAGCCTCGC CTCACATGGA

CCCTCTTGGC AGTTTCTCGC ATGGGGAAG CATCCGCTAC ATAGATGGGA ATGAAAAGAG GAAAGAAGAC

GGTGCAAACT CAGGCACACC CCGGTGTCTG CCACCAGTGC TATTTAATCT CTGAGGTGTC ACCCTTCCTG

GCTTTATTGT CTCTTCCTGG AAGTCTCTTG TCCTCTCCTC CACACCCTTT AATCAGGCAT CAAAGACTTT

AACCAGTTTT GCTGTGTGCC CAGGCCCACT CATTCTCACT TTTATGGCAA AGGGAGTGGG AGACAGAGAG

ATAGCCAGAA AGAAGAGATT GGGGACCCCA AGACAAATGT TAGAATTTTA ACCAAGGCCA CCCTGTGGAC

AGGAGATTAT TGGGTTTAGT GGAAAGCAGC ACTGGCCACA ACCACACGTG GCAAAAGCAT CTATCGAGGA
```

-continued

```
GTGAAGTTAT ATTTGGTGAA TGTGACCGGG AAGCAGGGGC AGTGGTGTCC TCCTGCCTTC CTGAGGCACT
CTGTTCCCTT ACCTCTGCGA AGGCTTATTT TACCCCTGAG TGCTTAGTTT TGAAAGCCTT AGTTCCCTCT
CTCCCATAAA AAAGCTCTAC TCTGCTAACA TCTAAGTTAC CTTTGCAGAG TCTTAGGTAG AGGGAGGAAA
TCCCAATAAA GATTCCACCC TATCTGCAAA ATACAAACAT GGTATTTCTT GCATTCCCAA AATTGTGAAA
GAAAATGTGT ATCACCACAG TAGAGAATGG CATTTTTTGT TTGATCAAAA CCTAAATATA TTTGATGAAA
ATGTGTCTGG TTCTAAGTTT ATTTCCCAGA AAGCCATGTT TACTCACTTG GAATTTATAG ACATCTTATA
ATATCTGAGT CGAGTAGGAG CTCCGGGCTC TACCTCACTC TTTTCTCCCA CACCCAGGGG GAAGTGTAGG
GTTCTCAGAC TTTAGAATAA AGAGGAATCA CCTGGACAAC TCACCTAAAA TGCACATCTT CAGGTCTCAT
ACTCAGAGGC TCTGACTCAA CAGGTCTGGG TGGCGCCCAA GAATTTGGGC TTTAAATGAG TATCTCAGAT
GATTCTAATA CAGAATGTGT AAGATGACCA GATCCTATCA CACTTAGATG TATTGGCCTA GGGCCACCTA
ACTTGGAGAA AATGTTAGTA AGACCCCGTG GTTGGTGCTC AGCTATAGGT ACCAGAATTT TGATCAAAAT
TTACTATCAT TGTGACACTT CTCTTCGGAA CTGGAAGGCC AGAACCCCAC TTGTAAAGTG CTGGGAAAAT
ACAAGGAAAA TTTAGGGTGA GTAGCATTTT GAATTCTTAC ACATGGAAAG TAAATGTATA AGAATTCTTA
CCAATAAAAA AAAAGCAAGA GAGAATAGCT GCTAAAGAAT TAACACAAAT ATGTATATAT TAGTTATTCT
CTTTTCTCCT CTGATTCCAG AGGACTTTGT AATTCCACTA ATTCTTCTTG AGCTTCCAGG ATGATCTGAG
ACTTGAATTT TTCATGTGCT TTTTGCTTCC TATTTGGCAG CATCTTATCT TGAAGTTTCC GCTTTCTGCT
TGGGGACCTA AAAACTAACT AATGGGAATT TCTTCAAAAT GAGCAAACTC TGGTGAATTC CCAAAGCGGA
AGAAACAAGT GAGGATCGGG CTGGTTAATT AAGAGAACTT TTCCTGAATG TAGCCAGACT GTTTGCCGAC
TGTTGTTAAC ATGAGGGAAG AAATACCCCT GGATTTTAGA AGAGCCCCTT GTTTGTTTTC CTTGGCCATT
TGTGCTGCTT GTTTTGTAAG TCAGAAATTT CCTGAAGGAC TATTATTAGC TTTGTTCTCA CGTCAGAAAA
CTTCTGCTCT GGCCACTTTT AAACATATAA CTTGGATTTT ACTGTATTAG AAAATGTAAC AATTACAGAC
AGCACTAAAA GGACACCAAA GGGCAAAGAA AATGGGTAAC TTTTTTTTCT TCCCCAAATC TAAAATAGGT
GATTTTGGAG AAGTAGGAGA AAAACCTGGA TTTTCTAGAT CTCTTTAGAG CTCAACAACT GATATAGTTA
ATTATGTAAG TCTTTGATAT TTGGAAATGA TTGGATTAAC CGGATAACAA TGAATATTTA AATACAGTGA
TTTGGCCAGG AGCAGTGGCT CATGCCTGTA ATCCCAGCAT TTGGGGAGGC TGAGGCGGGT GGATCACCTA
AGGCCGGGAG TTCCAGACCA GCCTGGCCAA CATGGTGAAA CCCCATCTCT ACTAAAAATA CAAAATTAGC
CAGGCGTGGT GGTGCAAGAC TGTAATCCCA GCAACTCGGG AGGCTGAGGC AGGAGAATTG CTTGAACCCG
GGAGGCAGAG GTTGCAGTGA GCCAAGATCA CGCCATTGCA CTCCAGCCTG GCAACAAGA GCGAAATTCC
ATCTCAATAA ATAAATAAAT AAATACAGTG ATTTAACACA AGAGATTTCT ATTTCACACT AATGAGCTCT
GTCACTGGGG CAAGCTTCTT TGCCTCATTA AGTCTCAGAT TTCCCGAGAG CTTATTTATT TATACCAAGA
GTGCTTTACT ACCGTCTCTG CTAGCTGTGA CATAATATGA CAAAAGGTAT AAATATGGGA AAGGCACTA
ATTTATATCA AAGCGTTCTT CGTTTTTCCT TGCTGTGAAG TTTTTAGCTA ATAATTCATA AGAATATACC
ATATTTAGAG TGTTTACTAT GCATGGGCCT GGCACTTCAC ATACATTGCT TCTTACAAAT TTTACAAAGT
GAAAGGTAGA TATTAATCTC ATTTTATGGA GGACAAGATA GAGATCTGGA GAGGTTACAT AACTTGCCAG
TGTTTTTTCA GTTAATAAAT GGTAGGGTGG AGATTCAATC TGTGTTACTC TAAAGTCCGT GTCCTTTTTA
TTGGCTCCAT GCCTACTCAG ATTTAAATCT CAGCAGGGAA GTAAACCTTA GTTTTTACAT GAGAAAATGT
TACAGCAGCC TTCTCGGCTT CCTTTACCCC CATCCCAGTT TCACGAGCTT AGTGCCTTAG ATCGGGTTCC
TTTAGAAGCA GACCTCGAAA TAAGGATGTG GGTGCCAGTC ATTTATTGAA AAGATGATCC CAAGAAAGCC
TAGTAGGAGA GTGAGGAAGT GAGATGGGGA AAGGAAGAAA CTCCACAAGA AGTGTGTTAA TAAGCAGGTT
ACCGCTGTGG GCAGCCATGG GGCTCAGCTG CACTAACAAA CTCTGTCTAG TACAGAAAAC CTCAGGGTCT
```

```
CCCCAAGGAG GGGCAAGAAG TCTGCCTAGG GTATATATCC GCCAACTCAG TCACTGGCTG AGAGCTGATC
CTGGGAGGGC ATGGTTAATT CCTCTGCACT TTCAAGTGGA TTCCTGTGGT CAGAAAAAGC CCTCTACAAT
GAATTCCAGA TGCTTGTATT TAAATCTGAC ATGATCTGAA TGCTGTGTTG GGACAGGGTG GGCGTTATTA
GTTTTCTGTC ATTACTGTAA CAGATTACTA CAAACCTGAT GGCTGCAAAC AACACATATT TATTATGTCA
TAGTTTGTGT GGGTCAGAAG TACAGGTTAG CTCAACTAGT TTCTCTGCTC TAGGTTTCAC ATTGCCAATA
TCAAGGTGTC ATCCAGTTGG GCTCTTCTTG GGAGGCTTGG GGATGAATCC ACTTTCAAGC TCATTCAGAT
TGTTGGCAGA ATCCAGTTCC TTGTGGTTGC AGGACCAAGG TCCCTGTTGC CTTGCTGGCT GTTGGCCAGG
AGTCATTCTT AGCTTCTAGA GACTACCTGT ACTCTCTGAC TCGTGTCTCC ACTTCACCTT TCAAACCAGC
AGCGGCTAGT CGAGTCCCTC TCTTCAAATG TCTCCAACTG TGCCTTCACC TCATTTCTCC TCTGTGTACC
ATGTCTGCCT CTACTGCTTG TAAGGGCTCA TGGGATTACA TTGGATTTAT TCAATCCAGG ATAATCTCCA
TATTTTAAGG CTAGCTGACT AGTGATCTTA ATTCCATCTA CAAAGTCCCT TCCAATAGTA CTGTATTAGT
CCATTTTCAT GCTACTGATA AAGACATACC CAAGACTGGG CAATTCACAA AGAAAGAGG TTTAATTAGA
TTTACAGTTC CACATGGCTG GGAAGCCTC ACAATCATGG CAGAAGTCAA GGAAGAGCAA GTCATGTCTT
ACATAGATGG CAGCAGGCAA AGAGAGAGAG CTTGTGCAGG GAACTCCTCT TTTTAAAACC ATCAGATCTC
ATAATACTTA TTCACTATCA CAAGAACAGC ATGGGAAAGT CTTGCCCCCA TGATTCAATT ACTCCCACCA
GGTCCCTCCC ACAACATGCA GGAATTCAAG ATGAGATTTG TGTGGGGACA CAGCCAAACC ATATCAAGTA
CCTAGATTCA TGTTTGATTA AACAACCAGG GAGCAGAAAT CTTCAGGAGT GGGGGGCATC TTTAGAATTC
TGCCCACCAA GGCTGGGCGC GGTGGCTCAC ACCTGTAATC CCAGCACTTT GGGAGGCCAA GGTGGGTGGA
TCATGAGGTC AAGAGATCGA GACCACCCTG GCCATGGTGA AACCCCATTT CTACTAAAAA TACAAAAATT
AGCCAGGTAT GGTGGTGGGC ACCTGTAGTC CCAGCTACTC AGGAGGCTGA GGTAGGAGAA TCACTTGAAC
CCAGGAAGCG GAGGTTGCAG TGAGCCAAGA TTGCGCCGCT GCACTCCAGC CTGGGAGACA GAGCAAGACT
GTCTCAAAAA AAAAGAATTC TGCCCATCAT AGTAGGCTGT CCTACAGAGA CATAACCCAG GAATTAGGTG
AATGGCTAAC CTAAATTAGC ACTGTGATGT GTTTTCTGAC TTGGTCCTTA TAGCTCCTCT GCTTAGATGT
GGAACTAATC CATGAATGCA AGGGTTTGTC TAGAGTTTTA AGTGGGAGTT AAATATCCAA AGTACAGGAG
ATATTATGGG TGCCTCATCC ATGTCCCCTT GGCATTTATC TTTCTTGGAT AACCCAACTC TATTAGTTTT
TATATCTCAC TTGTTCCTAT ACTCTGTGAA CTGATGTCCC ATAAATAGAC ATTTCATTTT GCCAGTCTTC
TTGAACAATA ATTACGATTA TTAATCTAGC AGTTATCATT AATTGGCCAC TTCACATTAG ACACAGCACT
TAGGACTTAA GAATACCATG TCATTTGATC ATCATAATAT GGTCAGGAAT TAAGTATTGC TATCCAAATT
TTACAAAGAA GGCACTGAGG GTTAGAGTTT AAATAACTTG CTTAAGATGT CATAGCCTGT AAGTGACAAA
ACTAGGACTC AAATACAGGT CCATCTGACT CCAAAGTCTA TGTTCTTGGC TACCACACTG CCTCTCCTAC
AAGTGACCTG TGGTTTTACT ACTATATTCA CACTCTACTA ACTTTACCAT CTCCCATGAG TCTGTCTAGA
GGAGGGCACA CACAGCACAG AAAACACATG AATGCAAAAT AAGGAAGGGC CTACTTACTA CACAGAGCCA
TTCTAATACC TGATGTTTGC TCTAATCCAG TTTTACTATT AATTAGTTGC TGGTGCCCAA GTTTTACTG
AGAAATGGGG ATAATTTTGG AAGTCATAAT GATGCCTTCT TCTCATAGGG TATTTTATTT GTTGTTGTAT
CTCCAGGCCC CAACACAGCC TGGCTTTTAG TAAATGATCA AAAATACCTG TTGAATGAAT AAATGGAGTC
ACCTGAAACA TGTTAAACAT TTGTTCATGT GTCCTAATCG TGGATTTCAG GATAGTAAGC ATCCTAAAAG
GAAAGCATGC ACACTGTTCT TGCTACATTA ATTTCTCACA ATATAAAAAA AGAAAAGCAT CTGAAAAAAG
CTGCCAGCCG CTGTGTCTCC TAATATCAAA CTGAGCACAG ATATGGAGAA GCTAAGGGAG AGGGATGATG
GGCCATGCCT CTAACCTCAT CATGGCAAAA GTCCTGGGGG TCAGACCCGA GGAGAGCAGG AAGTGTCTTT
```

```
TGAGGGATAC ATTTCCACAG TGGAAATAAT GAGACTTAAA TAAATATTAT ATACACAGTT CAACTGTTTT
TATGTGTAAA GGTAGTAGGT TTTCACAGTA AGGAAGCACT TCTTTTTTTT TTTGTTTGAG ACAGAGTCTC
GCTCTGTCTC CCAGCCTGGA GTACAGTGGT GCTATCTCGG CTCACTGCAA TCTCTGCCTC CTGGATTCAA
GTGATTCTCC TGCCTCAGCC TCCCGAGTAG CTGGGACAAC AGGTGTGTGC CATTACACCT GGCTAATTTT
TGTATTTTTA GCAGAGATGC GGTTTCACCA TGTTGGCCAG GCTGATCTCG AACTCCTGAC CTCAGGTGTT
CTGCCCGCCT CTGCCTCCCA ATGTGCTGGG ATTACAGGCA TGAGCCACTG CACTCACCAA GCACTTCTAC
TGATAGCATT TACAAACCCT TCTTAGAATA TTTAAAAATT CTAAGAGAAG AGTAAATTGA GCCTTCCCAA
CTAATACTAG GAGGTTATAA CCTTCATACC AAAACTGGAC AATGCTTGCA CAAAAGAAGG AAGCCAATGA
GGCCACCTAG AAGGAAGACT GGGCATTGGG CCCAGTGAGT CCTGGAAACC TCATCTGTGC CAGCCACCCC
GGCATGGCCT GTATGAGTGG ATGAGGGTGA CTTGTCCACA GACAATAGCC ATCTAGCTGT GATAAAGGAG
TCAAGGTAGT CAGCTGCATC TCTTTCACCT GTTTGCCAAT GTTACACAGG TTGAAAAGCT AAGGTTTATG
TAAAGCAAGC ATCAAAGATG ATGAAATGAT CAACCTGACA ATGAGTACTA TGCTGCATTG TCCAGAAAGG
AACTGTGGAA GATTTTGGGC TGAATTTCAA AACAGAATTT CCTCACTCTC TGGATGTTGG CTTACTTGGC
CTTTGATGTT CAGAGGTGGT GCCTTTGTGT TGTTGAACAA TGTTGATTTT GGAGAGAAAA CAGAGTTGAA
AAACCCACAA GTCATTCCCT GGGGAGTATT ACCGGAATAC AGAGGATAAT TTCAGCAAGC CAGCAAGGCC
TCATCTCTGC TTCTAATAGA TAGGAAGAAA GGAAGAGAGG AACAATACTT TTTTAAGAAG CTCAGCTTTA
TCGCCTTATC TCATAGAAAG ATGCCTCCAG TCTGTCTGGC TAAAGGTAAT TGGCATGGGA AAGTCTTTAT
CTGTGATTCT AACAAGTGGA ATGTTTCCCT TCATTAAGAG AGCCTTGTCT GGCTTGGGGA AATGAAACAC
TTTCTCCGAT ATGAGTGGGC TGTAACCCCT GCTACTAAAT ACTCAGAAGA AATAAGGCGG TTGTGGAGCA
GTCAGGAATG AGTCACTTGC CTCCCTGGAA TATTCAGAAA ACTGAATCAA AAGTACATTC TTCTGGGTTT
TCTTAGTCTA ATAGACTAAG GGTCTCTACT TTGTTAAATT TCTGGGAAAC AGCATAGAAT GGGAGAAAAA
ACTGGTCACT GTAGTCATGC AAATCTGCAA AACAAACAAA AAAGTCTGGG TATTGCTGCT AACTAGCTAT
GTGACCTTAA GCAAGGTATT AACTCTCTCT GAATTTCAGG TTCTTCATCT GTTAAATAGC ATATCTGTAA
AATGGGAATT ATTTTCATAT CATAATGCTG TAGCTTTAAA AAATAAAATA AAATGGATGA GATAATCAGA
ATTAAAGAGC CTGGGATATA TAGTTAATAT ATAGCAGCAT GTAAAGATCC TGTTAGAAAT GCTAATTTTA
CAGTTAACCA TTTGGAGATG ATCCGCCAAA GCTGCTAGTG TAGAGGCAAC TGAGAATTTG CCTGTCCTTC
AGAATATGAA TAAATAACTG TCAATGATGT CTCAAGCCTA GAAAAACCTA TCCATCTGGA TGGGTGGGAA
ATTTCTAGGC TAGTATTGAG AAGCCCATTT CTTGGGAAAT AGGTCCTGGA CTGAGTGAAG GAAAAGAAAC
AGTAAAACCC ATGGTAAAGC AGCAAGGCTC TCTAGAGGCT CTGGAGAGGA TGAATTGAAT TCTAGAAGAT
GAAGTAGGGA AGACGCTTTA CCTTCTTGTG AAATGGATTC AAAGATTCAA AGACCTTCGG GAATCTCCAA
TTGTATAAAT GGCACCATAG CTGTATGTTC CATGGAACAC TACTTCCCAG AGATGCCCAG TGAAAAAGA
ATGCCACAGT CAAATAAGTT TGGAAACACT CCATTATGTG GCCACCTCCT TGAAGACTCT AATGCACATT
AGCATGTTAA ACAGTCTTGA GAAGTCCTGC AGAGCAGAAA TTGCTTCACA TCTGCTAAGC CGGCAGTTTC
CCAATATACT TGATTATGGA TAGTTTTTTC CTTACAACAC CATTCTCTGA TATGCTTCCA ATGACATGAA
ATAAATATAT ATGCATGAGG TTCTTCATTA GGGCATACTT TTTAATAGAA AATATTGAGA ATAATCTAAA
TATAAATGCA CAGCATTTAC CTTTTCTGCA TAAACTATAT ACAGGCATAC CTTGGAGATA CTATGGGTTT
GGTTCCCACA ATATCTCCAA AACCACATTC GGTTTTATGA CCACTGCCAT AAAACCAGCC ACATGAATTT
TTTGGTTTCC CAATGTATAT CAAAGTTACA TTTTTACTAT ACCATAGTCT ATTATATATA CAATAGCATT
ATATCTAAAA AACAACGTAA ACACCTTAAT TTAAGGCTGT GGCTGGTTTG ATTTTCTACC CAGACCACTA
AAACTTTCTT CATATCAGCA ATAAGGCTGT TTCACTTTCT TACTATTTTT TGTGATAGCA CTTTTCCTTT
```

```
CCTTCAAGAA TTTTTCCTTT CTATTCACAA TTTGTTTGAT ACAAGAGGAC TAGATTTTAG CTTATCTCAG

TTTAAGGTGT TTACATTGTT AGCTAAAAAT GCTAATGATC ATCTGAGACT TCAGCAAGTC ATAATCTTTT

GCTGGTGGAA GGTCTTGCCT CAGTGTTGAT GTCTGCTGAC TGGGTGGCTT TGGCAATTTC TTAAAGTAAG

ACAACAATCA AGTTTGACAT ATCAATTGAC CCTTCCTGTC ATAAATGATT TTTTTTTTCT CTGTAGCCTG

CAATGCTCTT TGATAGCATT TTACCCACAG TAGAATTTTC AAAATTGGAG TCAATCCTTT CAAACTCTGG

TGCTGTTTTA TCAACTAAGT TTATGGAGTA TTAGAAATCC CTTGTTGTCA TTTCAACAAT GTTCACACCA

TCTTCCCCAG GAGTATATTC TACCTCAAGA AACCACTTTC TTTGCTCATC TATAAGAAGC AGCTCCTCAT

CCACTAAAGT TTTATCCTGA GATTGCAACA ATTCAGTTAC ATCTTCAGGC TCTACTTCTA ATTCTAGTTC

TCTTGCTGTT TCTATCTCAT TTGTGCTTAC TTTCTCCGCT GAAGTCTTGA ACCCCTTAAA GTCACTCATG

AGGGTTGGAA TCAACTTCTT ACAAACTCCT GTTGATGTTG ATATTTTGAC CTGCTCCCAT GATTCATGGG

TATTCTTAAT GGCATCTAGA ATGGTGAACG TTTTCAGAAG GTTTTCAGTT GGCTTTGCCC GGATCCATCA

GACGAATCCC TATCTATGGA AGCTATAGAT TTATAAAATG TATTTCTTTT TTTGTGGGGG CATAGCGTCT

CACCCTGTCA CCCAACCTGG AATGCAGTGG CACAGTCATA ACTCACTGAA GACTCAAACT CCTGGGCTCA

AGTGATTCTT CCACCTTGGC CTCCCAAAAC ACTGGATTAC AAGCTTGAGC CACTGTGTCT AGCCCAAAAT

GTATATCATA ACTAATGAGG CTTGAAAGTC AAAGTGACTC CTTGATCCAT GGGCTACAGA ATGGACGCTG

GGTTACCAGA CATGAAAACA ATACTCATCT CCTCATACAT CTCCTTCAGA GCTCCTGGGT GAGCAGGCCC

ATTGTCAAAT GAGCAGTAGT ATCTTGAAAG AAATTTTTTT TCTGAGCAGT AGATCTCCAC AGTGGACTTA

AAATAGTCAG TAAACTATGC TGTAAACAGA AGTGCTGTCA TCCAAGCTCT GTTTTTCCAC TGATAGGGCA

AAAGCAGAGT AGATTTGGCA TAATTCTCTA GGGCCTTAGG ATTTTTGGAA TGGCAAATTG AGCATTGGCT

TCAACTTTTT TTTTTTTTTT TTTTTTGAG ACAGAGTCTT GGTCTGTCAC CCAGGCTGGA GTGCAGTGGT

GCAATCTCGG CCCACTGCAA GCTCTGCCTC CTAGGTTCAC ACCATTCTCC TGCCTCTGCC TCCTGAGTAG

CTGGGACTAC AGGCACCCGC CACCATGCCC GGCTAATTTT TTGTATTTTA GTACAGACGG GGTTTCGCCA

TGTTAGCCAG GATGGTCTCG ATCTCCTGAC CTCGTGATCC ACCCGCCTCG GCCTCCCAAA GTGCTGGGAT

TACAGGCGTG AGCCACAGCG CCCAGCCTGT CTTCAACTTA AAGTCGCCAG CTGTGTTAGC CTCTAATAAG

AGAGTCTGCC TGTCCTTTCA AGCTTTGAAG CCAGGCATCA TTCTCTTCTC TAGCTATGAA AATCTTAGAT

AGCATCTTCT CCCAATAGGA AGCCATTTTT TATGCCCTAA AAATCTGTCG TTTGGTGTAG CCACCTTCAT

CATTGATCTT ACCTAGATCC GCTGGATAAC TTACCACAGT GTCTACATCA TTACTTCTGC TTCACCTTGC

ACTTTTATGT TATGGGGATG GCTCCTTTCC TCTAACCTCA TAAACTAACC TCCACTAGCC TCACATTCTT

CTTTTACAGC TTCCTCGCCT CTCTCAGAGT TCACAGAATT GAAGAATGTT GGGCCTTGGA TTACACTTTG

GTTTAAGGGA ATGCTGTGGC TGGTTTGATT TTCTATCCAG AACACTAAAA CTTTCTTCAT ATCAGCAATA

AGACTGTTTC ACTTTCTTAC TATTTTTTGT GATAGCACTT TTCCTTTCCT TCAAGAATTT TTCCTTTCTA

TTCACAATTT GACCGTTTGA TATGAGAGGC CTAGATTTTA GCCAATCTCA GTTTACACCA TGCCTTTTTC

ACTAAGCTTC ATCATTTTAG CTTTTTATTT AAAGTAAGAT GTGTGACCCT TCCTTTCATT TGAACACTTA

CATGATGATG CCTGGCTTCA AAGCTTGAAA GGACAGGCAG ACTCTCTTAT TAGGGGCTAA CACAGCTGGC

GACTTTTAAG TTGAAGCCAA TGCTCAATTT GCCATTAGAA GCCATTGTAG GGTTAATTAA TTTGCCTAAT

TTTAATATTA TGGTGTCTCA GGGAATAAGG AGGCCTGAGT AGAGGGAGGG AGATGGGGAA ACAGCCAGTC

ATCAGAGCAC ACACAACATT TATCAATTAA GTTTATCACC TTGAGGGCAC AGGTCATGAT ACTTCAAAAC

AATTACAATA ATAAAATAAA AAATCATTGA TCGCAGATCA CCATAACAGA TATAATGATA ATGAAAAATT

TGAAGTATTG TGAGAATTAC CAAAACGTGA CACACAGACA CAAAGTGAGC ACATGTCATT GGAAAAGTGG
```

```
TGCTGATAGA CTTACTTCAT GCAGGGTTGC CACAAATACT CAATCTGTAA AAAATTCAAT TATCTACATA
GTACCATAAA AACAAGGTAT ACCTGTTTAT ATAATCAAGA CCAACAGAAC CCTAGAGAAA ATAGCTCACT
CCCTAGCTCG GAGACATTCT AACCAACATA CACTTACCTT TCTTTTTGCT GTGTACAGAA TTCAAATCCC
TGTCTCAGCA AAATTGCAAA GTATCAAATG TCATGTCCAT CTAATACTCA AAACTGCAAA TGTTAAGTCT
TGTAAGCCCA GAGACCACTG TATATACAAG TGTTGCTATA AGCATTAGTT CTTCTCCAAA GAAAATAGTC
CACTTGGTAG AAACAAACAA AAAGAAAAAA AAAGAAAGAA AAAACATTTT TTACAAGAAG ATTCAGTCTC
TTACCTACAT AAGCAAAAAT ATGAGATGTT CTCTTATCAT TTTTCCATCT ATCTTATAAT CTTTGGTGCT
GACTTAGACA CTCATTTTCC TTTTTGTACG TGACCATGTA AAAGTTCAAG TCAAGAAAAA CTTGTTTTGA
CATTTGTTTT GCTGAGTGAT GGGTCCCTAA AAGAAATTTG GCTTTGCTTT TGAAAAGTTC AGCATGATAT
TGTGTGAATT TTTCATGGCT AATGATTTTT AGAACAGTTG TGATGTGTTT AGGTGTTTTA AGAATATGAA
GCATTCAGTG GTTTAAGTTG GTTGTTATAA AATGAAAGAA TATGAAGGAA AGCCTTCTTG TCTTAGAACA
CACTGATTCA CAAATAAGCA GCTTCTCTCA AATGTTGTA ATTACAAAAA TTCCAAGGCA AATATAATAA
ACTCCTTGTC GGTGCTATGT CTAGAAACTT AACAGCCCCA AGAAAGTCC TGACAAGGCA AAAATATAT
ATATATATAC AAATTGTGGA AGCAGGGTGT TGAAAGAAGA ATAAGACTA TATAAGGACA AACTGTTTAA
AAGGGAGGGT ATCCTTGAAA GCTTGACACT TGACTCTTTT GACGAGGCTG AGGGAAAACA CTCAGTTTCA
TAGATTGCTG GTACGGATGT AAAATAGTGA CATCCCTATA GAGAGGAATT TGGCAATATC TAGCAAAAGT
GCTTATGCAT TTATTCTTTG ACCTAGTAAT CCCGCTTCTA GGATTAGTGG TGAAGATACA CCTCAACAAT
AAAAATATAT ATACATTAGG TTATTAGTTA TGGTTTAATT TTTAATAGCA AAATATTTAA AACAACCTAC
ATGAACAAAT AGGAGACTTA CTGAATAAAC TATGGTATAT CTGTACAATA AAGTGCAATT CACTTATGTT
GTTAATTTGT TCCAAAAATC CAGAGCCAAA GAGTATTTGT TATGCTCTCT TTAGTATAAG AAAGGGGAAA
TAAGATATGT GTGCATCTGT TTATTTTTGT GAAAATAAGT ACAGAAAGGA TAAGTAAGAA ACTAGTAAAA
CTAGTTATCT CCTAGTGTTA GTAGAAATAG AATGAAAGTG AATTAGGCTT CTTTGAGTAT ATGTTTATAT
ATAGTTTTGA CTTGTGAATT ATGTTTATGT TTACATAGTC AAAAATATAA ATTAATCAAC AGAAATAACA
AAAAAGAAG AAATCACAAG CTTTAAAATT TAATACAAAC AGAAATAATT GAATCTAACA GTATATCAAA
GTGATAACGT AAACTCAGAA GAAAAAAACA TAATCCAACA TACCAGTGGA ACACAATATT CTAACTGTAT
ACATTCAGTG GTTATAGTCT AAGGACAAGA AAAATTGCAA AAATATCTTG AACTTTAGCT TGTAGGATTT
TTATTGGTAG CAATACTAAT GTACTAATTC TGAAATTAAT GTTCGTGTAT TATAGAATTG AGTAAATGAA
TAAATATGTT GATGTTATTG GAACTAAAA TTATCATTCT GGGAGTAGAG AAATATAAAT ATGGACTTGG
CAAATGAAAC AAAGACCTGC AGAGAGATAA CCATATAAAC TCATTATTTT AAAAATTATA AGTGTCCTAG
CTCTGTTACT GAAAAGGCCT AGATTCAATC TTATCTTGAT AGACAGGAGG GCACCCCTTT CTCAGAACAT
GGTTTCCAAA TGCCATTCTC CATTAAAAGG AACAAGGTCT TCTTGGAGAA AAGACTGATT CTAGGTCTGG
ATTAGGTAAA GTACAACGTT AGTCTGGAAT TTCTTGCTGA ATCAGAAGTA AGAAAGTGCT CAAAAACATG
GGAACATGTC ACAAACACAC GTGAGGCAAC TTGAATCCTC ACTGGCCATA TTTAGGACAA TCGAGCATCA
AAAAAAAAA AAATGTTGAG AATAATGGAT TCTAACACTT AAAACAAAAA ATAATCCATA GCCCACAGAA
GGGGAAGAGA GGGGGAGCTC TTATTTACAG ATGAATATCA AATAGCAAAG ACAGAAGAAA TGACAGAATT
AGAGAAACAT CATTTTGCAA AACACCACTG TAATAATCAA TTCAGGCAAG TATTATTAAT GGATGTATTA
CTATTGCGTA AAACCAGTTG GGGAACAGGA TATTCATACA GTCTGAAGGT GTCACCCTAA ACATAACTTA
TTACAAGTGG AAAATGGTGC CTTTACAATG AAGAAATCTA GCAGAAACCA TCTTAATCTA GTGATCAAAC
TTAGTATCAC CAATAATGGA TCATACTGAG TCATGTGTCT CCTAATATGA TGCACCAGGA AGGATGCAAC
GTCATGAACG TTGTATTCTT TTGTATTCAA CAGACCACCC AGGGTAAAGG CAGCTTTCTC ACTTACTAAT
```

```
CAGAATTGTT GGTTTTAATT CATTTTGGAT TTTAAGATTT CTTACTTTCT TGTCAGCTCA GAAATTTATT

TAAGATGATT TTTATCTTTT ATTCAATACT TTAGCTTGGA GAACCATTCA GAGTTTCTAA CTCATTGTAT

TGCCAAAAAT AGAAAACAGC ATGGTTTCTT TTGAAAATGT CTAACTTTAA AGTTACTTGT GTGTGTCACT

CAGATTCACA TAGCTTTTTT GCCTAGTAAT GTAGTATCAT GTGGCAAGGC TATAAAAATG TTTACAATCT

TTTATTTAAT ATGACTCTTG AGAGTTTATT CTAAGGAAAT AATTGAATAG TAACAAAACA CTATTAACAC

AAAGCATAGC AATTTGATTT GGGCAACCAA ACACTGGAAA CAACCTAAAT GTCCATTACA GGAATCATTT

ATGAAGCAAA CACTAAAATA TTTATTGTGA AGATTATGAG AACATAGAAG ACAGTTATGA GAGTAAATTT

GAAAACCTGA ACACAAAACT TACATATACT CCAATTGTAA CTTATAAAAA ATACGTGCAT ATAAGGATAA

AACAGTACAA ACAAAAAAAT AGTTGCGTTA GATTGGTAGA ATTATGGCTC CTTTTGCTGT CTTAATTTTT

TCCTTTTACA TTTTGATACA TTATTTTAAT TTTAATTTTA AAATTCAAAA GAATTTGCCA CTCATCTTTG

CCACTTCAAG GAAAAAGAA ATGTGTTCGA TTATTCTGTT CTTAGTATAG TTTTGGCAAT TTCCTCACGT

GTAAAAAGAG AATACTATTA ATAATTTCAG TATCTATAAG ACAATATAAA ATTAAAGAAT CTAGCCCAGT

AACTGGTACA TGGAACGTAA TTAATAAATC ATTATGGACT TTTTTTCTCA CACCCAAGTA GGGAGGAATC

AGTGGTCCCC TAGAGGCCCA GTGTAGAGGT GGCAGCACCA ATCCCTAGGG GAGAAGATCT TGGTGATGAT

AATTCCTGAG CAGACAGTTA GCTGAGAATT CAAGAGCAGA AAAGTAAGAA AGAAACAACT TCTTGCTAAC

ACCTTTCCAC CCACGTTTCC CTGTTCTGTT GTACTCTGCT TACCCTTTCA TGGATGGAGG CAGAGGAAAG

AGAACCAAGT TTGCTCTTAG TCATTCACTA TGTTGTTTAA TCTGCCTTCC ATCTTTCTTA TCAGTTCAAA

TTAGAATGTA GACCTGAATT TAAATCCCCG TTCTGTCAGT TATAATGTGA CCCTAGACAA AACACATTCT

CTGAACCTCA GAGAACATTC TTCATTTGTA GAATGGGAAG ATTAATCTAT ATTCCACTTG GATGGCAAGT

CTTTTATAAA CTTTATAACC TAAACATGTG TGAGTTGCTA GTATCATTAT GTTGGTAAAG TTATTCTGAG

ATATGATAAC AGAACTGTTT TGTCTAACTC CACTAGCATG GTTCAGGTTT AGAGAGTGTG GAATTAAAAG

GCTTTATCCT CAAATATGAC TTAAATCCGA TTTTTCTCAT CCACTTTCCT CCACAAACAA ATCCTCAGGA

AATGACAAAC TTTACATGGT TAAACATCAG TTTTGTTTAG TCTTTGACAT CCACATGGTT AAATCATACA

TTTGAAAACT GCTTATATTT GTGTTGTCTA TGTCTAAATT GAAAAGACTT ATTGAGGAAT AGAAGACTAC

ACATTTTTCA GCAAACACTG CACGTTTTGC AGAATTTCCC CAGGCACCAG TCTCCAGGAA TTTATTGGCT

ACTAACAATA CTAAGATATG GATGAATGAG GAAATCAAAA TGGAGATCTT GCAAGTTTTG TGAATGGG

TGAATGGTCC AAATGAAGAG ATAAGTTGTG AAATATTAGT ACAAGTAAAA ATTATTTACA ATGAAAGACA

TTTTGTCAAT AGCTATGAGA ATTTTACCAT TGACCCAGAA ATTCCATTTC TTTCTTCAGA AATACCCACG

TAGGTATACA TATAAAAAGT TATTCATTAC AGTATCGTTT TTCATAGGAA AAAGTTTTAA AAATCAGAAG

CTATCTAAAC TATGGTATAT CTAGGTCATA GAAATCAAAT GACTAAAAAT GTTAATATAA GCATATGTTT

TTAAATTAAC TTGGCTTGGG TCTTCAGCAA AATTGGCTTC TTAACATTGC ACTCCAGACT TAGACTTACC

CACTCAGTCA CTTATCATGC AGGAGCAGAC TCCTAATACC ACATATCATA GAGCAGAGTA GGACACAGGT

TCTCTGCAGG CAGGCAAATC CCAAAGAGAA GGGAGGAAAG GGCTGAGACA CTGCATGGTC AATTTCTTCT

GAACTCTGCA ATGTACGGAG GTGGACAGTG TCCACAAAGA TTGCTCCCCT GGACCCACCA TCATAATAAC

ACAACGGCTT TGTTTTGTTT TTGTTTTTGT TTTTGACAC GGAGTTTTGC TCTTGTTGTC CAGGCTGGAG

TGCAATGGTG TGATCTCGAC TCACCACAAC CTCCACTTCC TGGGTTCAAG TGATTCTCCT GCCTCAGCCT

CCTGAGTGGA TGGGATTACA GGCATGCACC ACCATGCCCA GCTAATTTTG TATTTTTAGT AGAGACGAGG

TTTCTCCACG TTGGCCAGGC TGGTCTCAAA CTCTTAACCT CAGGTGATCC ACCCGTCTTG GCCTCCCAAA

GTGCTGCGAT TACAGGTGTG AGCCACCGCG CCCAGCCCAC AATGGCCTTT TGTTTACATC TCTAGTGCAG
```

-continued

```
CACTCATTTC ATGTTCTTTC AAGAAGAATA CATATTTCAT CTTTTTATTT TATACAGCAA TTAGCACAGT

GCCTGGCATA AGGAAAATGA TCATTAAAAG CTGGGTGAAA AACCTAATAA AGCTACTGAG GATAGGAACT

GCAGACCAGC ATGGAAAGAA AACTATGAGC CAGATATTGA CATCATCCTG AAAGGCAGAA GATTTAGTAT

AGGCAAGAAG TATGCTTTTG GAATATAGAA AATCTGGATT ATGATAAGAA AAGAATCATA TTTGTCTTAT

CTTACCTACT CACTTCTCAG TTCCACATGT TTCTGAGGCT GTTTGTCCTT ACTTTCTTTT CTGTTTTATC

CACTCTTTCT GTTCTTTAGA TTGGATCATT CCTATTGAGC TGACATCAAG TTAACTGACC TTTTATTTTG

TCCAAACTGC TGTTAAATGC ATCCAGTGAA TTTTTAACTT TATATAGTAT ATCTTTTAGT CCTAGAATTT

CCACATGAGT TTTTTAAGTT TCCATTTCTC TGCTGAGATC TCCTATTTGT TCATTCATTA TGACCATATT

TTTCTCTACA TTATTGAGCA TAATTATAAC AGCTCTTCTA AAATTCTTGT CTGCACATTC TAACACCTGA

ATTATTCTGG GGTCAGTCTC TGTTACATTG CCTTATTACA AAAACAGTAT AAGTCACATT GCCTTGTTTC

TTAATATGCA AAATGATTTT TGATTGCAGA CTAGACATTT TGAATTAAAC ATTATAGAGA TTCTGGATTC

TCGAGAGAGT ATTGACTTGT TTTTTCCATC AGGCAGGTAA CTTGACTGGA CTCAAACTCC AAACTCTAGG

TCCTCTGTAA TGGGCAACTG CAGTAATCTT TGTTTAGTTC TTTAAGACTT ATTGGCCAGG CACGGGGCT

CATGCCTGCA ATCCCAGCAC TGTGGGAGGC CAAGGTGGGA GGATCACCTG AGGTCAGGAG TTCGAGACCA

GCCTGGCCCA CATGGTGAAA CCCTGCCTCT ACTAAAAATA CAAAAATTAG CCGGGTGTGG TGGTGGGCGC

CTGTAGTCCC AGCTACTCAG AAGGCTAAGG CAGAAGAATC ACTTGAACCT GGAAGGCAGA GGTTGCAGTG

AGCCGAGATT GTGCCACTAT ACTCCAGCCT GGGTGACAAA AGCGAGACTC CCTCTCAAAA AAAAATTTAT

TGGCACTGCT TGGCATCTGC TATGAATACA TGAAGTTCAT GGGTCAGCTA TAGATCTGGG CACGTTATAC

ACAGAATTTG GGTCTCCCTT TCTCTGGATT TCTCCTTTTC TGGATTTCTT TTCTCATTTT CCAGCAGCTG

TGGTTGCCCT AAACTCGGTC CTCTGTTTCT TTACGGCAGT AAGATTTGGG AACTTTTAGG TTTTACCTGC

CTCTCAGACA AAATAAAAAA TAATTTTCAT CTTGATGCTA CTCCTTTCTT CCAGATGTAG ACACCTCTCT

AATTTCCAGT TGCTTTTTAT TGCTCTCCAG AGTCTAAAGA TTATCATTGT TTTCTGTGGG AGAGTTGGTC

TGATAAAAAC TACTCCCCCA AAACTGGAAG CTGGAAGCTT GTAATTATGA ATAGACTTTG AGTAGTATTC

TTCTTTGGAA AAGGATTTTA ACTACTCCCT ATGTACTTCT TTATTTCCTG TTTTTCTCAT CCGTAATCTT

TTTATTTTCA TACTTCCTAA GTCAGACAAT TTTCCTACTT GAAGATTCAG TGACTGCTAT CAAATGACCC

CCATATTACT AAATACAATA TCCCCAACTG CATTTATAAA AAGAAAATTT ACTGTTTATT AGTAAACAAT

GTTGTAGAAT AGTAAAATAT TGCTGGGCTT TGGAGCCAGA TAATCAAGGT TAGAATCCCA GATTCTAACT

TACTAGCTGG TGTATTAGTC CTTTCTCATG CTGCTAATAA AGACATACCC CAGACTGGGA GACTGGGTAA

TTTATGAAGA AAAGAGGTTT AATTGACTCA CAGTTCAGCA TGGCTGGGGA GGCCTTAGGA AACTTACAGT

CATGGTGGCA GCAAGGAGAA GTTCCAAGCA AAGAGGGAAA AGCCCCTTAT AAAACCATCT GATCTTATGA

GAACTCACTC ACTATCACGA GAACAGCATG AGGGTAACTG CCCTCACGTT TAATTACCTT CCACCAGTTC

CCCCCCATGA CACATGGGGA TTATGAAAGC TATAATTCAA GATGAGATTT GGGTGGAGAA ATAGCCAAAC

CATATAATTC CACCCCTGGC CCCTCTCAAA TCTCATGTCC TCACATTTCA AAACTCAATC ATGCCCTCCC

AACTGTCCCC CAAGGTCTTA ACTCATTCCA GCATTAAGTC AAAAATCCAA GTTCAAAGTC TCATCTGAGA

CAAGGCAAGT CCCTTCTGCC TATGAGCCTA TAAAATCAAA AGCATGTTAG TTACTTCCTA GATACAGTGG

GGGTACAGGC GTTGGGTAAA TACACTGATT CCAAATGGGA GAAATTGCCA AACAAAAGA GTTACAGACC

CCATGCAAGT CCAAAACCCA ATAGGGCAGT CATTAACATT AAAGTTCCAA AATGATCTCC TTTGACTTCA

TGTCTCACAT CCAGGTCACA CTGATGCAAG AGGTGGGCTT CCAATGGCCT TGGGCAGCTC TGCCCCTGTG

GCTTTGCAGG GTATAGCCTG CTTCCTGTTT GCTTTTTCAC AGGCTGACAT TGAGTGTCTG TGGCTTTTCC

ATGAGTATGG TGCAAGCTGT TGGTGGATTT ACCATTCTGG GGTCTGGGCC AGGTGCAGTG GCTCATGCCT
```

```
GTAATCCCAG CACTTTGGGA GGCTGAGGTG GGGGATCACA AGGTCAGGAG ATCGAGACCA TCCTGGCTAA

CACGGTAAAA CCCAGTCTCT GCTTAAAAAA TACAAAAAAT TAGCCAGGCG TGGTGGTGGG TGCCTGTAGT

CCCAGATACT TGGGAGGCTG AGGCAGGAGA ATGGCGTGAA CCCAGGAGGT GGAGCTTGCA GCGAGCTGAG

ATTGTGCCAC TGCACTCCAG CCTGGGCGAC AGAGCAAGAC TCCATCAAAA AAAAAAACAA AAAAACCATT

CTGGGGTCTG GAGAATGGTA GCCCTTACAG CACCACCAGG CAGTGCCCCA GTGGGGACTC TGTGTGGGGG

CTCTGACCCC ACATTTCCCT TCTGCACGGC CCTAGTAGAG GTTCTCCATG AGGGTTCTAC CCCTGCAGCA

AACTTCTGCC TGGACATCCA GGCATTTCCA TACATCCTCG GAAATCTAAG CCGCGGAGGT TCCCAAACTT

CAATTCTTGA CTCCTGTGCA CCCACAGGCT CAATACCACA TGTAAGCCAC CAATGCTTGG TCAGGGCTTG

AACCCTCTGA AGCAATGGCC TGAGCTGTAC GTTGACACCT TTTAGCCTAG ACATCTAGGA CACAGGGCAC

CATGACCCGA AGCTTCATAA AGTGGGAGGG CCTTGGGACT AGCTGAGGAA ACCATTTTTC CATCCTAGGC

CTCCAGGCCT GTGATGGGAA GGGCAGCCAT GAAGGTGCCT GACATGCCCT GGAGACGTTT TCCCCATTGT

CTTGGTAACT AACATTCAGC TCCGTGTGCA GCACCAACTT ACTTATGCAA ATTTCTGTCA CTGGTTTGAA

TTTCTCCCCA GAAACAGGA TTTTTCTTTT CTATTGCATC ATCATGCTGC AAATTTTCAA ACTTTTATGC

TATGCTTCCT GTTGAAGACT TTGCGGCTTA GAAATTTCTT CCCCCAGATA CCCAAAATTA TCTCTCTCAA

GTTCAAAGTT CCACAGATAT CTAGGGGACA AAATGTTGCC AGTCTCTTTG CATAGCAAGA GTGACCTTTA

CTCCAGTTCC CAACAAGTTT CTCATCTCCA TATGAGACCA TCTCAGCTTG GACTTAGTTG TCCATGTTAC

TATCAACATT TTGGTCAAAG CCATTCAACA AGTCTCTATG AAGTTTCAAA CTTCCCCATG TTTTCCTGTC

TTCTAATAGC CCTCCAAATT TTTCCAACCT CTGTCTGTTA CCCAGTTCTA AAGTCACTTC TACATTTTTG

GGTATCTTTA CAGCAGTGGC ACTCCCCATG GTACTAATTT ACTGTATTAG TCTGTTCTCA TGCTGCTAAT

AAAGACTTAC TCGAGACTGG GTAATTTATA AAGAACAGAG GTTCAACTGG CTCACAGTTC AGCATGGCTG

GGAGGCCTCA GGAAACTTAC AAACATGGTG GCAGCAAAGA GAAGTTCCAA GCAAAGAGGG AAAAGCCCCT

TATAAAACCA TCAGATCTTG TGAGAATTCA CTATCATGAA AATAGCATGA GGGTAACTGC CCCCATGATT

AATTTACCTC CCACAGGGTC CCTCCCATGA CAGGTGGGGA TTATGGGAAC TACAATTCAA GATGAGATTT

GGGTGGGGAC ACAGCCATAC CATGCCAGCT AGAGAGCCTT AAGAAAGTCA CCTAATCTCC ACAAATAAAA

GGTTTCCTAT TTGTTCAACA AAAATAATGA CACCCCTTTT ATGGGATTTC TGTGAGGACA AATGATAACT

AACATAGCCT TGCATAGTGT CTGGCACAAA ATAGCTACTC AAAAAATAAT AGAAACAACA TTTAAAAAAT

GTAGACTTTA TTTTTTAGAG TTTTATGTAC AAAGCAAAAT TGAGCAGAAT GTACAGAGAG TTTCCGTATA

GCACTCCCTA CCCCCAAGCA CAGATAGCCT CCCCCAGTAT CAGCATCCCG CACCAGAGTG GTACATTTAT

TATAACTGAT GAATCTATAT TGACGTGTCA TTTTCATCCA AAATCCATAG TTTATATTAG GGATGCCTCT

TGGTGTTGTA CCTTCTATGG GTTTTGACAA ATGTATAATG ACATGTATTC ACCATTACAG TATCATAAAG

AATAGTTTCA CTGTCCTAAA AATCTTTGAT CTTCTTCCTA TTCATCACTC CCTCCCCATT AATCCCTGAC

AACTACTGCT AATTTTCCTG TCTCCATTGT TTTGTCTTTT CCTGAATGTC ATATAGTTTA AATATACAGT

ATGTAGGATT TTCAAACTGG TTTATTTCAC TTAGTAATAT GCATTTGATG TTCTTCCATA TCTTTTCAAA

GCTTCATAGT TCAATATTTA TAGAATTGAA TAATATTCCA TTGTCTGGAT GTACTACAGT TTATGTATTC

ATTCACCTAT CAAAGAACAC CTTGGTTGCT TCCAAGTTTC AACAATCATG AGTAAAGCTG CTATAAACAT

CTATGTACAT GTTTTTTTGT GAATTGAACA TTTTCAGCTT TTTTAGCTCC ATTCCTAGGA GTGCAATTGC

TGGATTGTAT GATAAGGGTA TGTTTAGTGT TGTAAGAAAC TGCCACGCTC TTCCTAACTG GATGTACTGT

TTTGCATTCT CACCAGCAAT GAAAGAGTTC CTGTTGCTCC ACATACTCAC CAGCATTTGG TGTCGTCAAT

GTTTTGAGCA ATAGCATTTT GATCTAACTT TTCCTAGGTA TTCTTTTTGA AGGAAATAAT ATGACAGATA
```

```
ATAGAGAAAG GATATACGAG GACAGTTCTG TCCTTTATTT ATAGTCCATC ATTTAATGAA GGACTCTGTC
CACACTTGGT ATTTTTAACT CTGATCCTCC TCTCCCATGA ACTCTGACAA TCTCCTAAAT CCCTGTTGCT
GGCACACATG GTTGTGTATC AGGCCCCCTG TGGTCTGTCT GAAGCATGGC TTTTTTTTTT TTTTTTTTTT
TTTTTTTGAG ACGGAGTCTC GCTCTGTCGC CCAGGCTGGA GTGCAGTGGC GCGATCTCGG CTCACTGCAA
GCTCCGCCTC CCGGGTTCAC GCCATTCTCC TGCCTCAGCC TCCCGAGTAG CTGGGACTAC AGGCGCCCGC
CACCACGCCT GGCTAATTTT TTGTATTTTT AGTAGAGGCG GGGTTTCACT GTGTTAGCCA GGATGGTCTC
GATCTCCTGA CCTTGTGATC CGCCCGCCTC TGCCTCCCAA AGTGCTGGGA TTACAGGCGT GAGCCACCGC
GCCCGGCCTT TTTTTTTTTT TTTTTTTTTT TTTGAGATGG AGTCTGTCAC TCTGTCACCC AGGCTGGTGC
AGTGATGCAA TCTTGGCTCA CTACAACCTC CATCTTTCAG GTTCAAGTGA TTCTGCCACC TCAGCCTCCC
AAGTACCTGG GATTACAGGT GCCCGCCACC ACACCCAGCT ATTTTTTTGT ATTTTTAGTA GAGACGTAGT
TTCACCATGT TGGCCAGGCT GGTCTCATTC CTGACCTTGA GTGATCCACC TGCCTTGGCC TCCCAAAGTG
CTGGGATTAC AGGCATGGGT CATCACATGT GGCCTGAAGC ATGACTGTTG CTTTAATCAT ATGAAATACT
GCTCTGTATT GTTATCTATT TGAAATGCCA CACCTCCTGA GCTAAATTGC AAGCTTTTAT GGAGCACAAA
CCATATTTAT ATATATTAGC ATGATACCAT GACACATATC AAAAGCTGTT ATATATTGTT ACGTGAATTG
ATTCTTTCTC AGTTAAGAGG ACCTCTGTAG TAGCACTTTC ATACCGTTAA TTTTTCATTT TGTGCCCAGC
CCCTACTCTG TGAAAAATGA AATGAATCCT GTTATCATTT CCCTCCCAGG CCTTTTCTCC TTGTGGACAA
TGTGTGGCTC AAGAGAAAAT TCAGTCAGTA AATTTGTTCA GTGCACAAAC TCTTTATCAC CTCTCACTGT
TCTCAAGTGA GATAGAACAG AACATCCATC CAGTGTCTTA CAAATTGTCT GGTATATAGT AGGCACTCAA
TAAATGTTTT TTGAATAAAT GCATACATGA ATCCTATTCC TATATATAGT ATGGTAGACA GATCATTGAT
ACCCAAAGAT GCCCAAATGC TGATCCCCAG AACTTGTGAA TATGTTACAT TTCATGTCAA AAGGGACTTT
GCTAATGTGA TTAAGGATTC AGACCCTTGG ATTGTAAGAT TATCCCGGAT TAACCAGGGC CAATCTAATC
ACATGAGACC TTAAAAAAGC AGAAAACATT TCCCAGCTGG GTTAGAGAGA GATGAGACAG AGTAAAAAGG
AAAGAGATTC AGGGCATGAA AATGACTCTA CCCACTGTTG CTGGCTTTGA AGATAGAGGA ACTAGGCCAC
AAAACAAGGA GTATGAGTGG CCTTAAGAAA TAGGAAAAAG CCCTCATCTG ACAGCCAGCT AGAAAGCAGT
CCTCTGACCA CAAGAAATTG GATTCTGCCA ACCACTCAAA TGAGCAAGGA AATGGATTCT CCCCTAGAAC
CTCCAGAAAG GAACACAGCT CTGTAATGCC TTGATTTTAG CCAGGTGAGA CCTGTTTCAG ACTTTTGACC
TATGGAAATA TAAGATAATA AAGTTTTATT GTATGCTGCT AAATTTGCGG TAGTTTATTA CTGAAGCAAT
GGAAAGCCAA TACAGACAGA ATATACGAGA GAAAGAGAA TGAGTTCTTT CCTGATAATT TGTAAATATT
TGGGTCTTCA CTGGACAAGC TTCACAGAGG ATTCACTGGT TCCCTAGCAA ACCAGCATGT CCAGTCCTGC
AGCCTCCCTT TCTTAGGCCC AGCATATGTC AGCTGTGTGC ATAGAAAAAT CAAAGCAGGA CCCTGAGTAG
TTGGAAAGAA AAGATGGTTG GAAATGGTTG GCACTTCAAG TGAGGAAACA AGAGGTAGGA GACCGGCATC
TCTTTCTCAT ATGTCCCAGG CTGACTCTTG TGAGTTGTTT TCCCTTGGAG GCTATCGATG ACAGTCACAG
TAACCTGATG GAACCTGGAT CATGATGAAA GAAGTAAGTG TCAATGGCTC CGACTTCCAA GGACTCTGAT
GTCCCACAGC ACTAGCTAAA CAAAGCCAGT TGGAAATGAG CTTAAATGGG GAATTTCCTG AATATATTCC
CTATTGTTAG GAAGCCAGGT TGGCTTCCTT GCCTACAATT ATGCCAAGCA GTCACACTAT AGAGTCCCTA
GGGACATGAT ATTAAGTGAT TCTTTTAACA CAAACAACTT AATAATCATT TATACTAATA GCAAAACGGC
CAACGGCTGA TATTCCACTT GAAGTAGAAT TGGCTATCCA ACTGGAAGAG AAGACAGGAA GACGTGATCT
CCAGGGAGCC ACTAAAAGGA TGGGCACCTG CCTCTGGATT CCCCTTTTCC TTATATTACC TCTCAGCACT
GGCAGGCCTT TATTTCAGGA TACAGTTTCA CAAGTATTAT GTCACGTCTC TGAGAATTAT GTTGGTAGAT
ATTTGCTCCT CTGGCCAGAA AGACCTAGTT TGGAGTCTGG AGTCATGAAG GTGACATACA GTAGCTAGT
```

```
GACATAAGTG TAGCTAGTAA AAATAGTGAG TAATGGCCCT GAAATTCTAT TGAATGCCCA AAGTGCTGAC

CAGGAACAAG CATGCTCTAG CTTATCTCAC AAGGAACTTG ACAATTTTCT TCAAAAATCC TAGTAGCTAA

GATTTCTTAG TAACAAAGCC ACTAAGGCAC AATTATGATT AACTTGACCC TTAGGTGACT TTTAAGGACT

ATTCTATAAA ATATTACAAC TAATAGTGGA TCCAAGCCAG CACACTCTGC TATATAAGAT TAATTGACAG

TGTCCACACT GGTAAAATAA GTTGTTTCAT AAATACATTA GAATTCATTT GCACTTTCTA CACAGCCCCA

AGTCCAGAAC TTTCCCCAGA ATAGGTCTAT GTTTTGCAAT CTGCTACTCC ATACAGAGAT TTGAGTTCAC

TTGGCAATTT AGTGCTGCTT ATATGTGACC AGTTAGTCTG TTTTACTTAT CTATGCCTTA AACATTACTA

TACTTACTAA CTCCAAGATG CCTGGTCTCA ACTTGACAAA ATACCCCAA GTTGGGAAAT CCTTATGTGA

ATATGTAGAT AGTCACAATT GCTGGTTGAT GATGATCTGT CTTTTCCTGT ATTTGAGAAA ATGGAGATAA

AATGGACCAA TCCAAATAAT GGATTAAACA TGGGAATAGG TGAGAGAGAG AGAGGAATAC ATGGTGGCTC

TCAGTGTCTG GCTTAGGCAG TAAACACTTT CGTTAATAAA GACGGAAAAT AAAAAAGGAA TAATTGGTGT

CTAGGGGAAA ATAATGAGCT CAAGTTTTAA CACTCTGAGT TCCCGGATGT GAGACATCCA GGCGCATTTA

TCCAAGAGGC AGTTGGAAGC AACGTTCCGG AGCTTAGGAG AGAGGCATGA CCAAAAGCTG GTGGGACTGT

GAAAAGGTAT GGCCATTCTG GAAAACTGTT TGGCAGTTTC TTAGAAAATT AAACATGTAC TAACAACCCA

GCAATTGTAC TCTTGAGCAT TTGTCCCAGA TAAATGAAAA AAAAAAAAAG CATTTTTTTT ACACAAAAAC

ATATACATGA AAGTTCATAG AAGTGTTATT CATAAAAAAC TGGAAAAAAC TGAGATGTCT TTATTGAGTG

AATGCTTAGG CAAACGGTGG TCTATCCATA CAATGGAATT ATGCTTAGCA ATAAAGAGAA AAGAACTATT

GATACATGCA ATAACACAGA TGAATCTCAA AGGAATTAAT GCTGAGTGGG AAAAAAAGCA CATCTCAAAA

TGGTATATAC TGTACTATTT TATTTACTTA ACATTTAAA AATAGCAAAA TCATAGAGAT GGAGAACAGA

TTAATGGGTA CTGTGTTTTG GGATGGGGAG TGAGAAAAGG GTAAGGTGTA AATATAAAGG GGTAGCACAA

AAGAGCCTTG TGGTTGAAGG ATTCTATGTC TTGGTTGTAG TCGTGATTGC AGGAATCTAC ATGTGATAAA

ATTGTATGGG TCTACATACG CATACACACA AGAGCATATA AAACTGGTGA CATGTGAAGA AGCTCCGCAC

ATTGTGCCAA CATCAGTATC CTAGTTTCAA TATCAGACTA CAGTTATACA AACATTGTC ATTGAGGGAA

ACTGGGTAAA GGGAACACAG GACATTTGGC ATATATTTTT GCAATTTCCT GTGAATCCGT AATTATTTAA

AAATAACAGA TATACTACAT ATCAAAAATT TAATGTCATA AAGTTGATGA GTTTACCTAG TGGATAGCTT

TGTTAATATC TGCTATAAGA CTACTGAAAA TGACAGTTAT GCAAGTATAA GCTCAGAAA CTTTCCTCCC

CCTTCGTAAA TGAAATGAGC AAAAGAAATG AAACAGGAAA GGCAAGCAGT ACTGAAAACA GGGAAGGGCT

CTTCCCCATA TAACTATATC TGCGACTTCA ACAGCTATTC ATCCAGAAAC ACAGCCTCTT GCGCTAAGAG

GAAACTTTGG ATAACAATAT GTTTTCACTC TCCAAGAGAG AAAATGGATA GATTAATTTT TAAGAAAAAA

AAAAAAACCT CACCAATTTC ATGCTGTGGC TTGCACCTTT AATCCCAGCT ACCTACAAGG CTGAGGTGAG

AGGCTTACTT GAGCCCAGGA GTTCAAGGCT GCAATGAGCT ATGATTGATT GTGCTATCGC ACTCCAACCT

GGAGTACTAA GCTAAGAGCT AAGAACACAG CTGAGAGCGG AGAAGAAACA AACAAATCTG ACCAATAACC

CCCACTCCCC TCATTTTACT GGAGTGAGCT GAGACTGCTG GCAAACATGG CCTTTGACCT AGCCTGAACT

GTAGCAAAAG TCATCAGATA TTTTTCCACC AATCAACAGA CAGAAGTGGG GAGAAAACAA TCGTAGTTCA

TAACTACAAC AAGCAGATAA ACGAAGGCCA TGGTGAGGGA TGGAAGACAT TGTGATATAT CAAAGGCAGG

CTCATTTAAA ACTCAACCCA AATTCCAAAC AAAATATATA ATTGAATATG TATTAATGCC AAAGGAGCTT

GAGTGAGCTT TAGCACAAAC CCCGCCCTCC AGCCCCCACC CAAAAAAATC ACTCTGTTCT CTCCCCATTC

TTTGATAGGC ATACTTGCTG TTTTCTCACA GCCAAGGTAC AGAGGGGACT TAGAGGAACT AGAACTCTAA

TACACTGCTA GCAGGAATGT AAAATGAAGC ATCTACTTCA GAAAACCATT TTATCAGTTT CTAGAAAGTT
```

-continued

```
AAACATAGAC CCACCATGCA GCCCAGCCAC TCTACTCCTA AGTATTTACA CAAGAGAAAT GAAAACGTGT
CCCCACACAG TTGTATTTAA AGGTGATGGT TAGCCTTGTG TGTCAACTTG GCTAGGCTAT AATACCCAGT
TACTGAATCA AATAGTAATC TAGGTGCATC TGTGAAGGTA TTTTGTAGAT GTGGTTAACA GCTACAATCT
GTTGACTTCA AGTAAAGGAG ATTGCTCTTG ATAGTATGGG TGGGCTTCAT CCAATCAATT GAAGGCCTTA
AGAGCAAAAA GTAAGGTTTC CCGGAGAGAA AGAAATTCTG CCTCAAGACT GCAGCCTCAA CTCCTGCCTG
AGTTTCCAGT CAGCCAGCCA GCCTAAAGAT TTGCTAGGCA TTATAATCAC ATCAGCTAAT TTCTTAAAAT
AAACCTCTTT ATATATATTG ATACAATGAA TGGTTATAGC AGCCTTATTT GTAATAGCCA CAAACTGGAA
ACAACCTAAA TGTCCTTCAA TAAGTGAATA CATAAACAAA TTGTGGTATA TCCACAATTT TTACGCAGCA
GTAAAAAGGA ATAAATGGTT GAATAAGGAA TAAACACATA ACAAGGATGA ACCTTAAAAC CGTAAGGCTG
AATGGAAAAA GTCAGACAAA ACTAATACAT ACTGAATAAT TCCATTTATA TTGAAGTTCT AGAAAATGAG
GACTAACCTA TAGTAACAAA AAGCAGAAAA ATTTTGCCCA CTGGTGATGG AGGGGCGCA GGTATTGTAG
AGTATCTGAG AAAGGACAAC TGGATAAAAG GGGGCACAAG AAAACTTTTG AGGGTGATTG ATATGTTCAT
TATCTTGTGG CATGGTTTCA TAGGTGCATA CATATGTCAA AACATCAAGT TATACACTTT TAAAATGTTC
AGTTTACTGT ATATCTATTA TACTTCAGTA GAGAGGAAGG AAGAAAGTGG GCAGGGTGGG GGAGAGGAAA
GGAAACGAGG GAGGAAAGGC CCTAATAGGA AGGATTTTGG AGTTTAGATT TTAAAATGAT AAAGGATGTT
TGACACTCTA GGCATATGAC GAATATAGGA TTATGAGTCC ACAAAAACCA CCAGGAAGTC ATGTATGTTT
ATACTTTTAA GTGAAGGATC AGTGGATTAT CAACTCCCTA ATGCTTTGCC TCTCTATGAC TGGCTGCTGT
CCTTCTCATC CCAATACTCC TTCCAAAGCC CCTTGCTTAA ATGTAAGCCT TCTTTCCTCC TTTCAACACA
TCCTGCATTC CGTGACAAAA TAAGTTTTCC TTAAACAGAA TGTACAGCAT ATTATTTGTA CAATTAAAAA
TTTTTGGCCA GGTGTGATGA CTCATGCCTG TAATCCCAGC AATTTGGGAG GCCGAGATGT GTGGATTACC
TGAGGTCAGG AGTTCGAGAC CAGCCTGGCC AACATGGTGA AACCCTGTCT CTACTAAAAA TACAAAAATT
AGCTGAGTGT AGTGTGGCAG GTACCTGTAA TCCCAGCTAC TCAGGAAGCT GAGGCAGGAG AATCGCTTGA
ACCTGGGAGG TGGAGGTTGC TGTGAGCAGA GATCAGACTA TTGCATTCTA GGCTAGGAGA CAGAGTGAGA
CTCGGTCCCC AAAAAAAAAC ACATTTTTTT TTAATGTTTC CTCCTTGCCT GTAGGAAAAA GGCTCTGACT
CCTTAGCCTG GGCATCAGAG CTCTATCTAA ATGGACTTTA ACCTGATTTT GTGGCACTAA TTCCATTGCA
GTACTTGTCC GCTCACTGGC CTGTGCCTCT CTGCCACTAT TTTTGGAATA ATGTCCTCTC TCCATCTTGT
TTACTCAACT ATATCCAACC TCTAAGGCTG TGCTCCTACA AAGCCTCCCC TGGCTACTTC AGCCCACAGA
GATATTTAAC TGCTCTGCAG TTCAGGACAT TCTTCTGACT CTTTAAATCA CATTTACTTA TATATGATCT
TGTGATATTT TTTGTTGACG TGTTTACTTT AATTTTCCTC CATAACCTAT TCATTCAACA AACTCAACAA
TTATTTATTA AATGCCAAGT TAGAAAAATA TTATTGATTT TATATAGATT ATAGATATGT TTGAAATTTT
ATTTGGCAAT CTGCAAGTAG AAAAATAATT ATAATGTGGT ATATCTGTGA TAGAAGTATT AGTGCAGAGA
CCATGGGGAA CATAATCCAG CCTGGAAGTT CAGGAGAGAT ACGTGGAAGA AAGGACGTCA GAGCCTTTTT
CCTACAGGCA TGGAAGAAAC ATTAAAAAAA ATTTTTTTTT TTGAGATGGA GTCTCACTCT GTCTCCCAGC
CTAGACTGTG GTGGTGCGAT CTCTGCTCAC TGCAACCTCT GTCTCCCGGG TTCAAGTGAT TCTCCTGCCT
CAGCTTCCCA AGTAGCTGGG ATTACAGGTA CCTGCCACAC ATGGATGATA AATATGATCA TATTTTCTTG
TTCTTTTCCT CCTCAGTTGT CTTCCCTGAA GAAAGGAATG CCTTTTATAG ATGACAAACT CCCATTCTCA
AGAACAAGGA TTTTTGACCA ATTTAATTTA ATCAGATGTC TGGCTTTGAC CTAGAAACAC AGTCACGAAA
CTTGGTGATT AGAGACCAAT TCCCAAACAT GAGCATTTCT TAGGAAACAC AGTAAAGATC TGAGAGACCC
AAGAGCAGAA GGGCGAGAAA CCAAAAGCCA TCAGTTTGCA TAGGAAACAC CTTGTTTAGC CTAATCTTTT
TATTTTTATT ACTCTATTAG TCACTACAAC TATTTTCTGA TTGCTATGGT GATAGATGGT TTAAAACAAG
```

```
CCTTCATTAA GAATTGTCAC ACCATGGTCT CAGTCAAAAA CACCAACATT TTTATTGGTA TTGACAATTA
TGGGAATATC CAATTCCAAG AAGACAAGGA GACCTCTGAA CTTTCTAAAT GAAGACTCCA ATCTTCCTGA
TCTGATGGGA AGCAGCTTGG CAAGATTACC AACCACCACC ACAGAGAGTG GACTCTAAGC TAAGACTTAA
AAGATAAGTA GAAATTATCC AGGTAAAGAT GTGTACAGAG AAGGAAGTAC ATCCAGGGGA AAAGAACAAT
ACGTGCAAAA GTACGGAAAT GGTAAAAAGT AATACTACAT AGTCAAAGCC AAGCAGAGTT CAGAAGGGAT
CTGGTGGTGA AAAATACGGC TAGAGAAAGC AGCAAGGATT GGCTTCTAAA ACCTATGTAG TATCTTGGAC
CTTACCCTAA ATGTAATGAG AAGCTTCTAA AGAATCTTTC ATTTATTCAT TCATTGAACA AATATTTTGA
GGCTTTCTGT GAAGAACATC ATTCTAAGTA GTAAAGATAC AGCAGTGAAT AGGACACATA AAATCCTAGA
TCTCACAGAA TTGACATTCC AGAGAGGGAA AGGTAGACAA TAAATACATA AACAAATCAT TTAACAAGAT
GATTTCAGAC AATGGTACGT ACTGTGAAAA AAATGAAACA AGGTAATGGA CAGCGAAAAG GCACTGGAAG
GAAGCCTGCT TACCTTTGCA TGGTTAGAAA AGATCTCTCT AAGAAAGAGA CCACATGTGA GCTGCGACCT
GAAGGATACC GAGAAGCTAG GTGTGCAAAG ATGTGGGAC AGAACTTTTG GACTGAATAG CAAATACAAA
TGCCCTTGGG TGCAAGCTTT GCCTGTTCAA GGACCAAAAA GAAGGCCAGT GTGCCTGCAG CATACTAAGC
ACAGAGGAAA ACACTGTTAT ATGCTGAGAT TGGAATTATA AGTAGAGCCA GATAATATAG TCTCTTATAG
GTCATAATAA GGCAACCAGA TTTTATTCCA AGAGGATTTA AAAATCACTG GAGGTTTTGC ACTAGGGTGA
GAGGTGTGAT TTGTATTTTT AAAAGATAAT TCTGGAGAAT TAACTATAAT GAGGTAGGAG TAAACTAAGT
TAGGGGCTAT TTCAGTGGCT CAGACAAGAG ATAATGGTAG CTTAGACTAG GATAGTAGTC GTAGAAATAA
ATAAAAGTGG CACTCTACTT TGGGGGTAGA GTCTATAATA GGTTTGGTTT ATGGATCATA TATGAGAGTA
AAAAAAAGAA AATAAATTAA TAATGGTTCC TAGGTTTGTA CCTGAGCAAC TGAATAAATG GGTGCTGTGA
ATTGAGATAA AGGAGATTGA GAATCACAGG CTTTGTTTTG CAAATTAATT TTGAGAGGCT TATTAGACAT
CCCAGTGGAG ATTTCAGGTG AGTGGAGCCC ATTGAAAGGT AAGGGACAGG GTCAGGTGTG GTAGGTCAGG
CCTGTGATCC CAGGACTTTG GAAGGCCAAG GCAGACAGAT CAGTTGAGCT CAGGAGTTTG AGACCAGCCT
GGGCAACATG GGAAAACCCT GTCTCTACAA AATATGCAAA ATATTACCTG GCATGGTGG CATATGACTG
TGGTCCAAGC CACTTGGGGG GCTGAGATGG GAGGATCACT TGAGTACAGG AGGCGGAGGT TGCAGTGAGC
CAAGATCTCG CCACTGCAAA CCAGCTTAGG TGACAGAGTG AGAACCTGTC TCAATAAATA AATAAGAAAC
GTAAGGGAAA AGGAAATTAA TCTGATCATT GGCAAATGCA TAGTATTTAA AGCCAGGGGA GTAGATGAGA
TACTCAAAGT AGGTGAAGAT AAGGAGGCAA TGAAGGCCTA GGACTCTGGT GTACATTTAG ATGGTTATAA
GAGGAATAGA AACTGGCAAA ATAAGTAACA CTGAGCACCC AATGAGGTGG AGAGGAAAGC CAGGAGATGA
AGCATCATAG AAGGCAAGAG AAGAAGGGTG TCAAAGAGGC GAGGCAGTCA TCAACTTCTG GGCAGTCAAA
TAATATAAGG ACAGAAAAGT GACCATTGGA TTTGGAAATA TGATGAGCAC TTTGAGTGGA GTGTTGAGAC
AGAAGACCAA TTAGAGTAGA TTGAGGAGAT AACGAGAAAT GAGAAAATGT AACCTGCAAG CACAGACAAT
TCTTGAGAGA CTTTTCTGTG AAAGGAAACA GACACAGAGT CTTAGCATGT CTTGTCTTTC TATGGGAAAT
GTAAATAGTT TGAGATCAGG GATAGTATTT TATTCTGCTT TTTGTACCTC TACATTACCT AGCATAGAGC
TAGCTAATGT GCACTTAAGT ATGTTCTCAA TTCTTATCGC CTGAATGACT GGATGGGTGA AGAATGGAT
GGATGGATGG ATGGATGGAT GGAAGGATGG ATGGATGGAT GGAAGACTTC TGATTGCCA AGAAGAGGAT
ACTGGTAGCA GAAATAAAAA CAGCACTGGA GAAAGAAGAG TTTAGATTTT TATTCTTTGG TGTCAGTTAG
ACAGGAAAGT AAGACATTAG AAGAGTCCTT AGATAATTTA TGTAATTGTT CACTTAGGAT TTTTAAATGT
GATCACTGAT ATTGGACATG TTCCTAGTGA AGCATTTTTG GTGTTTCACT GGTTGAAGTT AATAACTGTA
AAATTATTTC CCGTTCAGGA CAGAAAAACA GAAAACTTGA AGCTCCTATT AGAAAGTTCA AGATTCTCTG
```

-continued

```
GGGTTCTTAG GATTTACTGT TCCCAAAACT CTGTCAAGAA CAAGAAAATG ACCTGTATAC TTAACTGGTC
TAGGCAACAG TGGAAAGACA ATTCTCAGAG AAGATTTGTT TTAAGAAGAC ACTTTCCATA GGAATCAAAC
AATAGCTTTC AGTGACTAAC ATGGTAAGAC ACAGGGTGTT AGCTCTTTCC TTCCAACCTC ATGGCTGTTG
TACCTTACCT TTCGACCCCG TGTTCCTGAA ATTGTTAAAT TCATAAACTT ACCAAGGACT AACCAGCCTC
TGGGGAATTG CTGTATACTT AGCAAACTTA CAATGGACAT ATTTATAAGC CATAATGATA ACTGACTAAT
AGGAAATACC CTCAACTGAA AATGAGAGAT CATCATTTGC AAATGAGTTC CCTTGCCCAG GCAACTACTG
GGGAAAATGT CATGCAAGCA AAATTAATCT TTGAAATCCT CCTTTTCCAT TTTTTGTGTC TTCCTTTTCC
ATAGGCACCA GAAATATCAT GGTGCCTGGA TCTCATCTCT ACAGAAAAAA AAAGTGATTT GATAAACTGA
TTTATATTGT GTCCAAATGT GATTGTATTT TCAAAGATAA CCTAAGGGGA GAATGCTGTC TGGCCCAACA
GCAGGCTCTC GACTTCATTT CAGACACTGT GGCCAATGGC TGGGAAACAG GTATGAACAG TAGGTTTCTG
AGTCCCCTGG AATTATTCCA TTTATGTAGC CACCTCCATG ACAGGAAGCC TCCCTACTCT TACTTCCCAG
TTTGTTCATT CATGGCACCA GGTTGCAGAT TAAAATTTGC TCAGTGACCT TTTATCTAAT AATGTGTTAC
CTTCTTCTCT TAAAAAGTAC AAGGGACAAA TGCTCATGGT ATACTTTTAG GAGATTGTGG CTCTCTATTA
ACAGTATTTA TTCAACAAAC ATTTATTGAG CATTTATATG TGCATCATGC TAGGGACTGG AACCTAGTAA
GTGTAGCACA TATTATTTCA TTTAATCCTC ACAACAAACC CATGAGGTTG GTTTATGAT CCCAATTTTT
CAGAAGAAGA AACTGATATT CAGAACCAGT TAACTAACTG GTTCAAGGTC ATGCAATTTC TAAGATACAG
AACCAAGAGT CAAAGACATG ATTTTAAACC AAAGCTTTTT CTGCTACTCC ACATTGCTTC CCTAGGTGAG
ATCTGAGGCA TTCCGCGAAA AGAGAAGGGT CATAAAGCCA AGGAAGACA AGCTTAGGAA AAAAAAGGGA
AATGTCCTAA ATAAACAGCT TTCCTATTTA CCAGAAACCA CTAGTTTAAA AATATAATGG GAAAAATCCT
ATTCACTTTA ACAATGTTAA AAAAAAAAAA GATAGAAGAA ACATAGGGAT AAACTTAACA CATTTGTAGG
ATATGTAAAG AAACTAAAAG ATGTTAATAA TGGCCTAAAG AAAAAAAAAC TTACATGTAT GGGGAGATAG
ACCATCTTAC TGGATTCTAA TATTTAATAG TCTAGGTGTT CCATTTCTCA CCAAATTAAT GTATACATTT
AATACAATGT CAAACGAAAT ATCTTAGGAA TTGCTTACAA ATTGTCAGAT AATTACAAAG TTTACCTGGG
AAATATAAGC ATATATGAAG AGTGAATGGG ACCCCACCAC TCCCCCCAAA ACAAAAAAGG TCTGAAAAGG
ACAGAAATCA AGGAGAGTCT TGCCTGCCAG ATACAAAATT CTATTATAAA GGTGTATTGA TGAAAACAAT
TTAATACTAG TGTAGCAATA GGCAGCAAAG CAATGAAACA GCATAAAAAG ACCAGAACTA TACCTAATTA
TGATGAAGAT TTAAGGTATG ATAAACATGA CATAATTCAA ATCAGCAGAA ATTGGCATAG ATAGGGTTAA
GACAAATAGC TAATCATTAG AGGGGAGGAA GGAAAGGAGG GAGGATAAAA TTAGGTTCCT GCCTTCATCT
TACATTAAAA TAAATTCCAG ATGTATTACA TTTAAATTTT TTAAAAAAA GAAACCACAA AATACTTGAA
GAAAATATAA GTTGTTATAT AGTCTTTTGA TGGGAATTTT TTTTTTTTC AGAGACAGGG TCTTGCTCTG
TCACCTAGCC TAGAGTGCAA TGGCATGATC ATGGCTCACT GCAGCCTTGA ACTCCTGGGC TCAAGTGATC
CTCCCAGCTC AGCCCCCCAG GTAGCAGGAA CTACAGGCAT GCGACACCCC ATCCAACTTA TTTTTTATTT
TTTGTAGAGA CAGGGGTCTT GCTTTGTTTC CCAGGCTTAT CTCGAACTTC TGCCTTCAAG CACCTCAGCC
TCCCAAAGAG CTGGGCTGAT GGGACATTTT TTAACATAGT GCCACATTAC CATAAATGAA AAGCTTGTAA
ATACTAATT TTTAAAACTA ATATATATCA GAAATTTTTA TAAACAAAGT TAAAAAGCAA ACACAAAAAA
TTTGTAGCAC TTATGACAAA TATATGTATA TATATGAATA CAAAAGAGC CTTTACAAAA CAGTAAGAAA
ACAATGAATA CTCCCAATGG AGTATTCAAA ACTAAACTGC TAAAAGCAAT TCAAAACAAA AACATAAAC
TATGCATATA TGTATGTGAA AAAGTTTAAC CTTATCAAAG AAGTAAACTC TCAAAGAAAT AAACATCAAA
TAAGGAAATA GCCTTTTCCC ACAAATAACC AAAATCTGTA AGAATACTGA GCTGCGAATG TTTCAGAAAA
AAAAAAAAAT CATACACCTA GTTCGGCATG TAATTAATAT AGATCAGAAC ACTTTAAAAA TATTTATAGG
```

```
CCAGGCACGG TGGCTCATGC CTATAATCCC AGCACTTTGG GAGGCCAAGG CGGGTGGATC ACCTGAAGTC

AGGAGTTTGA GACCATCCTG ACCAACATGG TGAAACCCTG TCTCTACTAA AAATACAAAA ACTAGCCAGG

CATGTTGGCG TATGCTGGTA ATCCTGGCTA CTCGGGAGGC TGAGGCAGGA GAATTGCTTG AACCCAGGAG

GTGGAGGTTG CAGTGAGCTG ACATTGTGCC ACTGTACTCC AGCCTGGGCA ACAAGAGCAA AACTCTGTCT

CAAAAAATAA TAATAAATAA AAATAAAATA TTTATATACT CTGACCCATC AATTTGTCCA GCATAATTAG

GCATGTGTAC AAGGGTTTAC ACACAAGAAT GCCTATTGCA ATATTGCTTT TAATGCTAAA AAAAATTGGG

GAAAATGCTT TAAAAATATA GATTAAGACT GTACATTGTG GTACAGTCAT ATAATCAATA GTATACAGCT

ATTATTTATT TTCAGCCACT GTCCAAAATA TAGCCTGGCC TAACAACATT CTGTTAGGAT ACGCAAGCAC

CGTGAGGAGA TCAGCTATAA AGTATCAGTG TTTCACACCA CTGCTCCTTT GCTAATAACC TTCAATGGCT

TTTAAAGAAG TAAAAAACAA AGGCAAAATT CCTTAGTCAG CCCTTAAGAC TCTCTGTTAC TTAGCTCAAA

CTACCCTTTT CAACAACACT GCCCTAACCA GGATGAGTTT TTTGCCCCCC TGGAGTACAT TCAGCCTTTC

CTTATCAAAC CTTCCTTTAA ATAAGTATCT TCTCCAGGAC CACTTCACTT TCTTCCCCAA TTTAGCATTT

TCTATATCTC CAGGCCTACC TCTATAAAGC CTGTCCTAAC CACTCAAACC CTAGCTTTTT CTCTGAACTG

CTAGAAATAT TTTTCTCTCA TTGGCCATTT AGGTAAAAAG GTTTTTACTG TTTATTACCT ACTCAATAAA

AATTTTCTTT TTTTGAGACA AGGTCTTACT CTGTCGCCTA GAATGGGGGG AAGTGGTGTG ATCACAACTC

ACTGCAGCTT CTACCTCCCA GCTCAACAGT CCTCCCACCT CAGCCTAGTG AGTAGCTGTG ACTACAGGCA

TGTGCCACCA TACCCACTA CTTTTCATTT TTTATTTTTT GTGAGATGGA ATCTCACTAT GTTACCCAGG

CTGGTCTGCT GATCTCAATT GATCCTCCCA CTGTGGCCTC CCAAAATGCT GGGATTACAG GCATGAGCCA

CAATATCTGG CCCCAGTAAG CTTTTAAGGC CATTAACATG AGGAACAGTG TTCTTTACAC TATTTTATCA

GCTAGGGCTT TGCATGGAGT AGGAGTTTAG TAAATGCGGT TGATGGGTTA ATCAATGTGT GAAAATATTC

AGAGCCACCA AAAACAGATA TTATGTCTAT TCTCATCAAC AATCAAAATT GAGTAAACAG CCATTTTCTA

ATACAGGAAA CCACAAAACA TTGAATGGTG ACATTAAAAA ATTCCCCCAG CAGGAGCCAA CCAATTTTTT

CATCCTGATC CAAGTTAGCA AACTGCAAAA GATAGGAAGC ACTAATGAGT GGAAATTTGA GTAGAAGCAT

TTCTTATGAA GGCTGTCTTG ACTGGATCAC ATTTTTATTG CTGTTGGAGG TGCCAAATGT GTGTGTTTAT

GCTAATCCTC CACCTCAGGC AACACACAGT CAAGGATCCT ACCAAGTGTT ACCGTCAAGT GTCTGTTGGC

AGCTCAAGGC CCCAGCGTTG TTCCCTTGCA CTAGGGAAAA GACATATTCC AGGTACAAGT ACTCCCACTT

TGATGCTACA GAGGAGTTGC TGAACTTTGT GTCATTAATC TCTCTTCGTT AGATCCCAAC CCTGTTTAAA

TCCCACTATC TGCCTACTCT GGGTCTTCAC CAATTTACTA GATCATAGTT GGAGAAAATC TACAAAGCCT

TGCTCCCTTT AGATTTAAAC AGGTCTCCGT TTAAATTTAG AATTGCTAAC TTCAAGCGGG CCCTTATGCG

ACAGTATGCC TGTCAGTCAT ACTACATTTC CTCAATTCCA TTCATGTGAC TGCTCCATAC CCTTCCCTCT

CTCTTCATAC TACTATTATC TCTTCCCCCC TCCCTCATTT TTAACTGATG ATCTTGTTTC CTATTTCTCT

GAGAAAATAG AAGCCATCAA AAGAGAGTTT CCACAAACTC CTACTGCCTT ATCTAGCCCT GTACCATATA

CTTTGCATTT CCTCTCATTA CCATGGATGT ACTGCCTATC TGTGCTTCTA TCTAAGGCTA ACCCTTCCAC

TTCAGTTTTG AATATTATCA GCTCTTACCA ACTCAAGGCC ATTGCTCTAG CAATTCTCTC ATTCTCTCTC

ATTTTCTTCC ATCAAGTTTT CCTTTTCTTC AATTAACAGA GTAGCTCCTA AAGGGAAAAA AAAGTCTTCT

TTTTCAATGC TCATCATCAC TGGCCATCAG AGAAATGCAA ATCAAAACCA CAATGAGATA TCATCTCACA

CCAGTTAGAA TGGCAATCAT TAAAAAGTCA GGAAACAACA GGTGCTGGAG AGGATGTGGA GAAATAGGAA

CACTTTTACA CTGTTGGTGG GACTGTAAAC TAGTTCAACC ATTGTGGAAG ACAGTGTGGC GATTCCTCAG

GGATCTAGAA TTAGAAATAC CATTTGACCC AGCCATCCCA TTACTGGGTA TATACCCAAA GGATTATAAA
```

```
CAATGCTGCT ATAAAGACAC ATGCACACGT ATGTTTATTG TGGCACTACT CACAATAGCA AAGACTTGGA
ACCAACCCAA ACGTCCAACA ATGATAGACT GGATTAAGAA AATGTGGCAC ATATACACCA TGGAATACTA
TGCAGCCATA AAAAATGATG AGTTCATGTC CTTTGTAGGG ACATGGAGGA AGCTGGAAAC CATCACTCTC
AGCAAACTAT CACAAGGACA AAAAACCAAA CACTGCATGT TCTCACTCAT AGGTGGGAAT TGAACAATGA
GAACACTTGG ACACAGGAAG GGGAACATCA CCCACTGGGG CCTGTTGTGG GATGAGGGGA GTGGGGAGGG
ATAGCATTAG GAGATATACC TAATGTTAAA TGATGAGTTA ATGGGTGCAG CACACCAACA TAGCACATGT
ATACATATGT AACAAACCTG CACGTTGTGC ACATGTACCC TAAAACTTAA AGTATAATAA AAAAATATAT
ATATATATAT AAAACAACTA AAAATAAATC TTCTTTTTCT GCAGGATCAG TCCATCACCA CACACACAGG
CTGTGTTTTA TGTTGTTCCC CAGCTTAAGA GATCGTTCTC CAGATCCCAC TGCTCCTTCC AGTTGTCACC
TCAGTTCTCC ACTTCTTTTT GCTGATAAAC TACTCTAACT AGTTACATAT GATTTCTGTC CCCAGGTCCC
CTCCCTCAGT TGTTTTGAAC ATAATCATTT ATATCATTTA TCATTTTCAC TCTAATTGCA CAACCAAAAA
CTCCCTTTTT TTTTAGATGG AGTCTCACTC TGTCACCTAG GCTGGAGTGC AGTGGCATGA TCTCGGCTCA
CTCCAACCTC CGCCTCACGG GTTCAAGTGA TCCCCCTGCC TTAGCCTCCT GAATAGCTGG GATTATACAC
ATGCACCACC ACACCTGGCT AATTGCTTTG TTTTTGTTTG TGTGTGTGTG TGTTTTTTTT TTTTTTTGGA
CAGAGTCTCA CTCTGTTGCC CAGGCTAGAC TGCAGTGGCA TGATCTCAGC TCACTGCAAC CTCCACCTCC
TGGGTTCAAG CGATTCTCCT GCCTCAGCCT CCCGAGTAGC TGGGACTACA GGCATGCACC ACCATGCCAG
GCTAATTTTT TTGTATTTTC AGTAGAGACC AGGTTTCACC ATGTTGGTCA GGCTGGTCTT GAACTCCTGA
CCTCAAATGA TCTGCGCACC TGGACCTCCC AAAGTGCTGG GATTACAGAC TTGAGCTACT GCGCCGGGCT
ATTTTGTGTT TTTAGTAAAG ACGGGGTTTC ACCATGTTGT CCAGGCTGGT CTCAAACTCC TGACCTCAAG
TGATCCGCTC GCCTCAGGCC CTCAAAGTGC TGGGATTACA GGAGTGAGCC ACCATGCCTG GCCATAAAAC
TGCCCTTTGT TAATATGACT GTTGGCCTGC ACATTGTCAA ATCCAGTGGC ATTCATCTTA CTCGGCCAAC
CTACGGCATT TGACACTGTC TGTCTTTCCT TCTGTTCCTC TATCTGTTTC CAGTATACTG GCCTGGCTTT
CTTTTTACCT CTTTTATATG CTCTTCCAGT CTCAGGCTCC TTTGGGGATT TGAAGGTATG TTGCATTTTG
CTATTCAATG AATAATGACA AGTAATGATC ACTTAAGACA TTAAGTGGTC AGTTCCTTTA CTAGGATAAA
AATAATTTTC TTCCCAACAT GGGGCATATT CCATTTCCAG TCTGACTGTT CTGTGTAATC TTTGTATTCC
TTGGCAGCCC CTTTTATATC AGTTCATCTA CTGTGCAGGA AATTGGACAA ACATTTGCAC TGGTATAACC
AAATACAGTT GAACTTTTGG CTTGACTCTT AGCTGAACTC ACCAAAAATA ATTTCTGTAA GAGACTGAGA
CGTCTACGAG TAGGTTTTTC AGAATTAGTA AACATAAATC AAGGATACAC AGGTAGATTT GAATTTCAGA
TAAACAACAA ATACTTTTTT AGTATGTCTA CTGAAATATT TGTATCTTAT CTGGCAATTC TACCTGGTAC
AGAACTAATC CATTCTCTTG AAAGATCTTG ACTCTGTAAT AAGTTCTTTG GTGATGGAAG GGAGGTATTT
CTGTAATTAG AGTCACTGTC TTCCTCCCAG TTTTTTATCC TGGCCCAGAT CTGCAATGAA CACACGACAG
AATCCAGGGG GGATGAAGAT GGGTGCTTTG CAGGAAAAAA AAATTAAAAA CATCTGAAAA AGCTTTTGTA
CTAAAAGAAT GTGATCTAAA AAAGAAAGCA GGAGAACTTT CTGTCTGCAC TTTACATCAG AACAACCTTG
GCGTCTAGAA GCTGTGCCCT GTGGGAAGTG GTGGTGCTTG GTAAGAGATG CCAGGACCAG TGGTACCCAC
TGGGAGCACT GCCAATACCC AGCAAGGAGC ATGGGTGCAC AGTAAGGCAT TGCACTGTGA TTCAGCATAA
AATAACAATA AGGGAACGTC ACGGAGAAAA GGCCAGACTT CCTTTGTTTA GAATGTGGGA AATGTCTTCT
GAAAAATGGT AGTAAAAAAG CATGCTTGGA TGGTCCACTC CAGGCAAAAC TGACTAATCG GGGTCAGGG
ATACAACCCC TGCATCATAT GTTTGTTTCT GTTGGGCTGA CATGAGGTTC ACTGTGACCA CTGTGGTTTA
ACCCCATAGT CTCCTGGAAA TACAGCCAGG TCAAGAGAGC TCCACATAAA ACATAATCAA AAAAATAAAC
TCAAGTTTCC ACTGATCAGC TTTTCACAAC TCTTATCCTT TCACTAACTT GGAGCAAGA TTTGAGAATT
```

-continued

```
GGATGGCTAT TTGAGGGCTA TTTCTGCGCT TTAGTTCAAT GTTTTGTTCT TTCTTTATTA GAGAACTATG
GTTTTTTATT ATATTTACAC TTTAAGTTCT AGGGTACATG TGCACAACGT GCAGATTTGT TACACAGGTA
TAAATGTGCC ATGTTGGTTT GCTGCACCCA TCAACTCGTC ATTTACATTA GGTATTTCTC CTAATGCTAT
CCCTCCCCCA GTCCCCCACC CCCCGACAGG CCCTGGTGTG TGATGTTCCC CTTCCTGTGT CCAAGTGTTC
TGTTTATGTG ATAGATTACG TTTATTGATT TGTGTATGTT GAACCAGCCT TGCATCACAG TCACTTGCTT
ACAAGAAACA AACACTTCAC AGATGGATCA TTATGTGTGA TAAGTGAAAT CCAAGGATTT ATGCTCAGAG
GTGGGCTTAA CAGGTAGGAA GAGCAGTATT TTCCTTCAAC CATGAGTGTA TGCAGGTTTT TCTTTTCTTT
TTTGAGATGG AGTCTCACTC TTTTACCCAG GCTGGCGCGC AGTGGTGCGA TCTTGGCTCA CTGTAACCTC
TGCCACCTGG GTTCAAGCAA TTCTCCTGCC TCAGCCTCCC AAGTGGCTGG GATTACAGGA CCTGCCACT
GTCTCCGGCT AATTTTTGTC TTTTTAGTAG AGATGGGGTT TCACCATCTT GGCCAGCCTT GTCTTGAACT
CCTGACCTCA TGAATCATCC TTCTCAGCCT CCCAAAGTGC TGGGATTACA GGCATGAGCC ACTGCGCCCA
GCCCACAGGT TTTTCAAAGA CTAAACTTAA AAAAAAAAAA AAAATTTCCC AATGAAATAT AAAACTAAAG
TGCTAAACTG TGATAGACTG TTTTACAAGA ATGCCAGTTT TCACAAGTGT CTATAGAACA TGTAATTTAG
ATAGGTAAGA TGAAATTTTG ATAATATTTG ATGGCAAATT TAAACAGGTA TACAACAAAA ATAAAATTCT
AAGCCCCTCA ACCAACTGAA TGGACTCCTT CTCTCAGCCA AAGGAATACC AAAGTAAACC TGAAAACTA
GTTTTGGCCA GGATTGGGGG TAGGTGGGGG AAGCCCAACA TGACTCATTA TTCTCTCCTC CCTTTGGAAT
TCAGGCACAA CTGAATGTCA GCATTGACAC TAAAACACAG ATCTTAAGAC TGACAAGCCA GACTCTTGT
AGCAGAGAGC CAGGCCCTGG AAGAAATCAA GTTATTTTAT CCCAAAAAAT ATTTCTTTGA TATATTTTCA
AATGGCCCTG CAAAGCTGTC TCTTGTGGGG AAAATTGACA TGCTGTACAG AATTTCCTTC TCTTTCCAAG
TTTTTACTGA TCCAGGAGAG ATTTAACTAA GAGGCTAGCA TGTTTTTTTT TTTTTTTTTT TGAGGCGGAG
TCTTGCTCTG TTGCCCAGGC TGGAGTGCAG TGGCGTGATC TCAGCTCACT GCAACCTTCG CCTCCCGGGT
TCAAGCGATT CTCCTGCCTC AGCTTCCCGA GTAGCTGGGA TTACAGATCC ATGCCACTAT GCCCAGCTAA
TTTTTGTATT TTTTGTAGAG ACAGGGTTTC ACCATGTTGG CCAGGCTAGT ATTGAACTCC TGACCTCGTG
ATCCGCCCAC CTCGGCCTCC CAAAGTGCTG GCATTACAGG CGTGAGCCAC CGTGCCCAGC ACAAGACATT
TACCGTCTAT TCTCTCTGAA GCTACTATCT AGAGGCTTCA TCAACATAAT AAGACCCTTG GTCTCCACAA
CTCCTTATCT TATCCTATTA GTTTCTACTG ATTCCAGGTC TTTAGATAAT AACAACTCTT TCAACCAATT
GCCAATCAGA AAGTCTTTGA ATCCACCTAT GACTTAAAAG CCCCACTCCT TCAAGTTATC CCGCCTTTCT
GGACTGAACC AATGTACACC TTATATGTGT TGATGGATAT CTGCCTGTAA CTTCCATTCC CCTAAAATGT
ATAACATCAA GCTGTAACCC AACCACCTTG GGCACATGTT TTCAGGAACT CATGAGACTG TGTTGCAGAC
CTTGGTCACT CATATTTGGC TCACAGTAAA CTTCTTTAAA TATTGTATAG AGTTTGGCTT TTTTCATTGA
CACAGGAAAA ATAAAGAATT GGAAGGTCTT TCATCAGTCA CTGAGCCAGC TTCATATCTG ACTGAGGTCA
TACAGTTCAG TGATTTGTAG CTTTGCTACT TAGATTGCTA TCCATTATCT AGAAGCATCA GGATCACGTG
GGACCTATTG GAAATGCAGA CTTTCCTCCT AGAACCCAGG ACCTTGGAAT ATTCTTGGCA CATAGTAGGT
GCTCAATACA TATTGAACTC CTAGGTGCAA TTCATTAATT CATGAATTAA TGAATTAACA CGCTCTCAAA
GTTTAGTGCT TTTTCACAGA CTAGTCTTTC TGCCTCTTAA GCACTCAGCT CACCACGCTT CCAGTCTCAC
TCCCCTATTA GTCTGATTAA AATCTGCTTA CATGTGAGTC TGAGATCAAG TGTTATCTCT TCTGAGAAGT
CTTCCCTCAC TGGCCCAAAG GAATTTCTCC TCTATTTTAG CACTGTCCCA GTTGACTTGT CATTATTCTA
GTCTTTTTCA TATTAGTTGT TTTTCATATA TATGTTATTA AGGAAACTAG TCATTTCCCC TAATAGAACA
AAATTGCTGG CCTTTGGGGT TGGCAATGGA GGGGAGGCTC TTCTTGAAAA GGGGGAAGAG TGTTCTCCTA
```

```
ATATTTTTCT TACGAGATTT ATGTTGCTCA TCTTTAGCCT TTAGTCCCCC ATTGCCTGCC TACAGTTGGC
AGAGACCATC TGTTCTCTCA CTGTCAGGAA CTGTCTCAAT TCTTGAAGTT CAGAGTCAAA AAAGAAGCAA
GTTTTCCTAG CTCTTTGATC AACTTTCAAA GTTTTACTTC CATTTGAAAA TTTACTAAGT CACCAGGAGA
TGGTTTATAC TGAGAAATAT CCACTCATAC TCTTCCTCTT CAACTTTCTT CCATATACAC CCTATTACAG
GGATATAGTC TTACTCTATA GCTCAAAAGG ATGACCCTAT CAGAAACCTG CACAGTATGT AAAACATTCT
CACCAGAGGT TCACTTGTGT ATTTCCACCC TAGAATGGAA GCTCTACAAA AGCACAGAAT GTATCATTTT
AACTTTAGAT TCTATTTTCA CACCCAGTGC TTGACACATG ATTTGAAGTT AATATTTATT TATCAAGTGA
TTGTTTTAAA ATCATGACTC ACTCAACAAA GTTATAAGAA TAAGAATAGT GTTACAGAAT TGGTATACAC
AAGCTGACCA TAATCAACAC ACCTATTATC ATTTTTTTGC GACAGGTTCT CGCTGTCTCA CCCTGGCTGG
AGTGGAGTGG CATGACCACG GTTCACTGCA GGTTTGAACT TCCAGGCTCA AGCAATCCTC CCACCTCAGC
CTCCCACATA GCTGAGCCCA CAGGTGTGTG CCACCATGTC CAGCTAACTT TTTAATTCTT GTAGAGACA
GGGTCACCCT ATGTTGCCCA AGCTGGTCTT GAACTCCTTG GCTAGAGAGA TCCTCCCTCC AAGGTCCCCC
AAAATGCTGG GATCTCAGGC AAGAGCCACC ATGCCTGGCC ATAATCAATA CACTTTTAAG AATGCTAGAA
TGTTATATCA GATGCATACT TCAGCACTAT CTCAAGCAAA CTGGGGTGTG GGTTATTCTA CATATAAAGT
TCAGCAGTGT TGTTCCACAG TCCCAAACTC CAACTGAGGT CAAATGTAGG GTGCAGCAAG GTCACTGGGG
CTGTCATCAA GGGCCTCTCC TTGCACTCTT GCCAACCCTG TTTCTTGATT GTCTCTACCA CCATGAGTCA
CCAGCAATCT CCCACAGTCA CTTGTTTAAA AGTTCACAAG TATTGTGTGA ATTGCAGGCA ACCCCTTGAC
TCCCTGATTG CCTGGTCTTC TTCCTTGGGC TCTACCATTT TTTTTCCCCA GCACTCTTTC TGCTGCTCTA
AATTTTAATT CATGCAATTC CATATGTGTT TCTCTATCAT TCTTCATCTC TTTCCTCTCC CTTCCATCCA
ATTTTGTTTG TCTGTTTGCT TGCTTGCTTG CTTTAATACA TTTCTCTTTT TCTGAGAAGG CTTGAGTCCA
AAACTCTCAG TTACCTGTTG TTCTGTTTCC CGTTAGTTAA TCTCCGAACC TTCATAAATT AAATCTGACA
AAGTCCCCTG ACTAACAAAG GAAATGCACA AGTCACAGTA AAAGGGGCAC ACACAGAACA CAAATAGACC
CAGGGTCTTT TCTGTTCATC ACTCAGCTTT TTATAGGAGA TCCAGGAGAA ATGAAGTGGA AAGGGAAGTG
TGTTGAGTTA CTATACAACA CAAGAGTAAA CTTTCTTATA AGTGGTAATT TTTTTTTACA GGAATAATTG
AAAATGGAAA TTACCTTCTC TACTCATAGT AAGTACTCAG TGCGTTCTTG ATGGGATGAG AATGTGTTTG
AGCTTTAGTG TAAGGCAGAA TTCTGTTTAG TCTGCCAGTA TTGGAGAAAA ATAAACACA AAGGGACTGA
CATGTAGGAA GTGGCACCTG GGAGGGTCTC AATTCTTCCT ATTACAAAAA TGCCCCAGAG AAATAAAAAG
CTTGTGTACA TGTTGAGATG GGAGAGTTCT CTGGCCCCCC TCGCAGGATG TGTGACAGTG GGGTGGCTCT
CTGCTGCGCC ACCATGAGCT CAAACCCCTC ATAGGAGGGG GAGCACACAG GCAGGAAGGT GCAGGAGCTG
GGCGAGCTCT TTGGGCTCTG GCCCCGTGGT ACTGTCTAGA GGTGGGTGCC TGCAACTCCT GAAAGCCCAA
GTGGGCATGT GTTACAGTGC ACTCTTTCAG CTTTGCTGTC TGCAGCTTAA GCGTTAACCA GCTCAGTTTC
TTCTTGGTAC CCAGGTCCTT GTCTGGCATC CAGGAAGAAT CAGGTTACAC ATGGACTTGA AGGATGAATG
TGGGAGTTTT ATGGAGTGGT GGAGGTGGCT CTCAGTGGGA TGGATGGGGA GCTGGAAGGG GGATGGAGTG
GGAAGATGAT ATTCTCCTGG AGTTTGGCTG TCCAGCAGCC GATCTCCTCT CCAGTCGTCC CCAGCCTCTC
GACGTTCAGA TGCTCCTCTT CTCTCCTTCT CTGCCATGCT GTTCTGCCGT TCATCTGCCT GTCTCTCTCT
GGAGCCTGGA ATTTGGGGTT TATATGGTAC ACAATAAGGG GCATGGCAGG CCAAAAGGGA ACTTTTTAGG
TGCAAAAAAC AGGAATGCCT CTTCTCACTT AGGGCTATAG ATTTTCAGGC TTGAAGGTGG GGCCTTTACC
AGCGAACCTG TATTTCCCTG TCTCCTGTGC ATATCAATGT AATCAAATAC TGGGCTGATC CAGGATGTTT
CTTTAGACCA ATTATGGGTA AAATAATTTA CATTCAGGTT TTTATATTTG CTTTTGTCAT TTCTTTTTAA
GCAATCATGT AAAATATCTA TACGACAGTA ATAGATGATA GCGAACCTAA TTAAAATTAC CAGAAACTTA
```

```
AGAATCTCTA ATGATTTCAA CTGTAACTAA GGTTATTTCT CTTTATGTTG AACAATGTTG GGAGATAAGA

CACAAGAGTT TCTGAAGTAT TTCAGAAACA CAAAGAGGGA GGTTATATAA ATAATATTTT TTTCCTACTT

TGGGAAAATG AAAGCTAGTC ACAAAGTTAA ACGAGTGGTT ATTTTAATAT TTAAAATACA GGCTTGGATG

TATTTCCTGT TAAAGAAAAT AAAATGCAGA ATATTCAAAA CGTCTGACCA CCCTTCTAAG AAAATGCATC

TCTGAGGTAT TTTTCCTTAG AAGTTATTGT AAAAATCCTG GAGAAGCTTG AACACAGCAA AGCAAACAGG

ATGCAGAGTT TAATCTGTGG AAAGCTTAGG GAAGAAAAGC AAATCATTAA AAATAGGTCT TCCTCTGAAG

ATTTTTAAAA CGCAAAGAGG GTGGAATAGC AATGATAATA AAAAAGCTGG CATAGAGAGT GGCACAATTT

GCTGTGCCAC TGAGCTGACT GGATGTGTTC TGAATTTCTA GGCATTAGTG TACCTTTCCA CACGCATTCT

CCCTTTAAAA AAAATGCCCA CACACTGAAT ACTTTTTTCA TGCAATTTAA AATAAGCGCA CCATCTAGTT

TACAGAAATT CACTAGAAGT TATTTATCCT AAAATAGCAG AGATCTAGAA GAATTTTGAG CTCTAGGACA

TTTTAGACAC ACAGAAAGAA GAATCTGGAC AAGTCTTGAC CAGACATGAC AGAATAGAAA TTTCTTTTCC

TATTTATCTC TTTGAATAAA ATTTTCAGGA TCTTACAGTG GACAAGTTTG TTATCTACAC ATTGTGAAGC

ACATTGATTT CTCCTCTGTA GCCTTAGGAA GATCTGAGAG GTGACTGAGC TGATTGAATG ATCCGTGACC

GCTCTACTGG GACCAGTAGT AGAACTTTAC TGGTGGAGAC CTGCTGGAGG TTTGAGAGCA GACTTTGAAA

ATTACTAGAG CTACACAGAT ACTGTGTGGC TAACTGGATT ATGTTTAGAG GCTTTCAAGA CTATGCTGCT

GCTGCTGCAG TGTAGCCAGG ACGCACAGAG AACATCTAAG GCTCTTGAAT GGGGCGATAG GGACAGATTT

CAGCAGCCAT CTGACTTCAG TGCTCATTTT GATGCTTTCC CTGCAGGGTG CAGTGTGCAG TGTGCAGTGT

GCAGTGGTGG GAGGCTCACA CAGGAATACT TGCTTCTGTA GCCCTAATTT CCGGTTCAAA CTCTGCATTC

ACCTTGACAG ATTCTTTCCT TGGCCAAAAT TTAGTTAGGC TTCTGGGCTT TCTCTTATGC CCACCTGCAG

ACTTTTTGGT AAAATCCAGT TTTAGTAAAG AGCTCTGCTA AGTCAGTTTA GCAAGAATCC CCACCTCAAA

AGTCACTATC TCCCTCCCTG GTAGTGTCTG GCTTGTCTTC AGCGAGAATT CTATTAGGTT CTGTTAGATT

AGAATCCTCC TTACCCTTGA TGCTTCCTCT TAGTATTTTT TCATCCACTG ACTCCTTGAC CCACCTTGCT

CCTCGGCTAT AAATTCCCAC TTGCCCATAC TCTGCAGTTA AGACTATTTT CTCCCCACTA CTGCAAAATC

CCATTGCCAT GGTCCCTATA CTATCTCAAT GGTAATGAAT AAAGTCTGCC TTACCATGCT TTAACAAGTA

ACATTGAACC ATTTTTTTCT TTAACAATCT GCTGCACAAT GAGATTACTA AAACTTTATT CCATTTTGCC

ATGCTGGATG TCCTCAATGG AATGGCTCTT GTGAGCACCA AATCATTGTG AGAAGGAAAA CCCATCTCTT

ACAGCCCCCT GTAACGTGAT GTATGTTACA TGTGATGTAT GTTACATAGT TTTTTTTCAT GTTGATCACT

TTTTGCCCAT TTTCCTATAT CTTATCAGTT GGAAGACTGT GGAAGTTTGT AGTACTAAGC CACAAGATGA

CTAAGAAGAG TTGAAAGGGC AAGTGGGGCT AAAAACAGAT TTTGTTTGAC TTACCCCACC ATTCCCCCTA

TCATGGGGCT GAATCTGCCT GGAGGAAGGA GCATCTTTAT CTTTGTACTG TGAACCACAC AGTCTAGCAG

CAGCACAGCC AAGGCACTTG GGGTTTCATG AGACTAAGTA CATGCAATTC TATTGTAAAG GCTTAAAATA

TATACAACTG ACCCTTGAAC AACATGAATT TGAATTGCAT GGTCAGTTAT ACGCAGATTT TCTTCCACCT

CTGCCACCCC TGAGACAGTA AGATCAATCA ATCCTCTTCC TCCTACTCCT CAGTCTACTC AAAGATACTT

GAAGTCTACT TGAAGATGAC AAGCACAAAG ACATTTATGA TGATCCACTT CCACTTAGTG AATAGTAAAT

ATGTTTTCTC TTCCTCCTAA TTTTTTAACA CTTTCTTCTC TCTAGCTTAA TTTATTGTTA AGAATACAAT

CTATAATACA TATGACATAC AAAATATGTC TTAGTTGACT GTTATGTTA TCTGTAAGGC TTCAGGTCAA

GAGTATGCTA TTAGTGGTTA AGTTTTCGAG GAGTCAAAAG GTGTATGTGG ACTTTCAACT GCAGGGGGT

GGGCACCCCT GCCCCCATGT TGTTCAAGGG TCAACTTTAC TGCCAAAGGC AAGCCTTTAC ATCCACTTTT

TCCATCCCAT CAGTAAATGG AAAAAGATAG CTACAGTATC CCTGCGTCAA ATCTTTTTTT TTGCAGATCA
```

-continued

```
CAAATTGGCC ACTCACCTTG CTCTGTGAGG GGTAAAATGC CCCACTTTCT TTAGTAATAT TTAAGTTAGA

TAATATTTAA GTTATAAAGT TGTTCTTTGT AATCGTTAAT TGTAATTTTT ACATAGTTTC TTTCAAACAG

AAATAGCATT TTTGTTAGAT AACCTCCCGT ATAGATGATG AAACTCCTTT TAAGGGCTAT CTGAATTTTA

ATTCCTTGAA AAGGCAGAAA TTGGATAGCT AGTAGTCATA AATGTACTGT GGCTTCCCCC AACCATCTGG

GCTATATAGA AGCTGCATCC TTGGACTGCA GTAGAGGAGT CTTACAAAGC ACAGAGCAAC TTCTCTCCTG

GGTTGCGCTA GTTATGATGG CAATTTTAAA TGTGTACTTT TACCCAAAGA AAATCCTTAT TATCAACAAT

CACAATGCCA TCATAACCAT GGTATAAAAA ATTCAAAATG TCCCAGCTGA AGTGGAGGCA AAGACTCAAG

TTCATGGAGT CAGAGTTTCC TTGCTATTCC TCTTTTTCAA ATGACCATTT AGTAAGCACC TGAAGAAAAT

ACTATGGACG GCATTGAAAA GTGAAGATAG GTTTAATCTT CTCGAAAATC TAATTCTCCA GATGAAACGC

TGACACTTAT CCACCCCACA GACCCTATAG CAGATGTGTC ACTGGCCATC ACATTTGACA CAGAGAAGTC

ATAACTCAGT CAGCACAGAG ACATTTCCAT GAGTTTCTGA ACCATGGACA GAACGTCGTC TGTGGGACAT

GAAAACTGGA ACTTAGAGGA CAGGCACATC TGAGAAATGG GCAGTTTAAA GGCAGAACAT AGCACATATG

TGACTGGGTT TTAGAAGCAA ATTTACAAGA CGCACTCTTC TTCATCCTAA ATAATCTGCA ACCAAAGCTT

CCAAAAAAGA CAATTTAGGA ATGCAGAGGT GAGGAGTAGG GAGGGAATG GGATGAGAGA GAGTGGAGAT

TAATGGTGGG CAGAGCGAGG TTTAGAACTT AGTGGTTTCT TCAGGTTCTG AACTGAAATT TGTATACTGT

AAAGGCACAA ACACCATTTT TAACAAAAGT GAGCAGGACT TCCTATCTGG TTCAGAAAAT AGGTGAATAA

ATAGTACGAA TTATTAAAAA TAATAATTTC CACTTATACA TAGGAAACTT GATAGGAACC ATGATAAATG

CTTAACTCTT AATCTTCAAG GAACTCTGCT AGGGATATAA TATTATAAAT CTTGTTTTGC AGATGGAGAA

ATTGAATTTT AACCCAAGTT ATCATAACCC TTAAATGATT AAATGATACT GTTACATGAG AAAGCTGCGT

ATCTGTTTCC TGGATTTGTA GCCATAATTT GTGTCTCAAG TCCCTTTTGC TGCCAGCTAT CTTGGGTAGG

TGTGTTCCCT TTGGGCTGTT TGATACCCCC ACATTTATCT TTTTTTTTTC TCTTTTTTTG TTGAGAGAGT

CTTTCCCTGT TGCCTAGGCT GGAGGGCAAT GGCGCGATCT CGGCTCACTG CAACCTCCGC CTCCTGGGTT

CAAGTGCTTC TCACGATTCT CTTGTCCCAG CCTCTCTAAT AGCTCGGATT ACTGGCATGC ACCACCACGC

CCACCTAATT TTGTATTTTT AGTAGACAAG GGGTTTCTCC ATGTTGGTCA GGGTGGTCTC AAACTCCTGA

CCTCAGGTGA TCTGCCTGCC TTGGCCTCCC AAAGTGCTGG GATTACAGGT GTGAGCCACC ATGCCTGGCC

CCAAATTTAT CTTTAATGCC CCAAATTATC TAGTTCCCAT GACTGGGCTT CTGCTTTGAT CCTTTCTGCA

CTTGCTGGAC CCTCTCCCTG GGAAATGAGA TTGTGTCCTG AGCCCCTAGT TAGAGGCTAT GTCTCTGCTG

TTCCTGAATG GGCCTCCTGG ATGAGACCTC ATTAAAAGTC TAATTCTCTT GGAGAATTGA GAGATACCTA

TTTGTCTCAA AATCATTGAA ACCAATTAAT GTATTATGAG CCTCTATCCA GTGATTTGTA CCTCAATTCC

CCAATCCAGC TGTCAAGGCC AATTTGTTCT ACCTTACCTA GTAGGTAAGT CTGGAATTGT AGCTGTGGCA

TTTTCAGTAA TGGTACTCTA GGTTAGCAGT CCCCAACCTT TTTGGCACCA GGGACCAGTT TTGTGGAAGA

CAATTTTTCC ATGAAGGGCT GGGCAGGGGA GTGGTTTCAG GATGAAACTG TTCCACCTCA GATCATCAGG

CATTAGATTC TCACAAGGAG TGCGCAAGCT AGATCCCTCA CACATGCAGT TCACAATAGG GTGTGCACTC

CCATGAGAAT CTAACACCGC TGCTGATCTG ACAGGAGACA GAGCTCAGGC AGTAATACTC ATTTGCCTAC

CGCTCACCTC CTGCCGTGCA GCTCAGTTCC TAACAGGCCA CGGACCAGTA CTGGTCCACG GCGCAGGCAT

CAGGGACCCC TGTTGCTAGG TATAAGCATC TGGCTGCTGC ATGTCTTCTG TGTAGCTACA TCTGTATGTG

TATCTGATGA GATATAAATT ATTTGATTAT AAATTACTTT CTTCATATTA GAGTTGTGAA TGAGTATCAC

ATATAATTAT ACATAAACTA GGAATATGCT TTTTAATAAT GTATATAAGT AAGTTTCCTT AACTATGACT

TTCATCTTAG CGTAGTAAGA GGGTGCTAAG AAATATTTGT GATGAAAATA GGCATTGGTA GAGTTGAGAC

CACTGGGTGA TGAAAGAGTG TAAAGATTTT AAAGCCTTCA GATGCTGGTT CAAGGTGAGA AATGTGATTG
```

```
GGAGCAAATC AATTAACTTC TTGAAGTCTT ATAGGGCAGT TATGAATACT TAATGTTAAC ATATGTAAAG

CTCTTCTGCC CTGTATACAG TAAATGCTAG TTAGCTATTA TGATCACTAC TAAAATGGGG ATGACATAAA

CCTCATAAGG TTTTAAGTAT TATGCAAGAT ACTATACAAA GTCCAGTAAA TATCACATTC AATTGAATCC

ATGATGTCCG ATTATTTTAG CTACTTCCAA GAGAGAAAAA AATGCTGTCA GTTTTACTGT TCTTATAGAG

AGCAAGGCAG ATCCCAATTC CCAATGTGGT AACGTGAAAA TTTTTGCATT TGAATCAACA AACACTTTC

TCCTTTCTTT CCTACTATTT AACAACTGGT AAGTCTATAC TCCCCCAAAT CTGGAATTCT CCTTTCTTAT

TCTTTTTCCT CCTACCAAGA CCGCAGGATC TTTTACTTGG CTATAAGGGG TAAACCTCAA GTAGTACAAG

TTCTCTGTAT TACTTTTATA CTCTGTCACA GATTCCCTTT GTTTCCTCAT CTCCATGTGA ATTTAGTTAA

ATTCTCAGCA TTCTGATCCT TACTATACAA GGTAAATGAA TATAAAAACA AAACGAAACA AAAACCTCTT

CCTATTTACA TAAGGCCCCA ACCTAATATT TAGTGATATA TATTAATGTG AACAAGGAAC TAACGAAGAC

TGGGAAGAAA TTCACAGACT TGAGAGAAGA AATGGCAGGA TTTCCTGGGA ACAATTTCAT GTAACGTCAA

AGGTGGTAAA AGGTCAAATA GAATGAAGAT GGAGAATACC GGATTTTCTT ACAAAATGAT TTCCCAGGAG

ATCTCATCAA ATGCACGAGG ATACCTTCTC AGTTTCACCT AGTGAGTAAA AGACTGGTAA CATAGCTCAC

TTACAATTTG GATAAACAAA ACTAAACAAA CAACATCAAA ATTTCAGAAA AATAATAGC AAAACAGAAA

TCAAACACTC AAATTTTTGG TCCTTCTGTT TATTTCATTT TGGATACTCA GTGAATGTTA ATTAACCAGG

AAACTTAAAA GTTATTTCAA TTATGAACCT CTTCAATCCT TCATCAATTA TTTTGAGTAT TCTGGTCTTA

AAAACATCTC TTTCTTCTAC AAACTTCTGA AAGAGATGAA CACCTCCACC TACACCAAAA TAATGTGCTT

TGCTGGCCAA AAGTACACGT CCATTTTTAC TTAACAGTCT AAGGAAAGTC TGGTGCAAAT TACTATAATA

ATCTGGGTTG TAAATGGTTT CTGAGGTGAG AATGAGATCA TATTTTACAA AAAGTTTTTC ACTACTTAGT

ACAAGCTTAC AAAACTCAGA CCACTCACCA GAAAAAAATC GGCATTTATA TAGTTGTGTT ACTTTTGGTT

TCCTGCATCT TTTCACATCT GGCTCATTTA CATCATTTTC TTCATCTTCC AAAGTGGAGT TAGCTACTAC

ATTAGGTAAG GTTACTTCAT CAATCACCAT ACTGTTATAA TCTTGAAAGT GAATTTCTTT GGACCCTCCC

TTGAATGCAG TTATACCTAG TAAACCTGAT CCACAACCAA GATCCAAGAC TTTTTTCCCA GCAAATTTCA

CTTTGGCCTT TGTGAAATAA GCCAGGAGGT CAAAGGTACA TTCCCAGATT TTTAAGCCTC CCTCATAAAC

ACCTGTAATC AGATCAGAGT GAGAAGAAAA GCTTTTTGAA ACTATGTTTT CTCCAGGGAA GTTCTCTTTC

AACAAGATGG TTTTCACTAC TGATAACTTA ACATGCTGGA AACCTGGTAA TGTTTCTATG ACTTTATTTT

CTAACATCTT CTTTAAATCT TTAGGCATAG CATGCTCTTT GGCAGCTCTC AAGGAGGGCT GTTTTCCATG

TGGCTCCAAG TTCCTTGAAC TGCTGGCTGC ACTGAGTGGA CTGTCTGTGT CTTGAGAGGG AGCTGCATTT

TCCATTGACT TATGTTCCCA CAAGTGATCC TGAGGCAAGT CAAATTGTTC TGCAGAACAT TTTCTGTCCC

TCTCTTCTCC TTTTTGACTT TCTGAGACTG ACAGCTCTTT TGAGGAATCC AGGGTCAAAG CTCCATCTCT

AATGGGTGTT AATTCATTTT CCAGATGGTC TTCTATAGTG AAATTAAACT GAAAGGTCAT CCTCTTATTA

AATGCACACA ATCTTTAAAT TCAGATTCTT CAACTTCTGG ATAGAATTTG ATGATACACA CAAATCTGCC

TCAATTATTC AATTAGTTTT GTTGGGCCCA ATTTCTCTTT AGCAGCTTAT ACATGGTAAC AAATATTTAG

AGATATTTCC AAATGACTTT TTAGACGTCT TTGGTCCTCT TTCCAAGCAG CTCTGGAAAG AAAAAAAAAA

AAAAAGAAA GAAAATGATG ATTAAAGCAA AATGGCACAT TTCACTAAAG TGTAATATTA AACAGCCACC

CCCACCCCTC CCTGTCCCAC CATACAGCTG CTTTTTCTTA AAAGTTGTG GGAAGAGAG AGAGATAAGA

GATTTGGACA CTCATACACA CCTTAAGGGT TCCAAAGTGG GAGAAGAAAA TCAACTATAA AAACAAACAG

AAGAACAACA GCAACCACCA CCCACTACCAC CTGGACAAAC ATAAAGTCCA AGATATTCAG ACAGGACAGC

CTAGCTACTT GCTGTCTTTC AGCTGTCTTG ATTTGTGTCC AACCATATTC ACCCCCTAAG CTTCCAGAAT
```

-continued

```
AACTTCACTT CTGTCTTTTA CAGAAGAGGT GCAGTATTTT ATTTTGGTAA GTCAGCGTCC CTTTAAAAAC
ATGCATAGGT ATGGCCTGGT GTGTGTAAAT TCATCCAAGA CTTCACTCCA AACATTTAGT CGAGAACAGC
AGCCCTAAGT GTATAGAAGT GGGGGTAATT TGGCAATAAT TAGTAAAGAC TAATTCGGTG GCAGAGCAAA
CGCAAACTAG GGCACTGCAG TAGTTTGGAG AGACCTGTAG AAATAAGAAG CAACTTTATT GAGAATCTTC
TATCTACTGC GCTAGACACT ATACCATTTG CCTCAATTTT CACAGTTCTG GCAAGTGGGA TCTTTGTTCC
CTTTATACAA GATTTACAAT TTGGGGGAGA GGCGGGTCAC CCAGTCCCGC GGCTAGGAAC GCGCCTCTTT
CCTCTCCCAT CACGCTGCAA GGCTTGGAGT CACTTCCGGC TGCAGGTCCC GGAACAAATC CGACCCCAGA
AGTGGGGACT TCTGGCCCTC ACCTCCCCAT TTGAATGTAA TGTTTACAGT GATCCAGACC TGGGGATGCT
TGCTTCCCGA CGTGTCCTGG GATCGCGCTT CTGAAAAAGC TCACCTCACA ACGCCTCCTC CGGACCTAAA
TCGCGCACCA GTGAGTCGAG TCCTCCAGGG GCTAGAGAAG CCCGACTTTC TTTCCGGCCT TGAGGGACCC
GGGCTCACCA AGAAACCAGC CGCCCTCCTC TCTATGGTTT TGGAGCCGGC GGAGAGCGCG CAAGGGTTGG
CGGGACTGCG AGTTTCCGGT CTGGGCTTTG GCGGGTCTGG TTTGAAGCTC TCCTGTTTGA CGAAAGTATG
TCTCAGGAAG GTGCGGTCCC AGCTAGCGCG GTTCCCCTGG AAGAATTAAG TAGCTGGCCA GAGGAGCTAT
GCCGCCGGGA ACTGCCGTCC GTCCTGCCCC GACTCCTCAT ATCCTTCCTT GGTTGTCACT TCTACCTAGA
GAAGGGTGTG GGCGGGTCGC GAACCTTTCT CTTCTGTCCC TTCAGACCCA CCGCCAGGCT GGGTTATATT
ACCGCGGCCT GAACCCCCTC TTTTCTTTGT CAGTGAGTGG GATGAAAAGT GAGGGACTGG AGGGGAAGCG
ACAACCGTGG TAGATTTAAG TAAGGCTTTG GCCCTGGAAA GCCTCGCGGA CGTGTTCTGA CCCAAGGTTT
TAGCAGTGGA TGTGGCGTTT TCTTCCATTC CTTCTTTCAG TTTTTCTGTA CTCGTTCTT GCAATTAAGT
GTAAATACTT TTGCTAGTGG ATAATGGGGG AGGCAAGGAC TGAGACCTGC GGTATGACGA TAGCTCTGGC
TCTTAATAGT TTGAGGTAAA GCGAGATACT CTGAGCTTTT GTCTCCCGTA AAAAGGGTGG TGAATATGAA
TAAGGGCTTT CTTAGCGTTA TAAGAATTAA AGGGCATAGT TCTGTGGTGT GAAATCTTTA AAAGATGTTC
AGTAAATAAA AATGATTTTC CTCCTTCCCC TCTCAGACCT CTTTTTCTTC TTTCTTTCTT TTTTTTTGAC
AAGTTCTCAC TCCTCTCACC CAGGCTGGAG TCTTTCTGAA AGAGTTCTTC CGCTTGTTGT TGGCTTTCAA
CTGTTGGATT TGAGGCGCTT AGCGCCTTCT TCGTCCGGGT GCAGCACATT CTTGATTGGT CTCATGCCTT
TGTGGTTGTA AATGTGCCTG GAATCCTAGC CTTTCATGGT AAACCATATG TATATGTATC TTTTTCACAA
CATTTGAGCC CAGCTTTATA CAATTACACT CAAAAGAAAA AAAGTAACCT TCACTTGAGA GAATCTCAAT
ACTGCACAAA TATTGTGCAG CTAAAGCCCT ATGTAATCAC ATAGAAGTCA TTCACCTAGG CATTAGCAAA
ATCTCAGAAG GTGCCAAAGC CCCCTTTTTT AGTTTTGTG TAGGTACAGA ACTGCCGTCT TCAAGGAGTT
TCAACTTGAA AACAAATAGC CACCCTCAAA ACATTCAAAA ACACTTAAAC TGCGTGCATA ATGTGTGTGA
GACATGGTGT TAGGCTTTGG GAGAACAGAG ACACGGAACG TGATTCCTCT TCTTCCCCAC AAGCTTATAG
AGAGACTTCA TTAAGTTGAA AGTCAACATT CCCACCTAGC TTTGCACTTC AAACGACATA TTCAAAAAAG
CCCAAACTTC CTCTAGTTTT CTTCATCTGA GTAAATGGTT TCACAAACTG AAACCTTGAA TCCTCTCTGT
CTCACACACC CGATCAGTAA GTTCTATTGT TTCTGATTCC AAACTATGTC TTGAATCAAT CCGTTTATCT
CCATCCTCAT TGCTACCACT CTGATTCCAA ACCCTTATCA CCTCTCACTT GGAGTATTAA TAGTTTCCTT
GTTTCTACTC ATAATTCATT ATTCCAAAAA AGTTAAGAGG GGAAAAACAT AGATCTCGTC ATTTCCCTTT
TTAAACCACT TTACCTTCAA GGTTCCAGGT GATCTAAGCC TTGCCCTTCT CTCATACCTA GTTAATTAAC
TACACTCTGT TCATGAATAC ATTAGGCTCA CCTACCTCAA GATCTTTTTG CTCAGCCTGA TTTGTTCTCT
CAGCCTTTTG CATATTTCAT GTTTATGTCT TGGCCCAAAT GTCACTTCCT TAGAGGGGCT TTTTCAGAGC
CTTCAATCTT AGGCAGTTCC CCCAAACGCA GTCTTACACT TGTATCACAT TGGCCTGTTC AGTTTTCTAA
AAAGCACATT ACCATTAAAA GAAATGCTCT TGTTTGCTTT GTATATTTTC CACTTCTACA CATTATGTTG
```

```
CAAAGTTCAT AAAGGCAGGA TGTTGATTTT CTTCACAGCG TTACCCTCAG CACCTAGAAC AGTGCCTGAC

ACATAGTAAG CATTCATTAA AGGGCTAAAA ATATTTCATG TTTTAAAAAT ACTTGGGAGT CTAATTAGAC

AATATTTTTT TTCAGCTTAA TGGTAGTATT TTAGCTTCAC TATTTTAACA AATGAAAAAT TTGCAATAAA

TCTACAATGC CATTACCCCC CAAAATCTTT TTCATGTTTT GCATTTTACG TATTATTTTC CAGGCCTTAC

CTGCATGTCT GCATAATCAT AACTGACTAA TTTTGGAACA GCTGGTAATT ATTTGAGCTT TACTGAAATT

TTTTCATGAG GCCAATTCTA CCCTACTGAA CTCAAATTTG AGTTAATGAT GACCTCATTT TGATTGCTGC

TGTAAAAAAT AAGATTTCGG AAGAGGAATG AATTCTTGTA TTACTGTGGT AGGACTATGG GTTTTTTTTT

GTTTGTTTGT TTGTTTTGAG ACGGAGTCTC ACCCTGTCAC CCAGGCTGGA GTGCAGTGGT GCGATCTCAG

CTCACAGCAG CCAGGTTCAA GTGATTCTCC TTCCTCAGCC TCCCGAGTAG CTGAGATTAC AGGCACGTGC

CACCATGCCC GGCTAATTTT TTGTATCTTT AGTAGAGATG GTTTCACCAT GTTGGCCAGG CTGGTCTCGA

ACTCCTGACC TCGTGATCCG CCTGCCTCAG CCTCCCAAAG TGCTGGGACT ACAGGCGTGA GCCACCGTGC

CCGGCCGGGT TATTCATTTT TCTTATTAAC ATTCTTTGAT GATTCTTATG GTGTTGTTAC AGTAAAACAT

TTCTAACAAT TATTCTAACA ATTATTCTTG ATGGTGTATA TGAAGAATTT ATTGTCGTGT ATTTGTAAGC

TGCTATGTGC AGAAGAATTT CAGTCAAATA AAGTTGGTAA GATAGGTATG TAAGTAATAT GAAAAAAGAT

AGAAGGTGAT GAGTGACTTA GGTATAAATT AAGTACAATA GAAATGTTGA GGAAAGAAAA ATTTCTTGTA

ATAGAAATCG GAAGTACAAA CTGGGCATGG TGGTGTGCAT CTCTAATCCC AGCTCCTTGA GAGGCTGGTA

TGGGAGGATC ACTTTAGCCC AGGAGCTTGA GGCTGCAGTG AGGTGTGATC ATGTCACCGC ACTCCATCCT

GGGTGACAGC AAGACCGTCT CTCTTTTTTT TTTTTTTTGA GACGGAGTCT CGCCTATGCT GGAGTGCAAT

GGCGCGATCT TGGCTCACTG CAACCTCTGC CTCCCAGTTT CAAGTGATTC TCCTGCCTCA GCCTCCTGAG

CAGCTGGGAT TACAGGTGTG CGCCACCATG CCCAGCTAAT TATTTTGTAT TTTAAGTAGA GACGGGTTCT

CACCATACTG GCCAGGCTGG TCTTCAACTC CTGACCTCTT GTTCGCCCAT CTAGGTCTCC CAAAGTGCTG

GGATTACAGG TGTGAGCCAC CCCACTTGGC CCCGAGCGAG ACCCTCTCTC TAAAAAAAAA TAAATAAATA

AATCATAAAC CTGTGGATTA TTGTAGCATT GTTTCTCATC TGTCAAAAAT ATTTCATGAC TATGCATAGT

TTGAAAAGGC AAGTTTGTCC CTGGGCAATT TTCAAAATAT TTCTTTAATG TGTTTTCACA ATACTGTTTA

CCTAATAAAT CTTAAGTTTT TAAAAGCAAA ATTAAGCCAG TAATTTGAGT CCAATTCCAA TCTCTTATGA

GTCATTGCTT AAATTTCAAA AGGGTTTTAT TTTTTTTTTA GGTTTGTTCT GAGTAATGAA TACCCTATTA

CTATGATACT AGTATCTTCC TTAATTATCC TACTCATTGT CTCAACATTC TGACAGTTGG ATTGAGCATA

TTCGTAAGTA AAATTGTTTT AACTGTATGA TGTACTTTGA TGTTAAGGTC CGAGTCCCCA CATACCTCGG

TAGATGTGTT CTTACAGTTT TGTATTCCCT TGAAATGTAA CTGTTCTCTA TGTTACAGCC TTTATAACCT

TCAGTTACTT GAAATGAACA AATTCATTCA AATTCCAGCA CTTAAAAGTT TTAAATTACA TTTTGGATAA

ATACCAAAGT GTTTTGTTGA TGATGTATGT ATAAACAAAT TGTAAATATT AAACGTTAGT TGTTACGATT

AGACCTATAT AAAACATGAT ATGCAGTCTA CTGAATAGCT ATCAGCCTCT AACATGTTTA GTGTCATTTA

GAAAATGCTT TCTAAATTGC CAAAAGCTGA TTGTCTAGGT GATAACAAAT TTACCATTTG GAGGAAGTTG

ACTTTCTCAT TTTCATGTCT TCATCAGTCT TACTTGATGA GATTCATTCT TCTAGTCAGA AGAGAGTTTA

GACTGCTCAG TTTACTCATA TTTTGAGTTA GCTTTTCTAT TTAGAGTTCA CTTGGTTGTG AATATTCAT

TTATAATTTG AATCTACGTT GTGTAATGGG ACCTAATTTT TTTTTCCTTT GTTTTTGTTG GAGTCTCGTT

TTGTCACCCA GGTTGGAGTG CAGTGGCGTG ATCTTTGCTC ACTGCAACCT CCACCTTCCA GGTTCAGGTG

ATTCTCCTGC CTCAGTCTCC CAAGTAGCTG GGATTACAGG CATGCTTCAC CACGCCTGGC TAATTTTTGT

ATTTTTAGTA GAGATGGGGT TTCACCATGT TGGCCAGGCT GGTCTCAAAA CTCCTGAGCT CAAGTGATCC
```

```
TCCTGCCTTG GCCTCCATAA GTGCTGGGAT TACAGGCGTG AGCCGCTGAG CCTGGCCCCA GAGTTTGTTT

TGTTTTGTTT TCAAGACAAG ATCTCACTCT ATTGCCCAGG CTGGAGAGCA GTAGTGCGAT CATAGCTCAC

TGCAGCCTGA ACTCCTGGGT TCAAGCTATT CTCCTGCCTC CATCTTCTAA AGTGCTGTGA TTACAGGTCT

GAGCCATGAT GCTTGGCCTG TGTTTTTGTT TGTTTGTTTT GGGGGACAGG GTCTTGCTTT GTCACCAAAA

CTGGAGTGTA GTGGTGCGAA CATAGCTAGC TCACTGCAGC CTCCATCTCC CACGCTCAAG CAATCCTCTC

ACCTCAGCCT TCCAAGTAGC TGAGACCGCA GGTGCGTGCT ACCATGCGTG GCTAATTTTC TATTTATATA

TTTATTTTTT GGTAGACATG AGGTCTTGTC ATGTTTCCCA GGTGGTCTTT AACTCCTGGG CTCAGACAGT

CCTCCCGCCT CAGCCACCCA AGTGTTGGG ATTACAGGCG TGAGCCACCA TGCGTGGCAT AATTTTTTTT

AAGTAAATTA TTTTTTTATC TTGAGTATAG AAGTGATTCA TGTTCATTGT GGAAAATATG AAACATATAG

AAAAACAGAA AAGATTACAA AACATCTAAT CTGAAATGGT TAAGATTTTG ATGAGAACAG TCTCATCTCA

TTTCCGTATA TTCCTGCCAG CCTATCCATC ATTCTTCGTA CATGTTTATC TACATTAAAA TTGGTGTTAT

ATTTTGGAAA CTTTTTGTTT AACTACATTG TGAACATTTT TCATGTTTTA AAATGTCATT TTAATGATGG

CAGATCCTAT TCAATAGATG TACACACACC TATTTAACTG GTCCACAATT GTTGGATATG TAGGTCGTTT

CCTTTCTCTC TTTTTTTTTT TTTTTGGCTA CTACTTAATA GTTTCTCTGT ATAGAATGTG GTATTTTGAA

AGTGTATCAA GCTTTAGATT GGTAGTATTC TTGCATTTAA TAAAGGGCAG TGGCCTTTGT TGACTGACAT

GACAATATTT TTATAAAATT TGTTATTTGC TTTACAGAAA TTTTGAAAAT TATTGTAGAA ATGTTTTTAC

CTCATATGAA CCACCTGACA TTGGAACAGA CTTTCTTTTC ACAAGTGTTA CCAAAGGTAT AATACTATTA

CCTGAAAATA CATGTTATAA GGAATCTAGC CTCAGTCTTA GATGATTTAT TATTAATTAT GGCTCTCTTT

TTCTAATATA TCAAATATAT TCAAAATAAA AATAAGGAGT AAGTAGATCT CATGTGAGAC TATAATGGTG

TTAGTGTGAT CATTAGGCAG TTAAAAACTG TTACAGGCTG GGCACGGTGG CTCATGCCTG TAATCCCAGC

TCTCTGAGAG GCTGAGGTGG GCAGATCATC TGAGGTCAGG AGTTCGAGAC CACCCATGGT CAACATGATG

AAACCTCGTC TCTACTAAAA GTACAAAAAA TTAGCTGGAC ATGGTGGCAG GTGCCTGTAA TCCCAGCTAC

TTGGGAGACT GAGACAGGAG AATTGCTTGA GCCTGGGAGG CGGAGGTTGC ATTGAGTCAA GATCGTGCCA

TTGCACTCCA GCCTGGGCAA TAAGAGCGAT GCTCCGTCTC AAAAAAAAAA AAAAAAAAAA AAGAACTTAT

ATTTTCAGAT TGTGTGGTTC CTTTACTAAC TGAATTTAAA TTATTTGTAG TCAATTTTAA ATGCTCTTGT

ATTTTAAAGC CACTGTACTC CAGCCTGGGT GACAGAGTGA AACCCTTAAT TCAAAAAAAA AAAAAAAAAA

AAGAAAAGCT GGAATATTGG CAAAATCAAG TAACTAAGAG AAAACATTAA ATTCACAGAA TACATTATTA

CATTTTAGAT ATATATGGTA TATGTTTTCT CTGAAAAGCA CAAGCATACC TTTTTTGTTT TAAATGGAGG

GAACTAAAGA TACTTTGGTG CCAAAATGAA ACATTATTTG TAATTAATCT CTTATTGAAA TGGGTTTCTA

ACTTTAGCTT TGAATCGTAA TCTTTCAAAT TTCTTGTACT CATAGTCACT TGATGATTCT CTATCTGAAA

TATTTCTTAG AATTTGTTCT TGACCACCAG AAAAAGATTC AACTGTTACA TAGATGAAAA TGGATGTTGA

GTGTTAACAG GCCATGGGA AACAGTATTT TCTTTAGCTA CATTGTATTG TTGACTGTGT TGCTATTCTT

ATAATGTTTA GGTCATTTAA ATTGTTAGAA AGATCCAAGT ATTAAGATCT AGGGTGGCTA ACTTTTCACA

GACAAAAAGC TTGTTTGTAA GGTCATTTAC TATACCCTTA ATTCAGGAAG GTTAGCTTGA ATTGGGTCAA

AAGGAAACTG GTTAGAAAAT AAGTGAGTAG TGAATAGGCG ATTCAGTGCA AATTCCTTCC AGAAAATACC

CTTGTAAATG ACTGTATGAA TGTGGATTCT TCAAGACAGT CAAATTTATT GTGCGAAAGT AATACTTTTA

TTTTTTGCAT CTCTAAAACA TGAACTTTGA GTGATTTTTT AAAAAAATTG ATGCTATTAA ATAGATTCAA

ACCATAGAAA TGGAAAATAA ATTTCTGTTT GGGGCTTTTG GGGGATTAT GTTGTAAAAA TACCTTTTCT

CTGTATTTTG TGCTTAATTA GGTACAATTG TTAAGCTAGA TGATAGCCTG TGGATGTTAC TAGTGCAAAA

TCAAATTATC GTATTGTGTT TTCTCTGTAA AGTTTTGTCT TGTCTTTTCT AGTGATTTCT CTTATTCCTG
```

```
TTTATTACTT GATTTGTTTT TACAGACTGT GAAATTATTC GATGACATGA TGTATGAATT AACCAGTCAA
GCCAGAGGAC TGTCAAGCCA AAATTTGGAA ATCCAGACCA CTTTAAGGAA TATTTTACAA GTAAGTCAAA
TGTATTAGAA AGCAGGAGAG AGAGGGAGCT TAAAGAATGT CAAAATTTTT ATACTGATAC TGATTAGCTA
TGTATTCTTA TGTAATGGCC TAATGTTGGA ATTAAATTTA TAGAATTAAA GACGTGAATA TAGAAACATG
AATTCTGAAT AATAAACTCT TATAAGAAGA GAAGTCATCA AGCTAGCTGA CCCTACCTGT ATTTTCAAGG
ATATGTGTGG AACACCTGCC ATGTGTTTTG AAGTTTGTGT TAGTATTCTA AATGGCTAGA CAGTTGTTCC
AGTATTTGTA GTTCTGATAG ACTAAAGTTC TGTGAAAAGA GGAAGAGACT GTGTTTTGTT CATTGCTGTA
TTTGTAGCAC CCAGCATGCT GACTAATACC TTTTCAGTGC ACAAAAAATA TATTCTAAGT GAAATTTCCT
TCCTTATTCA CAGACAATGG TGCAGCTCTT AGGAGCTCTC ACAGGATGTG TTCAGCATAT CTGTGCCACA
CAGGAATCCA TCATTTTGGA AAATATTCAG AGTCTCCCCT CCTCAGTCCT TCATATAATT AAAAGCACAT
TTGTGCATTG TAAGGTGAGT AAAGGTCTAA TTATACTTTG AATGGTATAT AATCAATGTG CATAGGGGCT
GAGTAAAATA ATGTTTGTAT AAGATTTTAC ATTTTAGTCT ATATTATTGA AATAAACTTT TCCATAGAAT
AAAGAACATG TAAGTAAATA ATTGTTGCAA AAAAAGTGGT TTTAAGGAAG TCATTAAAAG TGGCTTTTTG
GGGTTTTTTA GTTTTATCTT ATTTCCCCTC TATAAAGAAA GAAGTTTTAA GAATTTGTGT TGAGACAGAC
ACAGGGATCC TGAAATAGTT ATGTCATGTT GCATTGACCA ATATTCAATT ACCATTATGA TTAGATGTCA
GAACTTCCTT TTATAAAGGA AAGTTAATCC TTATTTAGTC CATCTCTACA TGCCAGAGGT AGCCTTGAGG
CACAAAAGCT TGCCTAGAAT TTATGGGTCA CAGACAGTTT TAATATTGCT ATTTGTTGGG CGAATGAAAA
TCACTAGTTA ATTAATACCT CTCTTTGCTG ATAGGATGCT AAAAATGTCA CGCACCTGGC CTAATGTTAC
CCTTTTTTAG TTCTGTATTT GCAAGATCAT GGAAGTCAGA AATAATATTT TATACATGCT TGCATCTCTT
GAAGCACACT ATATTTAATG GATGTTCACT AAACAATGAA TGAATATGTG ATTCAGTAAA TTTATGATCT
CTAATAGTAT GAATTAAAGT AAATTTGGCT CTTGAGCTTT GATTTGTTTT TTCTCTCATT TTTATTTATC
CGTAATCAGA ATAGTGAATC TGTGTATTCT GGGTGTTTAC ACCTAGTTTC AGACCTTCTC CAGGCTCTTT
TCAAGGAGGC CTATTCTCTT CAAAAGCAGT TAATGGAACT GCTGGACATG GTTTGCATGG ACCCTTTAGT
AGATGACAAT GATGATATTT TGAATATGGT AATAGGTGAG TGAAGAAAAC TTTCTGCTTA GTATATGGTG
ACTATAAATC ATGTATCAAT TAAAATTGTC TCTAATGATT CATGTTATTT TCTTACTAAT TATGCATTAA
AATTGATTTA AATCTTACCA AATAAATTTT TAATCTTGAA ATTTGGAATT TGTAAAATTT ATTTTGGGTA
CCTTAACCTA GATTTGCGTA TTTAGTTACT GTAATTTCTC CACAATGATT AACTTATATA ACTTTATAAT
CTCTGAGGTT GTCCATATTC AGAGACAATA ACTTTCACAT TTTTTTAACC ATAACTGATA TTGAGATGCA
GTTTATATTT CCTTCCAGAA TACATATAAA TACGTGCATA TGTGTATGTA AATATGTCTA TTCTCATATA
CATATTATAA TGAAATAACT CATTTTACAT GTGATGCACT TTATACTAGT TTATTTTTAT TTTATTTTAT
TTTTTTGAGA CAGAGTCTCA CTGTGTAGCC CAGGCTGGAG TGCAGTGGCA CAATCTCGGC TCACTGCAAC
CTCGCCTCCC GGACTCAAGC GATTCTCCTG CCTCAGCCTC ATGAGTAGCT GGGATTATAG GCGTCCGCCA
CCACACCTGG CTAATTTTTG TATTTTTAGT AGAGACAGGG TTTCACCGTG TTGGCCAGGC TGGTCTTGAA
CTCCTGACCT CAGGTAATCC ACCTGCCTCA GCCTCCCAAA GTGCTGGGAT TACAGGCATG AGCCACCGTG
CCCAGCCAAT ACTAGTTTAT TTTTAAAGAA TTGCTGGTCG TAACACACTT CATTGATTTT ATCACTCATT
AATGGATTAT GAACAAGAGT TTGAAAAACA ATATAAAGGC AAAGTTTGCA TTCAAAACTT TGGTATAAAG
AGAGTAAGTT GGTTTTGTGC AGTGTATCAG GCACCTGTTG CTCTGCAACA CACCACCTCA AAATCTATTT
ATTCACTATT TATTTATTCA TGATTCTGTG AGTCTGCAGT TTAGGGTGGG ATGTCCTGAG ACAACTTTCT
CTGATCCACC TGGGGCACTA GCTCACCCAT GTGACTTCAG TGACTTCATT CACATCTGGC TGTTGGCAGA
```

```
GGCAGAAGTA CTTGAGAAAG CCATGTGCAT CATCCAGCAG GTTCACCCTA TCTCAGATAC CTGATGCCAG
TGGTTTCAGG GTTTCTAAGA GTAGCAAAAG TGTGAGCAGG TCGCTGTGTG CTAGCACTTT TCAAGTTTCT
GCTTGCCTTA ATTTTATTAT TGTCCCCCGG GCCACAGCAG GTCATAGCGT TTAGCCCAGA GTCATTGTAG
AAAAGTGTGG ATTCACAAAG GGCAGTCATT GTGGCCATTT TTATAAATAA TCTACCACAG ACTGAGTAAA
AGCCTTGCAT GAATACCATG GATATTAATT TGAATTCTTC CTTTTTAGAT TTTCTTTCCT TAGCAATTTG
TTTTGTCATT TTGGATTAGA ATTATATCTG TAGAATATTT CAGTTATAAT AGGGTACAAC TTTTATTCCA
CTGAACATCT TTAGTTTTAT TTAGGTCATC TGGTAGGTAT AAACTTCAGA AGTTAATATT CAATATTTAT
AAAAACCATT AACAAGTGTG ACACTTAAAT AGTTTAAATA ATTCTTTTGA CACAACTGTT TCCAAGTTGT
GTTACGTATT TTAATTCAAT CAAATGTTGA AATTGTTCAG TAGATAGTTT TAATTATAGG AGAAACTCAC
CCCCATGACA TTTGGATGTC TTAAAAGTTC TGTTATCTTT CTTTGCAGTT ATTCATTCTT TATTGGATAT
CTGCTCTGTT ATTTCCAGTA TGGACCATGC ATTTCATGCC AATACTTGGA AGTTTATAAT TAAGTAAGTT
TGTTTGTTAT TTTTTACTTT TTAGAAAATG TTTTCCATAT TCCCCAATCT TAATTATTCA TGATTCTTTA
GATTGCATTT AAAACATTTT GTGTGAATTT AATGTTCACT GACACTGCTG TCTGATAATC CAGATATTCT
ACATGTAGCT CTCAAGCCAA ATTGGACTTC TTTACCCTGT GGCCTCTAAA ATTAAAAAAA ATGTTCTTCC
TAGTTAGCTA GTACTTCAGA AATAATGGGC CATGGGCCAG ACTAGAACTT AACCACTTTT CTTCTGCTAC
TGTTGTTTAA CCAGCTATCA AGTATCCTAT TTCTAGGATT AGATAAATTG ATAACTATAA TTAAAACTGA
ATATAATCTT TTCATTAGGT ACTTTTAAGT TGTTCACACT TAATTCCATT TGTACAGTAA TTTTAACTTT
CTGAAACTGA AGCATTTTAA AGGGTCACCA GGGATAGTGC CTGTAGCATT CATCAGATTC TTAGGGGTGA
GAGGAGATGT GGTTGAGATG TAAAAATGGT TAAGAATATC TACTTTATAC ACATACATAA AACATTAAAG
GTCAGTGTAT TTTCAGGTCT TAGGTACTTT TCTTGTACTA CCAGGACATT AAGTTGCCAT TCAGTGGTTA
AGAGTGTTGC CTGGGAGCTG TATCACATGT GCTTAAATCC ATTCTTGAAA TCATTTACTC CTTCTGAGCC
CTTGGGCTAT TTGGTTAATT TCTCTGAACG TTAGTTTGCT CATCTGAAAA TGGAAATAAT AATAGCAACT
TCTTGACAGG GTTATAGTGA GAATTGAGTT CATCACTGTG AAATGCTTAG AAATGTGCAT GACACATAGT
TAATACTCAA GGAATTAGCC ACATCACTAT CATCATCACT GATTATCTTC CACTCTTACC CTCTTCCAGT
TCATTTCTG CCCAGCAGAA TGATCTTTTA AAAAGTAAAT CAGATCATGT TACTCTATTG CTTGAAGTCT
ATCCCATTTG ATTAAGAATA ACAACCTAAT CCTCTGTGGA TGCTGCCTCC TTCACCAGCC TGTCTCATGC
TGCTCTCCCT ACTCTTAGTT CCTCAAACAT ACCAAACTCT CCTGTCCCAG AGTCTTTTCG TGGTTTTTCC
ATCTGCCTAG GATGCTTCTC TCTCCTATTT TGTGTACCTT GCTAACTCCT GCTTACTGTC TTTCAGTTCT
CAGCTTAAGA GTTATATCTT CATGATAACA TTCTTTGATA TCCTTACCCT AAGATTAAGT TAGATTGATA
TCCTTACCCT AAGAATAAGT TAGATTAGGT CTCTCTATTG TAGCACCTTA GACTCTGTCA TTTGACAAAT
CACAGCCCTA ATTAATTATT CTTAAAATTA TTTAACATTC TCTCTCATGC TAGACCACAA GTTTCATGCA
GGTAAGGCGG AGATTGTGTC CATTTGTTTG ACCCCTTTGT CTCCAGGGCC TGGTAGAATG CCTCATACAT
AGTAAGAATT CAATTAATAT TTTACACAGA GAAAAAATTA GCAACTTATT TAAACAAATA TAACTGCTTC
AGAGGTAAAC TGGGCACATC TTAGTTATAT TATGTGATAT ATGATGCTTT TTGATTGTTT TTTTAAATGT
TCTACAAGGT AGATATTGTT AGAGGTCCTA AGTTACTTGA TGTGTTACTT GTGGTGATTG TATTCTTTTC
TTTTTATTCA TTTAGGCAGA GCCTTAAGCA CCAGTCCATA ATAAAAAGCC AGTTGAAACA CAAAGATATA
ATTACTAGCT TGTGTGAAGA CATTCTTTTC TCCTTCCATT CTTGTTTACA GTTAGCTGAG CAGATGACAC
AGTCAGATGC ACAGGTAAAA TTTGGGCTAA TAGCATTTTA AACAGCAACT CTTATTTTCT TTGGCAGTTA
GTAAATCTCA TTTGAATGTC TGGGTCAGTC TATTTAAGAG GATTTAATT TATTTCATTT GGGTGTTTTT
TTTTGATCTG TGGGATTATT TATATCCCAT AATTACTTTT CACCCAGAGC ATTGTATTAG ATTCCTAACT
```

-continued

```
GCTGTCATTG CCTCTGGGGT CTGCCTGGCT CCCTCTTTGC TTGGTAACTG GTTGGTCACA GCATTCTTCT

CAGAATCCTT TCATTCTTTT CTGCATGAGA ACAAAAATTC TTTTGTTCAT ATTTGTATAA GATCTGATAT

AGCTGCAATC AATCTTGCAT TTTTTCTTCA CCAACGCATT GCGACCTTTA GGATACAAG  TATGTTTGTG

CATGTATATG TATGTATCAG TCTTTTAAAT TTGATATAGT CATACATTTG TTTTTATTTT GAAAAGTTAG

AGTGTTGAAT TGGTATCCCA TTTATGAAAC ATTATATTCT AAAAATTTGT AGTACGATTA TTGGGAATTA

TAACTCATTT TCCTGTAACA CTGTTATACA TAGTACCTTT TGCTTTCAGA CTAGCCCTCA ATTTTATTTA

ACTATAGTAG TCCTAAATTA TAAGATTAAT AGTACTCAGG ACCTAACAGT TATATGTCAT TTGTTTTTTT

TTTTTTTGAG ATGGCGTCTC ACTCTGTCAC CCAAGCTGGA GTGCAGTGGT ATGACCTTGG CTCACTGCAG

CCTCTGCCTC ACGGGTTCAA GGGATCGTTC TGCCTTAGCC TCCTGAGTAG CTGGGATTAT AGGCGCCTGC

CACCACGCCT GGCTAATTTT TTTAGTAGAG ACGGGGTTTC GCCATGTTGG CCAGGCTGGT CTCGAACTCC

TGACCTCAGG TGGTCCACCC GCCTTGGCCT CCCAAAGTGC TGGGATTACA GGTGTGAGCC ACCGCGCCCA

GCCTATATGT AATAATTTTA ATGGGACCAT GAATTGAATA TTTCTTCCTT GAATAGCAAT GACATAGCCC

CTTCTATTGT ACATCTGCAA GCTGATACAG GGAATTCCTT TGTACCTGCG CTCTTCCCTG CCAGTCAGCT

ATGGGGGTGA AGTGTAGGG  GTTCATCCAA GTCCTAAAAC TGGTAGCAAC TCCTAGGGCA GGGCTGATCT

GGAAGGACAG ACCCTAGGGG AGGGTGGAAC TTTAAAAAGA AGTTCTGAAG GTAGTAAGAA GGAAATGAGG

AGTAGTGTTA GGAAGGGGCT AACTTTTTTC TTCTTGCTTC TCTTCTTTAT CTCACCTGCC CCTCCCCTTG

TATCCCTTCT TCCTTTTTCC CTTTCCTTTT TTGTCCTCAC TTCATTCGTG CATCCTTTCT GATTCCTCTT

ACCTTGCTAA AAGGAGAAGT TTGTTTGGGT ATCCTATATC AATGGCAGGA AGGTTGTTTT CTTCTTTACC

TTTATCCTAT AGATTCATAT TCTCAACACC AACCTCCTCC TTTTTCAGTT TCCTTCTTGC TTCTCTTGAC

ACCACAGAGT TTGCAGCTAG TACTTGGAGA GGAAAATTAA ACAGAGATAC TTGGACCAAG AGTAAGATGA

AGAAAGTCTA AACAACAGTA TAGTCTATAG TGGCAAGAGA GAGTATGGGG GCTGCTTAGC CAGGGTGGCT

GTACATAAAG TATATCTTCA GTTTATATAA ACTGCTTATA GATGGAAATC AGAAAATTTA AATTCTCTTA

ACTGTCCAAG AAAATTCTCA TTTTTTCAAA TTTGGGACTG ATAAATGTGA CCAGTTCTGC TTACTGTCCA

TTGCCTGAAA TGGAGCTTTG AGGTGGACTG TATAATTTCT TCAATCTTAA CTCCAAATTC TGATCAGCGA

CGCCCTCTGC TGTTCACTAT TAATATTTAT TTACCAATCA AAGTAAAGTA TTGAAGTTTT CCTGGCAGTT

TTCACTTTGT GTTTTAGTCC ATTTAGGCTG CTATAACAAA ATCCCTTAAA CTGGGTAAGG GATTATAAAT

ATTAGAAATT TATCTCTCAC AGTTCTGGAA GCTGGGAAGC CCAATATCAA GGCACCAGTA GATTTGGTGT

CTAACGAGGG TGTGCCGTCT GCTTCAAAAA TGGCCCCTTG TTGCTGCATC CTCACTTAGT GCAAGGGGCA

AGACAGCTCC CTTCAACCTC TTTTATAAGG GCACTTATGT CATTCATGAG GGCAGAGCCC TCATGACTTA

ATCACTTCCC CAAAGGCCCC ACCTCTTAAT AGTATCACAT TGGGTGTTAG GTGTCTGGGA GGACACCAAT

CTTCAAGCCA TATCATCTCA CTTGGAAAAA AGTCAAAATA AAACCAGTAG ATTTAATTAA TATTACACTA

TTTATAGAAG CATGTGATGT ATCATTCCTT GTATTAATTT CCTGGGGTTG CCGTAACAAG TTACCACAAA

CTAGGTGGCT TAAAACAATA GAATTTTATT CTCTCACATT TCTAGAGGCA GAAGTTCACA GTGTGTCAAT

AGGGCCATGT TCTCTGGAAG GCTTTAGGGG AGAATATATT TCATATCTTT CTCTTAGCTT CTCGGTGTCA

CTGGCAATCC TTAGCTTACT TTGGCTTTCT GTGTCTTCAC ATCATCTTTT TATAAGAACA CCAGTGATAG

TGATTAAGGG CATACCTTAC TTTAATATGA CCTCATCTTA ACTAATTATG TCTTCAATAA CCCTATTTCC

AAATAAGGCC ACATTCTGAA GTATTGGGAG TTAGAACTTA AAGCTTTTTG GGAGGGACAC AGTTCAACCC

ATAACAACCC CTAAAATCGA TATTTATTCT CAATTAAGTC TTGAAATTGG TTTCAAAAAG AGAATATTCT

ATTAGAGTTT TTAATGTATA GTTTTAACAT ATAGTTCTTT AGCCCCCAAT TTTTTTTTTT TTTTTTTTT
```

```
TTTTTTTTTT TTTTTGAGAC GGAGTCTCGC TCTGTCGCCC AGGCCGGACT GCGGACTGCA GTGGCGCAAT
CTCGGCTCAC TGCAAGCTCC GCTTCCCGGG TTCACGCCAT TCCCCTGCCT CAGCCTCCCG AGTAGCTGGG
ACTACAGGCG CCTGCCACCG CGCCCGGCTA ATTTTTTTGT ATTTTTAGTA GAGACGGGGT TTCACCTTGT
TAGCCAGGAT GGTCTCGATC TCCTGACCTC ATGATCCACC CGCCTCGGCC TCCCAAAGTG CTGGGATTAC
AGGCGTGAGC CACCGCGCCC GGCCTGCCCC CAATTATTTA GTTTTTCTAT AAACAGGGAA ATTTATTTGT
GTGGCCCTTA GAACTAATTT AATTTCCACT CTAATTCCTA CTTATGTTTA TATAATGCTT TTAGAAATTT
GTATTATTCA GAAAATAAAC ATATACTATT GTATCTGTTG CCTACACTTA GATTTTATTG CCTGCTATAT
TTAAATTTTA TTAGTATTTT AATTGTTTTA TTAAAGAAAG AATGTGCCTG TAATCTCAGC ACTTTTGAGA
GGCCAAGGCA GAAGGATTGC TTGAGCCCAG GAGTTTGAGA CCAGACTGAG CAACACAGGG AGACCCCCAT
CTCTACAAAA AATAAAAAAA TTCTCCAGGC CTCATGGCAC ATACCTGTAG TTCTAGTTAC TTGGGAGACT
GGGGTGGGAG GATGCATTGA GCCCAGGAGA TTGAGGCTGC AGTGAGCCAT GATCAGGCCA CTGTACTCCA
GCTTGGACAA CAGAGTGAGA GCTTGTCTAG ATAGATAGAT AGATAGATAA TCTAAATAGA TAATAGACAG
ATTATCTAAA TAGATAATAG ACAGATTATC TAAATAGATA ATAGACAGAT TATCTAAATA GATAATAGAC
AGATTATCTA AATAGATAAT AGACAGATTA TCTAAATAGA TAATAGACAG ATTATCTATC TAAATAGATA
ATAGATTATC TAAATAGATA ATAGATAGAT AGATTAGATA GATAGATAGA TAGATAGAGC TTGGACAACA
GAGTGAGAGC CTGTCTAGAT AGATAGAAAC AAAGAAAGAA AGAAGAATG GTGCTCATAT TTTAAAGCAT
TGAAAAATGG TCTTCCTTGC TTATATTACC CACACCTTCT TTGTTGGCAT TAAGATGCAA ACTTTGTTTT
AAACAGTTGA GTAAATCAAA GATGGGACTG TTAAGTTATT TGTGTTATTT ACCTGCTTTT TGAAAATGTA
AAAATAAAAC TCTAGGTTTA ATTAGTAGTA TGCTATTTAG TAATGAAGTA AAGCTAGAGG CTTCGAACAA
ATCTTGTGTA ATTTCCTCTT GAATGAGAGA GAAAATTTAA AGTAAGCAAA CAAATAAGTT GTGTGTCACC
ACTCATTCAG TCATTTAACA AGTATTTCCA GAGTACTTAT TCTGTGCCAG GAAATGTTGT AGGTGCCCTC
AACAACTTAG AGTCTAGCCT GAGACACAAG TAAGTAGGTA ATTATTATAG AATGGTATGA TCTTTGGAGG
ACTGGGTATT GGCTGGCTCA TGGGAGTACA AGATAGGTAC CCAGTGATGA AGTCAGGAAA GGTTTCTTAT
GGTGATATGA TGACGTCTAT GCTGATTATA AGGTCAGTGT AGAATAAACT TTGTGCTTTT AAATTTGCAT
AGCACTGTAT TAGAGAGTTC ATCTTCAAAA TAATCGAAAA GGCTGAGTGT GGTGACCCAT GGCTGTAATC
CCAGCACTTT GGGAGGCCGA GGTGGGCAGA TTGCTTGAGC TAGGAGTTCG AGACCAGGCT GGCCAACATG
GTGAAACCCC GTCTCTACTA AAAATACAAA AATTAGCCAG GAGTGATGGT GCGCACCTGT AATGCCAGCT
ACTTGGGAGG CTGAGGCAGG AGGATCACTT GAACCCAGGA GGTGGAGGTT GAAGTAAGCC GAGGTCATGC
CACTGCACTC CAGCCTGGGC AACAGAGTGA GACTCCATCT CAAAAAAAAA AAAAATGATC AAAGAAAGGT
GAATTTTCAT CTACCCTATT TCTGCTGAGG AAAATGGACT ATTTTCAAAT ATTTTTAATA AGGGTCAAAA
TGAGGGATC GCCACCATGG AAACCCTTTG CCTCAGGGCA TCCTTTTGGC TGGCACTGGT TGGATGTGTA
ATCAGTGATA ATCCTGAGAG ATACAGCACA AATCTAAGCA ATCATGTGGA TGATTTCACC ACTTTTCGTG
GCACAGAGCT CAGCTTCCTG GTTACCACTC ATCAACCCAC TAATTTGGTC CTACCCAGCA ATGGCTCAAT
GCACAACTAT TGCCCACAGC AGACTAAAAT TACTTCAGCT TTCAAATACA TTAACACTGT GATATCTTGT
ACTATTTTCA TCGTGGGAAT GGTGGGGAAT GCAACTCTGC TCAGGATCAT TTACCAGAAC AAATGTATGA
GGAATGGCCC CAACGCGCTG ATAGCCAGTC TTGCCCTTGG AGACCTTATC TATGTGGTCA TTGATCTCCC
TATCAATGTA TTTAAGCTGC TGGCTGGGCG CTGGCCTTTT GATCACAATG ACTTTGGCGT ATTTCTTTGC
AAGCTGTTCC CCTTTTTGCA GAAGTCCTCG GTGGGATCA CCGTCCTCAA CCTCTGCGCT CTTAGTGTTG
ACAGGTACAG AGCAGTTGCC TCCTGGAGTC GTGTTCAGGG AATTGGGATT CCTTTGGTAA CTGCCATTGA
AATTGCCTCC ATCTGGATCC TGTCCTTTAT CCTGGCCATT CCTGAAGCGA TTGGCTTCGT CATGGTACCC
```

```
TTTGAATATA GGGGTGGACA GCATAAAACC TGTATGCTCA ATGCCACATC AAAATTCATG GAGTTCTACC

AAGATGTAAA GGACTGGTGG CTCTTCGGGT TCTATTTCTG TATGCCCTTG GTGTGCACTG CGATCTTCTA

CACCCTCATG ACTGGTGAGA TGTTGAACAG AAGGAATGGC AGCTTGAGAA TTGCCCTCAG TGAACATCTT

AAGCAGCGTC GAGAAGTGGC AAAAACAGTT TTCTGCTTGG TTGTAATTTT TGCTCTTTGC TGGTTCCCTC

TTCATTTAAG CCGTATATTG AAGAAAACTG TGTATAACGA GATGGACAAG AACCGATGTG AATTACTTAG

TTTCTTACTG CTCATGGATT ACATCGGTAT TAACTTGGCA ACCATGAATT CATGTATAAA CCCCATAGCT

CTGTATTTTG TGAGCAAGAA ATTTAAAAAT TGTTTCCAGT CATGCCTCTG CTGCTGCTGT TACCAGTCCA

AAAGTCTGAT GACCTCGGTC CCCATGAACG GAACAAGCAT CCAGTGGAAG AACCACGATC AAAACAACCA

CAACACAGAC CGGAGCAGCC ATAAGGACAG CATGAACTGA CCACCCTTAG AAGCACTCCT-3' (FRAG. NO: 1738)

(SEQ. ID NO: 3009)

5'-GCCACCATGG AAACCCTTTG CCTCAGGGCA TCCTTTTGGC TGGCACTGGT TGGATGTGTA ATCAGTGATA

ATCCTGAGAG ATACAGCACA AATCTAAGCA ATCATGTGGA TGATTTCACC ACTTTTCGTG GCACAGAGCT

CAGCTTCCTG GTTACCACTC ATCAACCCAC TAATTTGGTC CTACCCAGCA ATGGCTCAAT GCACAACTAT

TGCCCACAGC AGACTAAAAT TACTTCAGCT TTCAAATACA TTAACACTGT GATATCTTGT ACTATTTTCA

TCGTGGGAAT GGTGGGGAAT GCAACTCTGC TCAGGATCAT TTACCAGAAC AAATGTATGA GGAATGGCCC

CAACGCGCTG ATAGCCAGTC TTGCCCTTGG AGACCTTATC TATGTGGTCA TTGATCTCCC TATCAATGTA

TTTAAGCTGC TGGCTGGGCG CTGGCCTTTT GATCACAATG ACTTTGGCGT ATTTCTTTGC AAGCTGTTCC

CCTTTTTGCA GAAGTCCTCG GTGGGGATCA CCGTCCTCAA CCTCTGCGCT CTTAGTGTTG ACAGGTACAG

AGCAGTTGCC TCCTGGAGTC GTGTTCAGGG AATTGGGATT CCTTTGGTAA CTGCCATTGA AATTGCCTCC

ATCTGGATCC TGTCCTTTAT CCTGGCCATT CCTGAAGCGA TTGGCTTCGT CATGGTACCC TTTGAATATA

GGGGTGGACA GCATAAAACC TGTATGCTCA ATGCCACATC AAAATTCATG GAGTTCTACC AAGATGTAAA

GGACTGGTGG CTCTTCGGGT TCTATTTCTG TATGCCCTTG GTGTGCACTG CGATCTTCTA CACCCTCATG

ACTGGTGAGA TGTTGAACAG AAGGAATGGC AGCTTGAGAA TTGCCCTCAG TGAACATCTT AAGCAGCGTC

GAGAAGTGGC AAAAACAGTT TTCTGCTTGG TTGTAATTTT TGCTCTTTGC TGGTTCCCTC TTCATTTAAG

CCGTATATTG AAGAAAACTG TGTATAACGA GATGGACAAG AACCGATGTG AATTACTTAG TTTCTTACTG

CTCATGGATT ACATCGGTAT TAACTTGGCA ACCATGAATT CATGTATAAA CCCCATAGCT CTGTATTTTG

TGAGCAAGAA ATTTAAAAAT TGTTTCCAGT CATGCCTCTG CTGCTGCTGT TACCAGTCCA AAAGTCTGAT

GACCTCGGTC CCCATGAACG GAACAAGCAT CCAGTGGAAG AACCACGATC AAAACAACCA CAACACAGAC

CGGAGCAGCC ATAAGGACAG CATGAACTGA CCACCCTTAG AAGCACTCCT-3' (FRAG. NO: ) (SEQ. ID NO: 2481)

5'-GATCAAAATT TTTACCTATT ATGCATTTGA TATATAAATA AGTATATAAA TGCACACACA GACACAGCAA

TGATGGTGAA CAGTCTTCAT ACAATTATAT GGATGAATCT CATAAAATGC TGAGTTAAAG AAATCAGACC

AAAGAACATA TACTGAAAGA TTCTCTCTAT ATACAAAGTT CAAAAATAGG TGGACCAATT CATGGTGGTG

TTAGAAATCA GAAGAGAGGC TACCTTTGTG GGGAGGGGAC AGTTTAATGC CCAGAAGCGG TAAATAAGGA

ATCCTCTGGG GAGTGGTAAT GATCTGGATG CTGGCTACAG GATGTGTTGG TTGTAAAAAT GCATTTTTTT

ATATCTAGCT TTTTCCATGT GTATATTATA CTTCAAAGAA GTTCAGTTAA TAATTTCTCA TGTCACTGTA

GAGTAGCTCA GTTAGCCCCA GCAAGCCTCT GGCTTAATCT TGTTTTACCT TAAGCCATCA GTCATTTACA

AGTAGGAAAA TTCACAGGGA AAGTTAGAGT ATAAAATCCA GAATGAAGGT TTACTGGGTA AGAGTCTTTC

CATTTTCCAA AGCCCGTTTA TTTCTTGATT CCAGTTCTTA AGAAGTCTCA GCATTGTGTC TTTTTCATGT

ATCTTACAAG AAGACAGCAT GTGCTTCTAA CACCTGATAC ATTGTATCTA CCAGCACTTG GTAAACAGAA
```

-continued

```
AAGAACCACA TTTTTCTTGT AGGAGAAATT TGGTGCCTAT TTCCTACCAG GCACCAATAA GTGGGACCAA
TAGGTGGGAT TAAAGATACA GTAGAAAGTA TTTAAAACTT GCCAGGGGGC AATAGTCTGA AAATAAGTAA
ATTGGTGCTA TAGAATGGAA GTTACAGGCT TCTTTCTTTT TTCCCACAAG ATCTGCTCCT TGAGCCCCTA
GAGACTTTTC TGTCTGTTAC TGTTTCTTCA TTCCTCATCT GCAGAGCCAG CCCTGAGAAG TGCAGACCAA
AGCCAGGGAA GGCTCTGCAA AGATGTACAA ATGGAAGTCA CCTTAATAAC CTCTGACTGC TGCGCATAAT
ACATTTCACT CAAAAGAGGG GTTAAACAAT GGAACAGAAT ACAGAGGCCA GAAATAATGC TGAACACTGA
CAACCATCTG ATCTTTGACA AAATCCACAA AAACAAGCAA TGGAGAAAGG ACTCCCTATT CCATAATGGT
GCTGGGATAA CTGTCTAGCT ATATACAGAA GATTGAACCT GGGCCCCTTC CTTACATCAT ATACAAAAAA
TAACTCAAGA TGGAGTAAAG ACTTAAATCT AAAACCAAAC ACTATAAAAA CCCTGGAAGA TAGCCTGGGA
AATACCATTC TGGACATAGG ACCTGGCAAA GACTTGATGA CAAGACACCA AAAGCAATAG CAACAAAAAC
CAAATTGACT AATGAAACTA ATGAAACTCT TTAGTTGTAC AACAGATAGT TTATCTGTAC AACAAAATAA
ACTATCAACA GAGTAAACAA CCTACAGAAT GGAAAAATTT TTTGCAAACT ATGCATCTGA CAAAGGTCTA
ATATCCAGAA TCTATAAGGA ATTTAAACAA ATTTACAAGC AAAAAAATGA CCTCATTAAA AAGTGGGCAA
AGGACATGAA CAGATGCTTT TCAAAATAAG ACATTCACAC ATCCAACAAC CATATGAAAA GATGTTTAAC
ATCACTAATC ATTAGAGGAA TACAAATCAA AAGCATAATA AGATACCATC TAATACCAGT AGGAATGACT
ACTATTAAAA AGTCAGACAA TAACAGATGC TGGTGAAGGT TGTGGAGAAA AGGGAATGTT TATGCACTGC
TAGTGGGAAT GTAAACTAGT TCAGCCATTG TGGAAGAGAG TGTGGTGATT CCTCAAAGAA TGTAAAACCG
AACTGCCTTT CAATCCAGCA ATCCCATTAT TGGATATACA CCAAAAGGAA TAGAAATTGT TTTACCGTAA
AGGCGCATGC ATGCATATGT TCATTACAGC ACTATTTACG ATAGCAAAGA CATGGAATCG TCTAAATGCC
CATCAGTGGT AGACTAGCTA AAAAAAAAAA AATGTGGTAC ATATACATCA CAGAATAGTA TGCAGCCATA
AAAATGAACA AGATCATCAT GTCCTTTGCA GCAACATGGA TGTAGTTGGA GGCCATTATC CTAAGCAAAT
TAATGCAGGA ACAGAAAGCC AAATACCACA TGTTCTCATT TATAAGTGAC AGCTAAATAT TGAGTACACA
TGGACACAAA GAAGGGAACA ATAGACATGG GACCTACTTG AGAATAGAGG GTGGGAGGAG GGTGAGGATC
AAAAAGTACC CATAGGACAC TGTGCTTATT ACCTGGGTGA TGAAATAATT TGCACACCAA ACCCCTGTGA
CACACAATTT ACCTATATAG AAAACCTGTG CATGTACCCC TGAACCTAAA AGTTAATGGT GGGGGGGTGG
GGTTAAGCTA CTTTGTGGTA TAAATCTGAG CATTCATATT AAAATAAAAT ATTTACCTCA TTAGAGTAAT
TAACATTTAT TAAGCAAAGA GCCAAGTACC TTACACACAT GATGTTTAAT CTCACAATGA TCTTTAATCT
CATAACAACC GTCCATTGTA TGTACATATG TGGAAATTGA GCCTTGGAGA GATTAAATGC ATGGGGCATG
CCATTTGACT AGAAACTGGA AGCATCAGGA TTTAAACTCA GTTCTGAATG GTTTTGTAGG CTTTGTTTTT
TCCACATTAT AGCATGGCCT GCCATGAAGA ACAGGTCCTT TCTGGTGTTT GTCTTGTTTG GTTAAGTGA
AGCAAATATT TATTTAAATA TTCAAGATAT GCTGTTAAAT TTTTACTCAA AAATTTGAGT ACAGTATGGA
TCTTCTGAAG CCAAATAACT CTTATTCAAT GCTTAGTTGA GAAATTTTAT GGAGTAGTTC TCAATTTTTA
TGTAGTTCCA CTGCAAAGGT AAGTCTTATG GAAAGATTCA CTGTAATTTT TTTTCCTCAT TTGGACATCA
GCTTTTTCTT TTCCTCAGAC CCGCTGAAAG ATAATTTTTA AAATAAAAAC CTTGTTTTTA TATCAAGTGG
GGACATTTTT TCCAAATGAA AACCGTGTAT TCATTTTATA TGATAAAATC AATGTTATTA TTTTTAAAAT
TTTGATTTAA AAATCATTAA AAATAAATTT TCAGATATTA CCTGAAATTC TACCATCCAG AGATAATAGT
GCTTAAAGAT TTGATATATA GACACACACA CATATATACA TATATATCAT CCTAAACTTC TTTGTATAAA
TGTATATAAA GTTTTTAATA AAAACTAGGA GATTAATGCC CTTTGAATGA AAATAAATAC AATGTGTATG
CTTTAACATC TTGCCTTTAC TTTATAACAT TTATACAGC AGTCATGAGA TAATGATTTA CATGGTCATT
GTTAGTAAGC TAATAGCTAA GTGCATGAAC TCTGGAGCTA GCCTCCCTGG ATTTTAATCC CAGATCTGTC
```

```
ACTGACCAGC TGAGCAATAC TAGGTAAATT GCTCTTGTTC CTTAGTTTCT TCATCTGTAA AATAGAGATA
AAAATAATAT CCACCTCATA GGATTGGTGT GAGCATTAAA TGAGCATACG TATGTAGGCC ACTTAACAAC
AATGCCTTCA CATACTGAAC ACAAATATAC GAGCTGTTGT CTTATTGGGC TCATGTTTTT CCTACCACTA
AGCCGCATGC ATGCAAGGAC CATGTTGGTT TTGTTCCACA TTGCATCCCC AACCTGGTAT ACAGTGTGCA
TTCAATAGTT GTTGACTATT ATTACTAGTG GCATTTAACA AATATCTGTT AAATGAGTGA AGAAATACCC
ATTTACTGCA AGTGTGTCTA ATATTGATGG CATAATGGGG GAAACTCAAA CTCTGGAGTC AAACAGGTTT
TAAAACCTTA TTCCCTCATC CTCAGTTATT GACGTTTTTT TTTTGGCAGG TGTGTGTGTG GGACAACTTA
TTGAACTTTT CTGAATTTCC AGCTTCGCAT ATATAAAATA GAGATAGTGA TTCATTCTTG CAATGTATGG
ATTTGAGACA ATTGTGTAAG TTTATCAATA AATAGTAGCT ATTTTTGTAT AAGTATTACA TATAATATCC
AGGCCACTGC TTTGCATAAC CCAAAAGGGG CACCATTCAT GCAGAATACA ACATAAATGG TGTCCCTGGA
GCAGTGCAGT ATAGGAACCC TGAGGGGACC TACAGTATAC TTTATAGTTC ATAGATTACA AATTATCCCT
TTATCAGAGT CTCTCAAGGT TGGATGTATT TGAGGTCCAT AAGAGCAATT TAGGATTAAC AGTAGCTGCA
GAAACCATCT GCAGTGATAT TCTCATTTTA AATCCGCGGG AAAGAAGACA GCTATAAACT TGGGACCTGG
GTTTAAGCAT TTTAAATGCC AAGTTCACCA TTTTCTAAAA CACAACAAAT ACCCAGTGAG AGAGGGAGAA
GGGAAGTAAA TGCCTCTGAA TAAGCAAGTT AATGTCAGTA GTTGTACTGT ATGCATATTG ATGAACAATA
GAGGAACCAA TGTCCAATCA GATGAGCAGG ATATTTGGCA ATAACAAGTT GCCTTTGAGG AAAAATGATT
TTCTTGGCAA GTTCTTTATC AGCATTACAA AGCTAAAAGC TACGCTTATC ATCACTTATA CTAGCATACC
CTGTTGTGCA AATGCTGTCT GTGTTTGCAT CTGCTATTGT TGATGCCTGG TGCATGAATC AGGACTCCAG
CCCACAAGTT TTCCCAGAAC TTTCTTATGG CCATCATCTT TAAGTGTCTG GTGAACAGTC ATAGTTTGGT
ACACAAAAGG GTCAACCTGG GGGATGGCTA GGGTTTGACT CAGTCGTTAC ATTTCAATAG AGCAGGAAGG
GGAAATGGTG GCCTGTAACC TCAGGGAATT TTGCCAGTTG GTCCACCCCA CTCTCTCTCT CCTGCTCTGA
GGAAGTGGCA CAGCCTAGAA CAGCACCACA GGTGAGAGAA ATGCAAACCC TAACCAGAGA AGCAGACTCT
TTGCCAGTAG TAATAGTTCA GGACCACCAC CAGCTTTTAT TAAAATTTTT AATAACACTC AAGTATTGGC
AGAAAGAAAT AATCTTGGGT TAACTATAAC TAGAATATTG ACTCTTCCTC TGTGGAAGAA TCAGCCAATC
ACATTTGTTT ACATCAGTTC CCCTGAAGAA GAAAAATACA CTGATGTTGC AGCAAGACAA ATTTAAGCTA
GATGTAAATA ACTTCCTTTA GCCTGTAATG CTAGGCTAAT TACATATTGG AACTATTTTT TCAGGGAAGA
ATTGTGTAGG GTTTCAGGGA AGAATTCTGA AGAAAATATA GAGCTGAAAT GATCTTGCAG CTCACTGAAA
CTGCAGGGTT TAGATCCACA CTGATACTCG TTCTATTATC ACTGTAATGA AGGCTGATGG AATAAGTAAA
AATGTTTTGT ATTAGTATGT TTTTACACTT ATTTGCAAGG CATAAATAGG TTAGGTTTTG ATCTTAATTT
AATTCTAACA TGTATTGTGC ACAAGCTGTG AGCAGTTTTC AGGAGTTAGG TATCTGGCCA TGACTGATTT
TTCAGGAGTT AATCATCTGG TAGAAGGGTC ATACACAATA GGAAGATGTG TGTGACAGGT TGTGATCATT
ACTATAATCA CACAGAGAGC TGTAGAATTT TAGGCTGGCA GGGTGGCTCA CGCCTGTAAT CCCAGCACTT
TGGGAGGCCA AGGCAGGCGG ATCAAGAGGT CAGGAGATGG AGACCATCCT GGCTAACACG GTGAAACCCC
GTCTGTACTA AAAATACAAA AAAAAAAAAA AGCCAGGCGT GGTGGTGGGC GCCTGTAGTC CCAGCTACTT
GGGAGGCTGA GGCAGGAGAA TGGCGTGAAC CCGGGAGGTG GAGCTTGCAG TGAGCCGAGA TCGCATCACT
GCAATCCAAC CTGGGCGACA GAGGGAGACT CAGTCTCAAA AAAAAAAAAA AAAAAAGTC ATGTTAGATC
CAGAGGGGTA GCAACTGGGG CTGGGCTGTC AGTCAACTCA GTCAACTCAG TCAACTCTGC TCCCCCACAG
GAGATGCCAG TGATGCATTT TCATGGCCAA CATTGTCAGT CAGCATCATT GAATTACTCC TGATTATAGA
GACACAGCTG CAAACGATTC CCCATTAAAT ATGATGTTTC TTGCAATGTT TGGAAGGTAC TCCTTTTTAG
```

-continued

```
TAAGGGAAAT CCCCTCTTCT GGCTTGCTGA AAGTTTTTTC TTTCCATTTT AAAAATCGTG AATTCCTTTT
TGCAATATTG AGGTGGTTAT ATGGTTTCTC TTCTCTAATC TGTTAATATG GTGATTTAAT GGTTAGAAAT
TTTCTAATGT AAATTCCACT CATATTGCAG AAATAAACCT AAACTGAGCA TGAGGCTATA TTTTTTATTT
GCTTCTATAT TTGGTTGCTA TACAGTATTA TGTTTAAGAT TTGTTCACAT ATATTTGTGA ATGGGATTGG
ACTATTTTTC CTTCTTGCCG ATTTTTATCT GGTTTTTAAA TTAAGGATAT TTTAGACTTA TGAAATATTT
GGCAAACAAT CCTTGGCAAG TAATTTTTTG GGGAATTTGT TTTGGCTATT TTGAGTATTA CCCAATATAT
TTTAATTAAG TTATTCTTAA TGTTTTCTTA ATTAAAAAAA TTACCTACTC TAGAGATATT CTTTATGTAC
TCCAGATTTT GTCTATTTAT ACCACTTTTC TTTTTTCCTC GATGAGTGTC ATAGATGTTC ATCTATTTTT
TTATCTTCTT TGATCTTCTC TTATTCCTTG TTTCTATTAA CTTCTGAAGT TTATTATTTT CTTTTTTCCA
CTTCCTTATG GTTTATTCTT TCAATTTTTC TCTAACTTCT TAAGTTGGGT GTTTAATTTT TAGCTTGCTT
TGCTTTTTTA GGATAAGCAT TAAAACTACA AATTTTCCTT GTTATTCTTT TGCTGCACCC CAAATTGTTG
ATATTTCTAT TGTCTAATTT CTATTCAATT AGAATACTTT AAAGTTTCTT TTTGGTTTTT AAAAACTAAC
TTTTTAAATT GACAAATAAA AATTGTGTAT ATTTATTGTG CACAGCATAT GGCTTTGAAA TATATGTACA
TTGTGGAATG GCTAAATTTA GCTTATTAAT GTATGCATTA TCTCACATAC TTATCATTTT TTGTGGTGAG
AGCTATGTGA CTTTTGAACT TATGAGTTAT TTAAATATTT TTAAATTATT AAGCATATTG GGATTTTAAG
TAATTTACCT TTTTATTATT AACTTATAAC AAGTAGAACA GTTAACCTGT ATGATTCTAC ATCATTGAAA
TTTATTGACA TTTGCTTCAT AGTCTATTAT ATGGTCTACT TTTGTTCATG TTACATCTGT AGTAGAATTG
GCTAATAGTT GAGTAAAGTA CACATATGTC TATGAAATCA AGTGTAATCC AGAGAAAAAG AGAAATTTAC
TGAATATATT GTTCTAGGTG CTATTATATG TTGTCATGTT AATCCTCAC CACAATTGTA TGAGGCAGCC
ATAATTAATT CCACTTTACA CATGAGGAGC CTGAGGGTTA AAAAAAAAGC TAGCTCTACT ATTTGTAAAG
AATGAAGCAA AGATACAAAT GAAGGCCCAC ATATCCTATA ACTAGATATT TAAGCATTTT AATTCAAGCT
TTAAAACTGC TAAATAAAAT GTGCTCCAAT TTCTATATTG ACAGACATAC CTTCCTAATG AGCTGGGGTT
CGAATTTAGA AATCTTTGAT GCTTCAGAGT CCACACTGAA ATGTGGAGGC ACATAGTGAG TTGGTCCCCA
GCCTTCAGTC CACCCACCTT CTCTTTACTA AATCACCTTT CACATACATG TATGAACACC CCAGCCTCCA
AGTCCAAACC CTAAACAAAA TGGGACACCC TTGTGCATAC ACAGAGACAC AGCCCATCCT CAGGAAAACC
TGGAAAAGTC CATACAAGTT CTGGAAGCAA GCTTGGGACG GTTTCAGTAG TGTGGTCTAT AAGGGAGGCC
TCAGAAGACA GGTTTTCTTA ATTCTGTGAA CTTCTCCCAC AGTAGAAAGG GTGCTGGAGG AGGGTCAGAG
TGAGGACTTC TAAAGCATGG GTCCTGAGTA GGGGCCACTC TTGCCCAAGT CTAAGAAGGG TACTAGAATA
GCACACTACT ACTAGATACT AGAACCCAGA TACAAGCACA GGTCTTCTGA AATTAATAAT AATAATAACT
ATTACCATTA TTATACCAGT AGCTGTCATT TATTTAGTGC TTATTATTTG CCAGTCACTG TTCTAAATTC
TTTACATGTA TTATACAACT GCCATATAAC TGCCATATGA GGGATGTACC CTCATTGTCA CCATTTTACC
GATGAGAAAA CTGGCATAAA ACGTTTAAGT AACTTGTCCA AGTTACAGAG CTTAGTGAAG CCACAATGTT
GCTCAATTTG CTCTCAAACT TCAAAGGGAT GGGAAGGACA CCTAAGTCAT AGAGTCTTTA AGAATCAGAG
CTAGAAGGAA TCTTAGATGT TATCTAGTCA GCCTCCTCCC ATTACAGTCC AAGAGAAGAT GGCCCTGAGT
TACTTGTAGC TATTTTTGCA TGTGAATTGC AAGTGAATAT ACATTCTACT GAAGATAAAA GATATTTAAA
GATATCGCTG GATATAGGAA CAGTGGTTTT AAATCTCTAG GCTTTAACTT TTCTCAGAAC AAGAAATCCT
TTTTGGTTTT AATCTATATG CACATCTGTA TTTTTCTCAA TTATCGGGTA GTAAAATATA ACTTTTCTTC
TGTAATATTT TTTAACTTTA ATGAGTGTTC CTCATAATAG AAAAGTTTGG AAACCATTGC TATGGGTATA
TACTTTCTAA AGGGATAGTA ATTTCTCTAG AATATTCATT TAATGCTCCA GAAGTAATTA GCACAATTGT
GCAAGTCTGT GCATCATCAA CTATACATTC TGCCTGTTTA CTCCAAATCC ACATGAAACT GATTATACAG
```

```
TCAAAGGCGA GCCCAGTGGA GAGGCATTTT TGGAGACTTC CTGGTACATT GAGACAGGGT CGGCCAGTCT
GCGTTAGGGT CTTGGTCAAA ACTGCATTTC TGAAACTAAA CTCAGATTGC TTTCTTTTAA GGGGTCAGAA
CTGATTCAAA TCTACATTTT TAAAAGCCTT AGATGTGGGG CTTTTCCTAT TCCCAGTCTC CGCTATTGGT
CTTTGTGAAT CCACAGGCAA TTTGGCCACA TCCTTGACTC TCTCTTATAT TAAGAATTAA ACAGCTAAGT
TCATGCAGAG GAAATATAAC AAAGGAGGGA CTTTCCTACA AGATCTTTGA AAAATGGAAC ATTTGCATAA
GTCATATTTA GCCAGAACTG TTGTTTTATA TTTTCCTTTC TGAATACTTT GTTACACCTC CTCCCAGCCA
ACCCCCCCCC TCCCTGACCC CAACTAGTCA GAGACCAAAG CCTTCACAAT GGTTTACACT TGAACCTTCC
TGGCCCCACC CTCATCATCA CGCCTGAATA ATTACATTCA CTGACTGGTC TCCCCTGCTT CCGTTTATCT
CCACTCCTAA ACCCTCTGAC ACCTTAATCT TCCCAGAATA CCATTGTGAT CCTGTTCCAC TCTTGCTCAA
GTTTTCCCAG AAACTAGAGT ACAAACTTTA TAAGCTTTAG AGTTGAAAGC CACTCTATCT CTTTTTCATC
CCCAGGTCTC TGCCAAGGCA GTATAACCTG TCCAACATCT CTAACTTCAA TACCTTTGTC TTAGATACTA
GACTCTCCTC CTGGTTTCTA ATTAAACCTG ATCTAGGATC TAATTTTGCC TCTGAATTCT GTTGCCCTTT
GCCAAGTGAT CTCTTCCTCC TCTGAGCCGC AGCATCTCTG AGCTTGCACA CTTAGCATAG CCATAGCACA
CACAGCCTTA GCTTGCAGTT CAGGGTGTTT ACCTTCCCTC CCCTTCCAGA TGCTGGATCC CCAGGGATAG
GAACTCTGCC CTTATGTGTC CATAGCCCCT GGTAGTATGT CTTGCAGTCG TACATTTTCA GCAAATGTTT
AATTGGTTAA TTGAAGACAA CTGTCCCATG CCTTAAGCCT CTCTTTTTGC TAAACATGCC TGTGTCCTTT
GTCATTGAAC AACTATTTTG ATCTATTTTC TTCCTGACAT AGGGGTCAGT TCCGAGGATG CTGAAATCAA
GAGACATAGC TTATTCTCTC AAAATTGCTT TCAAGAGTGA TTTTGTTGTG AATTGAGAAC TGGCTGCCTA
CTTTTGGACT ACCCACTTCA GCAAGAGTGT TTGAAACCAA ATCTATTCTA AGTAATTTTT TATTCCCTTT
TCTCTATGGC ATTAGACACA CAGCTCTTTT AAACTACCTT TCGTTATCTA TTAAACAGAC ATTCAGTAAC
TCTATAGACA CTGTCTAGCT ATATGAACTT AGACAAACTA ATATCTCTGA GCTTCAGTTT CTTAAAATTT
AAAATGAGGA CAATACCATC TATGGCCGGG GATTAAATGC TATGAGGAAT GTAAACCAGA TGTCAGGTAC
CATCTCTCTA AAATCCAGAT AAAATGAATT AAAAATACTG GCCGCAAACC CTCTCTAAGA GTTCTCAAAA
TTCTCAGAGA GCTTAATTTT CATGCTCACC ATAGCACCGA TTTTCTTCTA AATATTTTGT TTCTACCAAA
ATATTTTGTC CCAATTTTGC CTTTTATGGC TATTTCTTCA TATCCACTTT CCCAAACTAA AGAAGCAGCC
CCTTCACCTT AAACTCCTCC TTCAAAGCAA CCTAAATACA GGTCTGGGTT TGTATTCCTA GTGGGATGTT
ACAGAGGTTA GTGTGATGCA GAGGAGGAGT CATGCTGTTT AAATCCATAC TAGTCCCCAG AGGCCAGGCT
GCTTCTGCCA CCCCTACCCC TCCCGCCACA GAGCTCTTCA GCTTCTCACA TTTCTAGTTC TTCTCTCTCT
ACTTTCATTA CCTTCTCTCT TTTTTTTTTT CTTCTCATGT GCTCACGGGA GCAGAGAAAA TTAACTCCTC
TAAGTTTTCT TAACACAGAG TGCCTTAATT ACATATTACT ATTGTTTGAG TTCCTGCCAA CACTACGTCT
GTAGGGTCAC ACCTGCTATA TTAGAGGCTT ATCAAAAAAA GATAGCTTTC TCCTAAAAAG GGATTTGGAT
GCCTACTAAG ATAACTGGAT GCCAAGATAA GTTTAACCTA ACAAACTTTA TTATTATTAT TATTATTATT
ATTAGAGATA GGTACTTATT CTGTCACCCA GACTGCAGTG CAGGGATGCA ATAATAGCTC ACTGCAGCCT
CAAAGTCCTG AGTTCATGCA ATCCTTCTGC TTCAGCTCCC TGAGTAGCTA GGACTACAGG CATATGCTAC
TCTGCCCAGC TACTTTTAAA AAAATAATTA GGGATGGGGT CTTGTTGTAT TGCCCAGGCT CGTCTCAAAC
TTCTGGTTTC AAGCAATCCT CCTGCCTTTT ACCTCCCTAA TTGTTGGAGT TACAGGCATG AGCCACAGCA
CTCAACCAAG ATTTAAAAAC TTTTAAAAGA AATCACATTA CTTACTGTTA TCATCATTAT GGTTACTACC
AGTGTTAAAA CAATTGGTAT TGAAAACACC ACTACCAGAT CAAGCTTCAA ACCAAGATGT CAAGTAAATA
TTATTGTCAG ACCTCTGAGC CCAAGCCTGC AGGTATACAC CCAGATGGCC TGAAGCAAGT GAAGAATCAC
```

```
AAAAGAACTG AAAATGGCCG GTTCCTGCCT TAACTGATGA CATTCCACCA TTGTGATTTG TTCCTGCCCC
ACCTTGACTG AGGGATTAAC CTTGTGAAAT TCCTTCCCCT GGCTCAGAAG CTCCCCGACT GAGTACCTTG
TGACCCCCAC CCCTGCCCAC AAGTGAAAAA CCCCCTTTGA CTGTAATTTT CCACTACCCA CCCAAATCCT
ATAAAACAGC CTCACCCCTA TCTCCCTTCG CTGACTCTCT TTTCAGACTC AACCTGCCTG CACCTAGGTG
ATTCAAAAGC TTTATTGCTC ACACAAAGCC TGTTTGGTGG TCTCTTCACA CAGACCATGT GACATTTGGT
GCCGTAACTC AGATCGGGGA ACCTCCCTTG GGAGATCAGT CCCCTGTCAT CCTGCTCTTT GCTCCATGAG
AAAGATCCAC CTATGACCTC TGGTCCTCAG ACCAACCAGC CCAAGGAACA CTCACCAAT TTTAAATTGG
GTAAGTGGCC TCTTTTTACT CTCTTCTCCA GCCTCTCTCA CTATCCCTCA ACATCTTTCT CCTTTCAATC
TTGGCACCAC GCTTCAATCT CTCCCTTCCC TTAATTTCAG TTCCTTTCTT TTTCTGGTAG AGACAGAGGA
AACGTGTTCT ATCTGTGAAC CCAAAACTCC AGCACTGGTC ATGGACTTGG AAAGACAGTC TTCCCTTGAT
GTTTAATCAC TGCAGGGATG CCTGCCTGAT TATTCACCCA CATTTCAGAG CTGTCTGATC ACTGCAGGGA
CGCCTGCCTG GATCCTTCAC CTTAGTGGCA AGTACCACTT TGCCTGGGTG GCAAGCACCA CCTCTCCTGG
GGGGCAAGCA CCACCTCTCC TGGGGGGCAA GTACCCCCCA ACCCCTTCTC TCCATGTCTC CACCCTCTCT
TCTCTGGGCT TGCCTCCTTC ACTATGGGCC ACCTTCCACC CTCCATTCCT CCCTTTTCTC CCTTAGCCTC
TGTTCTCAAG AACTTAAAAC CTCTTCAACT CACGTCTGAC CTAAAACCTA AATGCCTTAC TTTCTTCTGC
AATACCGCTT GACCCCAATA CAAACTCAAC AATGGTTCCA AATAGCCTGA AAACGGCACT TTCAATTTCT
CCATCCCACA AGATCTAAAT AATTCTTGTC GTAAAATGGA CAAATGGTCT GAGGTGCCTG ACATCTGGGC
ATTCTTTTAC ACGTCGGTCC CTCCCTAGTC TCTGTTCCCA ATGCAACTCA TCCCAAATCC TCCTTCTTTC
CCTCCTGCCT GTCCCCTCAG TCCCAACCCC AAGTGTCGCT GAGTCTTTCC AATCTTCCTT TTCTACTGAC
CCATCTGACC TCTCCCCTCT TCCCCAGACT GCTCCTCCTC AGGTCGCTCC CCGCCAGGCT GAATCAGGCT
CCAATTCTTC CTCAGCGTCC GCTCCTCCAC CCTATAATCC TTCTATCACC TCCCCTCCTC ACACCTGGTC
CAGCTTACAG TTTCATTCTG TGACTAGCCC TCCCCCACCT GCCCAACAAT TTCCTCTTAA AGAGGTGGCT
GGAGCTAAAG GCATAGTCAA GGTTAATGCT CCTTTTTCTT TATCCAACCT CTCCCATCTC AGTTAGTATT
TAGGCTTTTT TTCATCAAAT ATGAATACCT AGCCCACTCC ATGGCTCATT GGCAGCAAC TCCTAGACAT
TTTACAGCCT TGGACCCAGA GGGGCCAGAA GGTCATCTTA TTCTCAATAT GCATTTTATT ACCCAATCCA
CTCCCAACAT TAGAAAAAGC TCCAAAAGTT AGACTCCGGC CCTCAAACCC CACAACAGGA CTTAATTAAC
CTTGCCTTCA AAGCGTACAA TAATAGAGTA GAGGCAGCCA AGTAGCAACA TATTTCTGAG TTGCAATTCC
TTGCCTCCAC TGTGAGAGAA ACCCCAGCCA CATCTCCAGT ACACAAGAAC TTCAAAATGC CTAAGCCACA
GTGGTCAAGC ATTCCTACAG GACCTCCTCC ATCAGGATCT TGCTTCAAGT GCCAGAAATC TGGCCACTGG
GCCAAGGAAT GCCCTCAGCC TGGGATTCCT CCTAAGCCAT GTTCCATCTG TGTGGGACCC CACTGGAAAT
CGGACTGTCC AACTTGCCCA GCACCCACTC CCAGAGCCCC TGGAACTCTG GCCCAAGGCT CTCTGACTGA
CTCCTTCCCA GATCTTCTTG GCTTAGTGGC TGAAGACTGA TGCTGCCTGA TCGCCTCAGA AGCCTCCTGG
ACCATCACAG ATGCTTTTGG TAACTCTTAC AGTGGAGGGT AAGTCCGTCC CCTTCTTAAT CAATGCAGAG
GCTACCCACT CCACATTACC TTCTCTTCAA GGTCCTGTTT CCCTTGTCTT CATAAATGTT GTGGGTATTG
ATGGCCAGGC TTCTAAACCC CTTAAAACTC CCCAACTCTG GTGCCGATTT AAACAACATT CTTTTATACA
CTTCTTTTTA GTTATCCCCA CCTGCCCAGT TCCCTTATTA GGCTGAGACA TTTTAACCAA ATTATTTGCT
TCCCTGACTA TTCCTGGACT ACAGCCACAT CTCATTGCTG CCCTTCTTCC CAACCCAAAA GTGGCAACTC
CTTTGCCACT TCCTCTCATA TCCCCCTACC TTAACCCACA GGTATGGGAC ACCTCTACTC CCTCCCTGGC
AACAAATCAC ACCCTCATTA CTATCCCATT AAAACCTAAT CACCCTTACC TGGGTCAACG CCAGTATCCC
ATCCCACAAC AGGCTGTAAA GGGATTAAAG CCTGTTATCA CTTGCCTGTT ACAACATGTC CTTTTAAAGC
```

```
CTGTAAACTC TCCTTACAAT TCCCCCATTT TACCTGTCCA AAAACTGGAC ATGCCTTACA GGTTAGTTCA
GGATCTGTGC CTTATCAACC AAATTGTCTT GCCTATCCAC GCCATGGTGC CAAACCCATA TACTCTCCTA
TCCTCAATAC CTCCCTCCAA AACCCCTCCA TAACCCTTAT TCTGTTCTGG ATCTCAAAAC ATGCTTTCTT
TACTATTCAT TTGCACCCTT CATCCCAGCC TCTCTTCACT TTCACTTGGA CTGACCCTGA CACCCATCAG
CCTCAGCAAC TTACCTGGGC TGTACTGCCG CAAGGCCTCA TGGACAGCCC CCATTACCTC AGTCAACCCA
AATTTCTTCT TCATCCATTA CCTATCCAGG CATAGTTCTT CATGAAAACA CACGTGCTCT CCCTGCTGAT
CATGTCCAGC TAATCTCCCC AACCCCAGGA CTGGCAAATT GACTTTACTC ACATGCCCCA AATCAGGACA
CTAAAGTACC TCTTGGTCTG GGTAGACACT TTCACTGGAT AGGTAGATGC CTTTCCCACA GGGCCTAAGA
AGGCCACCGT GGTCATTTCT TCCCTTCTGT CAGACATAAT TCCTTGGTTT GGCCTTCCCA CCTCTATACA
GTCTGATAAT GGACAAGCCT TTACTAGTCA AGCACGCAA GCAGTTTCTC AGGCTCTTGG TATTCAGTGA
AACCTTCATA CCCCTTACCG TCCTCAATCC TTAGGAAAGG TAGAACTGAT TAATGGTCTT TTAAAAACAC
ACCTCACCAA GCTCAGCCTC CAACTTAAAA AGGACTGGAC AGTACTTTTA CCACTTGCCA TTCTCAGAAT
TCGGGCCTGT CCTCGAAATG CTACAAGGTA CAGCCCATTT AAGATTCTGT ATGGACGCTC CTTTTTATTA
GGCCCCAGTC TCATTCCAGA CACCAGCCCA ACTTGAACTG TGCCCCAAAA ACTTGTCATC CCTACAATCT
TCTGTCTAGT CATACTCCTA TTCACCATTC TCAACTACTT GTAAATGCCC TGCCCTTTTT TACAGTGCTG
ATTTATACTT TTCCTCCAAA CCATCATAAC TGATATCTCC TGGTTTTACC TCAAACCGCC ACCCTTAAGT
CTCTCTTAAA GTGGATAGAA GATCTTCAGT GACAAGGTAC ACTCCAATAC TTTCACCCTA ATAAAGCCCT
ATTCTTTACT TTTATATTCA CTCTTATTCT TGTTCCCATT CTTATGCCAC TCTCTACCTC TCCCCAGCTA
TCTCCACCAC ACTATCAATC TCACTCACTC TCTCCTAGCC ATTTCTAATC CTTCTTTAAC AAACAATTGC
TGGCTTTACA ATTTCTCTTT CCTCCAAAAT CACCGAGTCC TCAATTTACT CACTGCTAAA AAGGGGACT
CTGCATATTT TTAAATGAAG AGTGTTGTTT TTACCTAAAT CAATCTGGCC TGGTATATGA CAACATAAAA
AAAACTCAAG GATAGAGCCA AAAACCTTGC CAACCAAGCA AGTAATTATG CTGAACCCCC TTGGGCACTC
TAATTAGATG TCCTGGGTTC TCCCGATTCT TAATCCTTTA ATACCTGTTT TTCTCCTTCT CTTATGCAGA
CCTTGTGTCT TCCATTTAGT TTCTCAATTC ATACAAAACC GTATCCAGGC CATCACCAAT CATTCTATAC
GACAAATGTT TTAAGGGAGG AGACCACCCC TCATATTGTC TTATGCCCAA TTTCTGCCTC CAAAGAAAGA
AGTAAAAATG AAAAGGCAGA AATGAAATCC ACAGGCAGAC AGCCTGATGC CACACCCTGG GCCTGGTGGT
TAAGATCAAC CCCTGACCTA ATCAGTTATG TTATCTATAG ATTACAGACA TTGTATGGAA AAGCACTGTG
AAAATCCCTG TCTTGTTCTG TTCCTCTAAT TACCAGTACA CGCAGCCCCT AGTCATGTAC CCCCTGCTTG
CTCCCCCTGC TTGCTCAATC AGTCATGACC CTCTCACGCA GACCCCCTTA GAGTTGTAAG CCCTTAAGAG
GAAAAGGAAT TGTTCACTCG GAGAGCTCGG TTTTTGAGAC ATGAGTCTTG CCAATGCTCC CAGCTGAATA
AAGCCCTTCC TTCTTTAACT CAGTGTCTGA GGGGTTTTGT CTGTGTCTTG TCCTGCTACA GTTTCATCTA
ACAACCCCAT AATATCACCC CTTACCACAA AATCTTCCTT CAGCTTAATC TCTCCCACTC TAGGTTCTCA
CGCCACCCCT AATCCTGCTC GAAGCAGCCC TGAGAAACAT CGCCCGTTAT CTCTCCACAC CACCCCCAAA
AATTTTCACT GCCCCAACAC TTTACCACTA TTTCGTTTTA TTTTTCTTAT TAATATAAGA AGATAGAAAT
GTCAGGCCTC TGAGCCCAAG CCTGCACGTA TACATCCACA TGGCCTGAAG CAAGTGAAGA ATCACAAAAG
AAGTGAAAAT GGCTGGTTCC TGCCTTAACT GATGATATTC CACCATTGTG ATTTGTTCCT GCGCCACCTT
GACTGAGGGA TTAACCTTGT GAAATTCCTT CCCCTGGCTC AGAAGCTCCC CCACTGAGCA CCTTGTGACC
CCCACCCCTA CCCACAAGTG AAAAACCCCC TTTGACTGTA ATTTTCCACT ACCCACCCAA ATCCTATAAA
ACAGCCCCAC CCCATCTCCC TTTGCTGACT CTATTTTTGG ACTCAGCCCA CCTGCACCCA GGTGATTCAA
```

-continued

```
AAGCTTCATT GCTCACACAA AGCCTGTTTG GTGGTCTCTT CACACCGACA CGCGTGATAA TTATTATATT
ACTTTTAACT AAAACCCTTT CAGAGTCTCG CAGGGAAGGC TGTATATATC TCATAAAATG TTGGGGCCCA
CTGGATCAGA CAAGGCCACA AAGGCCAAAG GGAAGTAAAG ATCTCATTAT TTCTCCTAAT AATTTCCCTG
TCCTTTGTCA TAAATGGTGG GTAGGCTGTT ATGGTGATGG CAGATTTTCT TTCCATAAAA TGTCCATAAT
AGGACATTTG AACAGAAGGG AAAAATCAAA TTGCTGAAGT TGAAAGAGGG CAATGCAAAG AACTTTGGAG
AAAGAACTGT ACAGAGAAGT CAACTGGCAG ATGGGAGGAA GTTTAAGGGG AAAAATATAG ATGTCTAAAG
AATACATTTA TTCATTTTCC ACAGTGCAAT TTGGACAAGA AGCCTCTTTC TTGCTTCTTT CTATTCTCAT
TAAATCATTA GAGCTCAAGC AATCCTTCTG CCTCAGCTTC CCGACTAGCT AGGACTACAG GTATGTGCTA
CTATGCCCAG CTAATTTTTT AAAAATTAGA TTTTAATTTG GTGAACTATT TCTGTAGGAA ACTACAATAA
TACAGCCCAG GCACATTGAT CTTGGGTGAA CAAATCAGAA GGAATGAATA ATTCTGTGTT CCTGGGACTC
TGACAATTTC ATGAACTTGG TACTCTGAGT AAAGCATAGG AGGAGTTATT TCATAAAATG TGGAGCACAA
TCATGTGACA AGATAATGG GATCCCCATT TCATAAATAA ATCTGAAGTT CAGAGAGAGT AACAACTGGC
CAGGGTCACA TCACGGAGAC AGAGGCAGGG TTCCCACTGA TGCCTCTGAC TCCCTGTCCC AGGCCCTTCC
TCCTCCCGCA AGCAGAAGTG CAGGGGGCAG AGCTGACCCT GTGCAGTGAA AATCTGAGGG CTGAGTTCCT
ATTGGAACAC AAGTGAAAGA CTTCCTGGCT TCTAATCTCA GGATAAGGAC TCAGAGCTCC ATCTGTTCCA
GCCTTAGGAT AAGAACCAGA ATCTTACACC ATGAAAGCAT GAAAGGTAAG ATTTGAGTGA GGAAAAAAAA
AAAAAAAGTC TGTGTTTCAG ATTCAGTTCA CAAAGCAGTT TCATACTTAA GGTACCATCA CAATAACCCT
GTGGGGTAAG CAAGGCAAAT TTCATTCTTG TTTTATGGGC ATAGGAAGTA AGTCTCAGGG AGGTTAAGAC
CAAGGTTTCT GGAGAATTTT ATATTATGAA TCTTGATTTA TGGGATTACT ATTATGTAAT TCCTAAGATC
ATATAGGAAT CCTAGAGCTT GAATATAGAA CTTTATTTTT AAATCTATAT ACATCATAAT TACAAGGAGT
AGTGTCCATT TGGGTTCCTT GGCCCTGATG TGTTAGTGGA ATAAACATTT TTGTCAGGGT TGCCATGTGT
GTCTGTGCAC GTGTGCACTG TACACCTCCA GGGGATGTAC CCTAAACCAC ATGAATGTGA TTTGCACATC
CAAGATTTAC AGTGTACTAT AGGGAGAATC TTTTGCAACA GCTTTTGCTA TAATACAGAA TCTGAGATGT
CTTTGAGAAA GAAAGTGTA ATCATTACCA AAAAATTATT CTCATAATGT GTGCAAATTT GTATGAAATC
TATATTGGCC ATGGGACAAG GAGGTATTTC CAGCTAGCTT CTGAAAGGGC TCTATTCTCT CATAAGAATT
CAGCTGTTGA CATTAGGTGA TATCTGCCCA GGTCATCAGA TGCCATAGAG AAAGAGGGTT TGCTGAAACT
TATATCAGCA GTGCACTGTA TGCTCTTTCT GATTTATTTG AACATTCATT TATTGAGTGT CAAGTAATGC
ACTAGATACT CCAGGGATCT GACACAAACT CTGCCCTGAA GGAGCATGTA ATCTCACTGG GGAGAAAACA
AAACATATGA TAATTTCAAA ATAACAAACT AGGCAAACTA GTTAACACTT AAAAAGCAGG CTTTATTCAA
ATGCAAAATT GCATGTTACA GGGTAACCTT TCAGTAAGAA GCCAGGAAGA GGAGCTCATC ATGGGTTGGA
TTAGTAAAGG ACTAGTTATA AAAGAAGTGG TGGGGTTGAG GGAGGCCTGA GATGAAATTT AAAGAATATG
TAGAATCTAG GTAAGTGGAT AAAAGGTCTG GGGCAGGGG AAAGGAGAGC ATTTCATTGT GAATCAAGGA
ATTTCTCCAC CTGTTTTAAC TCTTCCATAT GACATCAAAG AGATGTCACT TGCAGCTAGC ATTTCAGTGA
TGTTTTCTTA CTAATAATAT CGTGATAAAA GAAACATTGA CTATAAGAAA TAGGAATGGG TCTCATAAAA
GGAAACAGCA AAACCCCCAA ACTAAAAAAC AGCGCAGGCT ATTTCTCTCT TCTCTCCTTT TGCTTGGCAC
TCATGAGATG CTAGGTGTGG AAGTCAGCCA ACTGAAAAAG AGAGGTGGCT GAAGAAGGTG GGGAGGCTGA
AGCCAGTTAA ATAGGATGGT CCAATTCACA GACGGCGAGG CTACAGTGCA AATAGGACTC TTTCAACTTG
AGCAGGACCC CATTACTTCA CTGGAGTTAG AAAGAAAGGA GAGCGTAGAC TTTTTGAACT TTCTATAAGA
GTGTACCTCC ACAGTATACA GAAGACGACG TGAAATTTGA TCTGCAAGAA AACTGAGTCC ATATTCACAT
ATGTATCAAA TTTGCACTTC ATTTAGAAGT GTCTGTCATC AAGTACAGCA CTGAATTGAA ACTGAAAACA
```

```
AGAGTCAAGA AAGAGCAAAG TCAGCCATCT TTATATTCCA CATGAATCCT TTCCCTTTAT GGTCTTATTT
GTTTCTCCTC AGAAAAGACA AAAAGCTGAG CTGTATAAAC ACCTGTGGGC TGGGGGTTGA GGGATAAATG
AGGGGCGAAA TGGAAGCTGA AGGAACTGTT GGTCAGGTAG AAATCTTCCC AGATGCACTG AAGGAAACAC
ACTTCATGTT TGACGTAGGA GGTGCCACCA CACAAAACGT TTCATGGAAG GATTTAAAGG ATCTCATGAT
TTTTAGTATT CCAAGAATTT TCTTTCACCA AGGGCGATTT AATATGGGTC ATTCATACTG AAAGAAAAAC
AAAAGATAAT AAGAGTTTAA AAATTGCAAA ACTTGGAGTG TTAGTAGTAA AGGTAAATAT TCATTAGAGA
TGAGAAGAGG AGCAAGGAAA TGCTTTCAGC TGGAAATCTC AGACAAGAGG CCAGGCTTTA GGAACCTCTG
AAGATGAACA AATGTAAGCA AACCCTAGTA GCAGCACTTC TCAGATTTTC ATGTGCTTAC CACTCAGAGA
TGGTGTTAAA ATGCAGACTC TGATTCAGTA GGTCTGAGTG GAGCCTGAGA TTCTGCACCC CTAACAAGCT
CTTTAGTGAT GCTTATGCCA CTGGCGCACA GACCCCACTT GGAGAAATTT TGTGGTGCA TACGGTCTTT
GTCTCCAGAT CTAATGAGTC TGAAGGACAG TGTAGATTGA TTTTTTAAAT TTATGTTTAT TTTAATTTAA
TTTAATTTAA TTTATTTATT TATTTATTTT TGAGATGGAG TCTCACTCTG TTGCCCAGTC CGGAGTGCAG
TGGCACGGAG GCAGCTCATG CAACCACGGC CTCCTGGGTT CAAGCGATTC TTCCGCCTCA ACTTCCTGAG
TAGCTGGGAA TACAGGCACG TGCCAGCACA CCCAGCTAAT TTTTGTATTT TTAGTAGAGA TGGGGTTTCA
CCACATTGGC CAAGCTAATC TCAAACTCCT GACCTCATGA TCCACCTGCC ACGGCCTCCG AAAGTGCTGG
GATTACAGGC GTGAGCCACC GAGCCCAGCT GTAGATTGAT TTTGAGCAGT GGAAAGTCAA GGAATTAGAA
GGCATGCTTA AATGGAAAGT GAAATTGGAG AAAATTTAAA CTCATGAAAT AGTGGTGGTT ATAAACTCGT
GATAAATTAT ATCCTGGGAT ATAATTTAAT GAGATGGTAA CACATTTAGT TTAAAGAAAT AAGTGACACT
TTTTTTGTGT GACACAACTG TCTTATTCTT GGAAAGGACA AGGAGAGAAT GAAATATGGT ATGTCTTCAC
AGCACCTTTC AAAGGGAGAA CCAGATTCTG AGGAGCTGGT CTCATGATGA ACTGTCAGGG TAAACCACAG
TTCAGCAGCT GCAAATGTGC TTGCCAAAAT AGAGACAAAA AAATGTTTCT GAAAACAAAA TTTCACATAT
GCCCTCCTCT GAGGTTGGCA TCATATCTTC CTGTGTATCT TGGGTGTAGC TTCTATCCTG CCAGAATTTA
GACAGTAGAA ACCAAATGAG GTGATAAACA GAGTCATTTT GCAGAAGAGT CAAAATAACC CAGCAAGAAA
TGAAACCACA AATGCCCAAG GAGTCATTCA TTCACCATTC AAAAGCTAAT AGAAATGAAC ACAAACTACT
ATGAAAATTC ACCCAAGAAC TTAAAAAAAA AAAAAAGGC TCATGGTGTT TAGTGTGATA GTATTCATTT
TACCTTTGAC TTGTTCTAAA AACACACCAT ACTTCTACCC CACCCTTCCT CAGTGCCGTC ACACAATGGT
TTCAGTGTGA AAAAAAAAC CACGTTACTG GAAAAGGAGG GTGCCTGGGA CTTGCCACTC TAAGCTGGTA
GTCAAGGGTC TTGAGTTCTA AAAGCATACG CGTTAAGAGC ATGATTCCTG GATCCAAATG AGTATGGATC
TCAGCATTGC CATTTATTGT GACCTCAGGC TATTTTATTT CTCTGTGCCT GTTTCTTTAT CAGTAATGAA
GATGTTCATA GACCCTTCTC CCACAGACTT AAAGGCATAT TTCATGATTT AAGACATGTA AACCATTCAT
AACAGTATAC AACATGGAAT TAATATTTGA TAAAGGTTTA TGATTATTGT AACTAACTCT GTCACTTGCT
CAAGGCCTAT AGAAAACTTA CTTAATTAGT TCAACTACAA AAAGAGTTTG AATGTGATAT CCACCAAGAT
CATATTCAGA CCTAGAATTC TGTGATTCTT ATGAATTAAT ACAGCCCTGG TCAATAAATG AGAGCTGGGC
AAATAATTCT TCTTTGCTAG GCCTTTCTAG ACCATCTGGT GAAGCATTCA AGACTTATGT TATTGGGGCC
AGCCTTCCTT TCCAACTTCA ACTCCACAAC TCCTCAATAA GCCATGGGCT CAAGAAAGTT CTGCTCAGTG
GCCCCTGAAA AATGCTTTCA TAGTCTCACT ACCATACCAC TGCCTACACA ATTTCCTTCC TACAGACTGC
CTTCCTTTCC TGCTTTTCTC CATATACCTA AATCCTATCT ATTCTTCATA AGCAACCTTC TTTATAACAT
TTTCTATAAC CACCAAGCCA AATGACCTTT TCCTTCTTAA ATATAGCACC CATTGGCCAT TACCATGCTC
TGCCTTGTAT TTTTCTGATT TTTTTCTTTC TATATTCCTG TCTTAACTCC CCAGCTAGGT AATAATTTTC
```

```
CTGAAATCAG GGACCAGGCT GACTCCTCTT GCTGTCTCAA GAAAGCTTAG CAGTTTCCAA CACAAAAATG
TTCAATAAAC AACTATTAAT TGACTGATTA TAAAAAATCA GTGAACCATT AAACTTAATA TAGCAATTTG
CTTAGCATGG TAATTAGCCT TTTGCTAATA TTCTTCCAGC CAGTCTCTCC TCCTGTGCCT CAAGGACATC
TTAAAAAAAA AAAATCTAGT TGATCTGCTT CCATCTAGTG GCAATTAAAA CAGGTGGTTC CGGTAGCCAG
AAAACAGCTC TGGGTAGATT GTGCCAGAAA ATACTTTCAC TCAGTAGGTG CGAGTTTGAA AGAAATCTTC
ACATCTGTGG GTTTCCTGCC ACAGACATAG GGAGACCAGC CCAGAGAAAG AAGCCTTTCC TCACTAGACT
CCATTTGCAC TAGTAAAGAG AAGACAGAGT AATTAAAAAG AATAAAAAGA ACCTCCACTG ATCGTACATC
CTCATCCAGT TACCCCTGCC CCACTTCTCC TTCACAGCCA AACATTTTAA AAGAGATGAC TGCTTGTTCT
GTCTCTACTT TCTCATCCTC AGTAATGCTC AATGCTTGGC CGTCTGACCT CTGTCTTGAT GTCTGCACTG
CAAATAGTCT CCCCACTGAC ACCCTTGTTG CATCCAGGGG ATACTTACTG GTTCTCTTGG CAATGTTTGA
AACCGTTCCC CTTTCTTTGT TTCCTTGGCA TTCATTACCC CACACTCTTT CTCCTCTTCC TTCTCCCTGC
CTGGCAACAT CTTTTCATTT CTCTTTCCCT TAGGTGACTT ATTAGATAAT GATGTTCCTC TGGGTCCCAT
ACTCTCTCCC AGGTCCTCTT CCATTCTTAA AGCACTCACA CCCTCCCTGG ATGATAGTAC CCACTCCTGA
GATGGCAGTT ACCTCCTGAA ATGTGAGGGA CCCAAATCCA CTTCTCCTGC CATAGCCTCT GTGCTTTGGA
TAGGTCCAAT GAGCCACAGT GAATGATGTG CATACACCCA AGCTCAGTA CAAAACTGAA CCCATGATCT
TTACCTCCAA AACCTCTCAT TCTTTTATGT TCCCTTCTCA GAAGTAAACA GGACTACCAT CCGCCAGTTT
CCAGGTGAGA AAGATGATAA TTTGATTCTT CTCTCTCACT TTTAGCCAAT TAACAGACAC ATTCAGTTAA
TATCACCTCC TCTTATTTCA TGAACCCATT CTTACTACTA GTTCCCTAGA CAGGCGCCAT CGGTTTTAAT
CTAATAACTG CAAATGCCTC CAAAACAAGT CTCTTTGAAT CCAGGCTCAC CTGTCTCCCA CACTTGCCAT
ACTGCTCTGC AGGGTGACCT TATAAGATGC CAGAGGTAAG GCTACTCACT GTTTAAACCC CTTTAGTGAT
ATCCCAAAAG ACCTCAAGAT AAAGCCCATA TCACATGGCT TATACATTAG TTTATGATCT GGCTTCTGGT
GCCTCATTTT TCCCCACTTT TTCCTTTGCA TTCTAAGCAA TGGCCCATAC TAAGTTTGTG ATTGGTAGGA
TGGTTGCCCA AACCAGCATC CAATCCCTTC AGAAATCATC TCACTTCATT TCTAGCATTT TAAAGGAAGC
TCAGTTGTCC AGCTGGGTAC TGAATATGTC ACCAAAGTCC TCCTTTCATA GTTTATTTTA CTTAAACTCT
CCTTCCTAAA ATTCCAGAGC AAGTCACTAA ACCCTAGATA CTGAGAAATA TTTTTCCATC TTCATTTCTG
CCAGGTGGGC CATCAACTTT CACATGTCTG CATCTCCTCC CACTGTGCTA TTTCTCCAGT AGAAGAAATT
TGAGCTTCAA GACCAAACTG AAAAATACTT GCCTCCTTGG GGAAGCTGTA GGTAGAATTC ATGCTCCCTA
TCTTTCCCAC ATTTCTGAAG GACAATGCCT GTTAGAGCAA TTGAATGCAA ATAGTCAATT GAATAAGCAT
TTATTCATTT CTCAATAAGT GCTTGTTCAA TTGAATATTT CTTAAATAAT ATATTTAAGA ACAAGAAGAA
CACACCACAA TGTTTTTAAC CCTCAGAAAA AATTCTGAGG TAATCAGAAA AATCTCCCTT TACATAAACT
GCCCTTTTCT AATAGGGATT ACTTGTTCGT TCATTCATTC ATTCAGCTCC ACTAGCACCA AAAAGCACAG
CTCTGAAAGG AAGCTAGTAG ATTTATCACC TTATCTGGTC ATTTGGATGA GGACCCCAGG TAAATAAACT
ACTATGGGGT TAATGTGTCT AGCTAGAGCA GGAAGTAACT TAAGGAAGTA GAGAATGAAT CAGCAGATGT
GGAAACTCCT CGCCACTAAT AAAACTTACC TTCTCTTGGA TTTCTTGCCT GAAAATAGAA AATAGAGAAA
AGGCATTAGC AAAAATTAGA CAATTTAAAG TTTTTCAAGT AAGGGAGAAG GAAGACTCCC ACTCTCAAAA
CTGTCTTTTG AAGTATATTA GGTATTTGTT AGGTGGACCC TATCTGTGTC AAAGGAGATT TGAGGAACTG
GCTTAATAAA CAGTGGTAGA CACTAATACA GAACAGACAT GTTGATGCAG ATGCCTCCTG AGGTTCCATT
CCATTCTCCG TGCTACTCAA GAAGACAGAA 25441 TTGCTAAATT GCCTGGTGGC AAGACCCAAT ATGTCCATTC
AAGTGTTTAT CCCTTCCCAA TCTGCCATCT CATCCTACCT GCAGATTCTT CCCTTGAGGG ACAGCTGCTA
ATACTGTAAA ACTATGTGCC ATTACAGCTC ACAGCATCAT CTCTATGAGA ATCCACAAGA GAATTTCACT
```

-continued

```
TTGGTCTTGT TGGTAGGAAT TGTGCAGCCT CATCTGAGTA ACTAATGTGT TTTTATCTTA CAAACACAAG
GAATATCACA TGGTTCTCCT TTGACTGGCT GTAAGGAAAC TCAGAGCTAG ATCTGAGACC CTCTCCTACC
AAGTATATAA AACTTTGTGA CATACATTTT TGTGCCATAA CTTCAACCTT GGTTCCAAAT GATTTTTGTA
CCCTAAGTTT AAATTTGGCT TTTTTTTTTT TTTTTTTGTA CTCAATAAAA CATCAAGCTC ATTTATTATT
GCGAAGAGCG AAACAACAAA GCTTCCACAG CGTGGAAGGG GACCCGAGTG GGTTGCCCAA ATTGGCTTCT
TTTTCTTACT TTTTAATTAA TTTTAATTTG CTATACTGAA CACATTTTGT ACTGTTCTCA CATTCTTTTT
GAAAAAAGCA GAATATAAAT AAGTAGATAA CTTAAAAAAA ACTCTTTGAG CAGAAAGAAT CATTTGGGAG
GCAATATATT TCAGTGGCTG TAAAGTGGCA TTCTAGAATC ATCCTACCCA GGTGAAAGCC CTATTTTGCC
ACCTGTAGTG TAGTGTGTAT TTGAACAGCT ACTTTCTTTT CTAAACTACA ATTTCTTCAT CTGTTAAAGA
GGCATAATAA TTGTATCATC CTCATTGGGT TGATAAAATA AAATATTTCC AAGTATTTAG TTCAGGTCCT
AGCACGTAGA CAGTGTTGCA TTACTGTTTT AATCCTTTAA AGTATTAAAG ACTACTATTT GAAATCTTTT
CTTCTAAAAT TCAGCCTGCT GATGACCAAG TGCACTTGAG CAGGGGGAAT CAAATCTGAA TTAATTTCAG
ATTCTGGTTA GCTTCACATA AATATTTTTT TTAGGGATGA TGAACCTAAC AGCAATAGAT GAGTAAGAAT
CTGTTCCTAC TGAGAGAGTT TCATTTTGAA GAAAAAGGAA CTAAGGGGGC ATGTGTTCAG TTTCATGCCC
TGGTCTAACC CTGTGTGTTG GTTCTGGTGG GAAATTCTTC CAACCGAGGA AAAACCAGT TCACAAATCT
GAAGACCAGT GATTTTAGAA GATGTATCTG GACTGGAGTC TAATCTCTGA CTCTGGGTCC TGCTGATATG
GTATTTTTGA GATTTGGCCT AAAACATCAT TGCCCTGGTT TCCTTATTTA CCAAACAGGG CCAATGGTAG
TGACTAATCA GAAAATGATA ATGCCTGGTG CACAAAATGT GTCTAGATGA GCCCATGCAC AAGGACACAT
GTTTCTGGAA CTGTTCCTTA TTCCTTTCCT AAAAGAAAGG AGGGAAAGTC TCCATACTAA GACTACTAGG
GCAGGGGACA AAGTGCTAGA GTCAGAAGAT TCATCTGAGG ACAGAAGAAT AGGGGTGAAG GCTCTAGTCA
CTTCATTGGC TACCATGCTC TAAATAGTTA CCTGTGCCCT TTTTCTAACT ATTAGAACCC AAAAAGCCTA
TAAATTCTCT CTCTCTCTCT CTCTCTCTCT GTGTATATAT ATACATATAC ACACACACAT AGACACACAC
ACACACCTAA ACACACACAT AGAGATTTAT GACTTTTTAC TTTTATCCTT GTAAATGCCA TTAACTATAT
TTTGTCTTAG ATTTAGCCTG GGAATGTAGC CATTATTTCT ACCATTGCCT CCATAGGAAA AATACTCTTC
ATGTTTTAAA GGACCAACCT ACAACTAAAA TCTTTGGAAA GCAGAATCAT TTGTAAGTTG GTGAAAATGG
AAGATGTTGT TTTATAAATG AAGACTTTTT TTTTTTTTTT TTTTGAGACA GGGCCTCACT CTGTTGTGGA
GTGCAGTGGT GCTGTCATGG CTTACTGCAG CCTTGACCTC CTGGGTTCAA GTGATCCTCC CACCTCAGTC
TCCTGGGTAG CTGGGACTAC ATGTGCATGC TACCATGCCT GACTAATTTT TTGTATTTT GTAGAGATGT
GGTTTCGCCA TGTTGCCCAG GCTGGTCTTG AACTCGTGGG CTCAAGTAAT CCTCCTGCCT CAGCCTCCAA
AAGTGCTGGG ATTAGAGGTG ACAGCCAAGG TGCCTGGCCC ACAGATGAAG ACTATTTAAT GTTATCTTAA
AGATACCCTA AGCTTCCTAC CAAGCCAGTG ATCTTTTGGG GCTTCTGTTT TCTTTGTTGG CATAACTGTA
ACTAGCCTAA CTGCCCGTTA TCTGTTTCCT GTTTGCCCCA CACTGATTCC CACAGCAGTT TTCAAGTTAT
CGGTTTGAGA TCTTGTACAG AAATGACTCC AAGGTAAAAA ATTTAAAAAC AACCCCTCTA ATTTTTTTAC
CCTTGCTTAT AAAACAGCCT TAGCCAGCTA ACCCCTCACT ACATGCAAAT GAGTTTGATT CTATTCTTTT
GATTCTACAA ACACTTATTA AAAGATTTTA GAATTCGGAA ATAAATAGCT TCCTTATTAA GGTGACTTAC
AGCCCCAAAG TCCTTAAAAT TATTTAGACA ATAGCCACCT TATCCCAGGG GGCAGTGTGT AATAACCCAC
CCTGTTCTCT ATCCGTCAGT TCTGCCATCA TCGCCCAAGG TAGGAAGAAA GACAGGACAA CCGGGGTCAA
GATTTGAAGT CTCAATGGAA AGAATAATCA GTGGTTGGAG AAAACTGTCA TTCTTCTTTT GCCTTAATGC
AGTACTTGAT ACTTATACTT AGTACTGTAT AGTACTTAGT ACTGTATAAT ACTATAAGAT AGTGAGATTC
```

```
AATCAGCACA GAATTTCTAA TAGCAAGGGC AGAGACATTT TAACTGCTCA GTGCTCTCAG GTTATACATA

GCTAATGAAG TTCTTGCATA TCAACAATCC CCACCCCCCT CACACACTTT GTCTTTCTGG ATTGGTTAGA

AAACTTACCT AGCGCCCACT ATTCTCAAAT TTAAATGAAA GATAAGATCA GAGTGGCACG CAATTAGGGA

CTGATAAATA ATATTTTTGT AATTGCCAGT GTAAATGGAC AGGGGCAAC CTTTACATAC CATATTCAGT

GAACAGAATA CGTACTAACT AATTTGATGG AAGGAAAATT AAAATGACAA TCAACTGAGC CCACAGAAAG

GCAACACAGA GCAGTTGGTT AGCAATTGTT TCGAGATCAT CCCTGAACTT GAAACAGGTA TATCTTTTTT

TTTTTTTTTT TTGAGACAGA GTCTCACTCT GTCACCAGGC TGGAGTGCAA TGGTGCGGTC TCAGCTCACT

GCAACCTCCG CCTCCCGGGT TCAAGTGATT CTTCTGTCTC AGCCTCCCGA GTAGCTGGGA TTACAGGTGC

CCGCCACCAC GCCTGGCTAA TTTTTGTATT TTTAGTAGAG ACAGGGTTTC ACCATGTTGG CCAGGCTGGT

CTTGAACTGC TGAGCTCATG ATCCGCCCGC CTCGGCCTCC CAAAGTGCTG GGATTACAGG CATGAGCCAC

CACACCTGGC CAAAACAGGT ATATCTTAAA AGCTGCCCAA TGTCCATGAA TGTTACAGCC TTGAATGGTT

CTTGCAGGTG AGTTTGGCCA AATGTGGCAC CATACACCCA AGGCCTGCTG CAGGCTAGTG GGTTGCTCAC

ACTTTAAAGC TGAGACACAC TCATGCCTTA AGGTAAAGGG AGTGATAATC TGGGCAGCAG ATGTTAACTT

CTCAAGGCAG TCCTCCTTCT CTTTTCCTCT CCAGTGACGG ATGGTTGGAA AGCATATATG GTGCATTTGG

TTAGAGCTGT GGCCTTGGTG AATAGATACT TGGGAGAATA CATGGGAATT CTCCCAGGG TTAATGCAAT

GCCCATGTGT TGGGAACCAG GTGACTCTTG AAGAGGTCAG GTATTTGGGA GCAGTGCCTT GAAACCTTAG

TGGACATTAG ACCCACTTCC TAGTGGAATT GTAGCATTGA AATCCAAGGC ATGTAGGCTC TTAGAGGACA

GAGATAGTGT GTCATTTTTT CAGAATTAAT TAAGAGCAGG CCAGGCGTGG TGGCTCACAC CTGTAATCCA

AGCCCTTTGG GAGGCCAAGG CAGGCAGATC ACGAGGTCAG GAGATCGAGA CCACTCTGGC TAACACAGTG

AAACCCCGTG TCTACTAAAA ATACAAAAAA TTAGCTGGGC ATGGTGGCAC GCTCCTGTAG TCCCAGCTAC

TTGGGAGGCT GAGGTGGGAG AATAGCTTGA ACCCAGAAGG CGGAGGTTGC AGTGAGCTGA AATTGCACCA

CTGCACTCTA GCCTGGTGAC AGAGTGAGGC TCTGTCTCAA AAAAAAAAAA GTATTAAAGA ATTACATAAG

AGCAAAGAAC CATTAGAATA TCTCACTTAG TTGTTATCAG CCTAGCAAGC TGCCTTGAAG GTAATAGACA

TTTTTAAAAG TTTATCAGAT GAAAAGCGAA AATCAGCCAA CCTGTTTTAA TGAAGGTGTG TCCTGGGCTG

ATTTACATGT CTCCAGGGAC TGATGGCTCT AGAATGTAAA GCTTGGCATC CTGCTTGTGT TGAATCTATC

ACATTTAATT TCCTGTGGGT TTCTTTTTTT TTTCTTTTTC ACTTTAAAGT TGTGTTCTTT TCATGTGAAG

TTAAACTCAC ATACCTTTTT TTAATCTCCT TGCCAGCCAA ATGATAAATG CCAACCCAGA GAATGCAGTA

ACCATGACTG CCACTGGAAT GAAGAGGGGG TTATAATCAC CCTCCTTAAT CATTGAGAAA CTTTTGTCCA

ATTCTGAAAG AGAAATCAGT AAGGCACATA GCATGAGACC ACCAGCATTA TTTCCTTAGT CTATCTCATG

ATATTTGACT TTTTTCCTCC TTACATCTCC CAGTAGTAGC CCATTTGATG CCATTTGACA GATGAGGAAA

CTGGCATGGG AAGGCCCCTG ATGAGTCTAC AGCATAGGCA AAGACTGGAC CAGCCTTGCT AGTCTAATGC

CTACAGAATC TCAATGCCCA GATTTGTGGT TCATAGAGTT CCTGAAAATG CACCTAAAAA TGTTGGCAAG

AATGGTCATC GTTGTATTTA GCTCCATGGA CTTGTTCAAT GACTGGAACT CTGAAACACA GAGAAGAGCT

AAAAGCCTAA TACAACTTCA GGAAAAATAA AAGCCAATGA TCTGAACTGG ATAATTCACC AGTCAAAGGA

AATCATTAAT GCTTTTACTT TAAAGCAGTT GTGCAAAAAT AAGCACTTGA TTTTTACATG CCAAGGACCT

GCACTAATTT CTTTCCAATG CAGTAGTTAC CACTTCCCTC TACTTCCTTC ACGAATAAGT AAAAGGGCAT

GTTTAGAGAT ACTCTTGTAA GTGTAAACTA AGTTCATTTG GGAGCCTCTA TTTGAAAATA CTGGTATAAA

AAAAAATCTG TCTCCTGATA CTAACATTTG AAGGAATCTA CTTTTTTACA TATTGGCAGA GGGTCTGATT

CTATCCTTAG TTCTTCCCAT TACTTTGATG AACCTTTTCA AGGTGATTTG ATCCCCACAC CCAAATATAT

GATTGAGAGA AGGCTCAAGT TCCCAGGAGC TCCAGACAGA AGGTACCTGT TGGCTTGATG AAGATGAGGA
```

-continued

```
GGAAATGAAC ACTAGCTAGG CCTTAAAGGG AAATGTCTCT GATAGGCCTA ATACACAGTC CTCTGCTAAA
GGCCTCCCTG CCTCTCTCTG CTCATCCACT CTACTCCCTG GCCCTGGGCA CGCAGCACAC AGAGATCAGC
ATTTCTGACA GCTTCTGTAG ATCCTACCAT TTAAAGACTT TTGTCATCCA TGCAGATAGT CTCAGGAGCA
GACACAGGTA GCTATTCTTT CACATGCTAG CTTAACATGC ATTTGCTTTA GCACCTATTG CCAGGCACTG
TGTCAGGTGG AGGGTATACA AAGATGAACA AGACATGATT CTTCTCATAT ACAGATAGAT TTTGGAGGCA
TTAGCTTAGT GATGATTCAG GAGTATCCAT TATTTGGGGA AGTAGGTGGT CATTAGTGAC CTTTTACAGG
CATTTCAATG GGCTAACAGA GATGTTAGAT TGTAGTGGAA TAGAAGAATG GGTAAAAAGT AAATCAGTGA
GTTCAGATTT TAGGAGTTAA GATGGCAAGA GGTGAGAACA AAAAAAGGAA ATGATTGTCA TTAAAGGAGG
AGGAAAGACC AGCCAAAGAT TTTACAGTGA GTTAAGCATA CAAATTTATT TCTAGGCCAC ATATTCTTAG
CAAAACAACA TGTAAATGTT TATGTATGTC TTTCCTCATA TCTGCTCATC CATCAGCTCC ATCGTTAAGA
TTTCAGTTTT CCAGGACAAA CTTACTCACT TTGACATATT GGACTAGGAT TTGACCAGAT TCCAGATGAT
TCACAAATGG TTTTCTTCTT CCCAATTAAC TCAGTTCCTT CTGAGCAGAT GAAGGTACAT GCAGAGGTAA
AGCTGAAGCT GGCCAGGGGA TGGCTACAGT TCATGATCCC CAAATCTGGT GCTGATAGAG GCTCACACTG
AATCACTTCA ATGAAAAAGA AAAAAAAAAA AAAGACAAAA CAGTATTTCT GAGTAGAGAC CCTCCCTTGA
GCAAAGGATT TTTAGCCAAA GCTGCCTGAC TACATTACTT GTGATATTGC TTCCAGGCTT TATTTTCTTG
AGAATGATGG TGGGTGGTGA ATGAGAGATG AAGGCAAGGA AGCATTGAAA GCTGTGGGGA GAGGAGTAGC
TACTCCAGGC TGCTGCCCTA GCTAAGGTGA CCCTCCCCTT CTGCTGGAAG TACCATGCCA TATGGCCTCT
GCATCAAGGG CTCTTATGGG ATATTCTCAG AGAATCTCTG CCGTTTCATC TGTTCTGATA TCTACCCAAG
CATTTTGAAA AACATCCCAA TTCACTGAAG CAAGTCCAAC TTCCGTAAAT TCCAGTAGGT GGGTTGACAG
TTTTATAATT TCAATAAGGG ATTTTGATAG CACTTCTAAG AATTAAACTA CTTAAACTAA TGCATCAGGA
GCATACTTGT AGAAAAGTTA ACCAAAACTT CGTAAGTTCA GATGACATTG GTTTTCTCCC ATATGGAGAT
AAGGTTGGCA GTTAAAAATG AAAAAAAAAA AAAAACCTAC CTTATTTCAA ACTTGAAAAG ATCAAGAGAT
TGTGTTTTTG TTTTTCAGTT GTTATTCTCC TAAAAGTTTA TGCATGAGGA AAAGTAAAAG TGATTTTAAG
AATAAGCCAA ATAAAACAAC CAAGAAAGAC CTCCACTACC CTGGGAAGGA AACTGGTTGG TATTAAGTAG
GACACCACAT AAAACAGGTG TTATTGAGAG GAGAAGAACC AAAATGTAAC TGAGGTTCAA CAAGACATTA
TTTATGCAAT GGCAATGAGA AAAATAAAAA ACACAGTATA ACCATGCTGT ATTGCTATAA GTCATGTTAC
ACACTGGGAG ATGGCTTCAG GGGTATTTGG TTTTTACTTT TTGTTTGGGA GGTTTTTCAA AAAAATTTAG
TTAGAATAAG TCCTTTGAGA AACATACAG TAGGTTAAAC AAAGTTAGGT TAAATTAGGC TCCTAAGTTT
GACTTCTCAG CAAACTTCTA CTGAATGTTC TGACTGTAAG CCCAGGATTG CATGACAAAA CCTCTAGTCT
GAAGTTACTC ACCTTGACAG GTTGGTTCTG GAGATGACCA GTTTCCAAAT GGTCCACAGG TGGTTTCTTC
AATCCCAGTT AAGTTTGTTC CTTCAGAGCA GCTGAAGGCA CACTGTGAGC TGAAGCTGAA GTTTCCCAAA
GGGTGAGTAC AGTCCATGGT ACCCAGCTCT GGGGCCTCCA AAGGCTCACA CTGAATCACT TCAATAGGGA
AAGAAACAGT ATGGGAAGA GTTAAGAGGA ACTGACGCCT GGATTTGAAT CCTAGCCCTG CCACTTGATA
ACCATGTGCC TTTAAACAAG GTTACTTGAA CCCTCCAACT TCAGTTTCTT CATCTATATA AGAGGAATAA
TGAAATTGTG TTATCTTTAT CAAATTGATA TGGAAACTAA ATGTAATTCA ATTAGCATAA GTCAAGGACC
TTAGAACAAA GCCTGACTCA TCAGAAATTC TAAGTAAACA TTAGCTAGTC TTCATATTAT TATCTTCAGC
ATTATCTGTA GTGAGAATCC TTAAAGCCAA ATAGGTGTAA CTGGGAATGA CCAGCTTAGT CGGGAAATAA
CTATCACATC AGAGCCCCTG AGTCTACTAG AGTATTGGGA GCAAGATGTT CAGAGAAAGA GTGGGTCTCC
ATAATAAGCC TTCTTTGCAA GGAGAGAATA TAAAAGTCTA GGAAGCATTT TGACCTCAAT TCTGTCTTCT
```

-continued

```
ATTCTAGCTC AGTTCCAGAA TTTTAACTCT TTTGATTTTG ACAACCCTCT CCAGAAACTG TATCTATTTC

CCTGTTCTGA TTGGTGGTAC AATAGGTAAA TTTAAGACTT GGAAATCAAA GTTTTCACAT TTTAGACCCT

GCCATGCCAT TTAGTAAACA GTACAACTTT CATGTCTTAT TCCTCATCTG TCAAATTTAA GCCATTATTG

CTACCTTGCT CTAGAGACTT CAAGGAAGAA TGGACTCAAG GAATCAGAAG AATTTTTGTA TTTGGAAACT

ATATGAGATG AGATTAGGGA GAAACATGGG AACTAAGAGA AAATGTTATC TTTTTTCATT GATTTAAAGA

GTATCTATTA TATATCAAGC ATTACTCTGG GGCTTGAAGA GCTTAGATTT CACCCTGTAG GACAAAATGG

TAGGTAGAAA TTAATGGGTG GATTGTCATG TATGTGTGAT GTGTTTTAAT TGCTTTTAAT TGATCAGTCT

CCCTGTAGTA TGAATAATGT ATTTGAGGGG AGCTAATTTA AAATTGTGGA ACTCATCTAA TAAACTATTG

CAAGAATCTA GAAGAAAGAT AATGACGGCA ATGGTAGTAG AGTTGACAAG TGGAAGACAA ATTAGAAAAA

CACTAAGTTG TAAAAATTGG TAGAATGTTA CCCTGCATAA ATGTTGGGGG AGTTAAGAGA GTCTCATACC

AGGGTGCCCA TGTAAATGGT GATTCCACAT ACTGAGATAA GAAATACGAA GAGAAAGCT GACTGGGAAC

AATTGGTTTT ATAGTCTTTT AAACATCCCA AAGGACATCC TTAGCATATT TGAGTTCAGA GCTGGAGATA

GGCTTATCAG TCCAAAGATC ACATAGATTT GTGAGTCCGC AAAAGTCAGT AAGTTTGACC AAAGGATACA

TGTAGATTAG AGTCAGAAGA GCAATATACA AAAGACAAAA GCTGAGAAAT TATAGTAGTT TATGGTCCTG

GATAAGTGCT CATGAAGGAT CTCAGGAGAA ATGATCACAG GTAGAAAGAA TGAGAAAAGA GTGATATGAG

AGAAACCAAG ACAAAGAAAA GTAAAATGTT AAAAATGAGT GAAATAGGCA TACCAATAAT TAAAAATGAG

TAAAATAGGC ATACCAATAA CATAAGGGTT AAAAAATAGA GTTCAAAAAT GGGGTGAGGG TAAAGTATTA

GGAAGGAGTC ATGGCCCAGG GATCAAGTGA AATGAGTTAG ATCTATAGAT CTATTTCAGT TGGTTGACAT

TTAAATGTAT TTTGGTTTTA ATTCTTTATT GTTTACAAAC ATTGCTTTTT TAAAAAATTA AATTGTCCAA

TTCAATTCAG GCTCACAAGC AAGTGCCTCA TATATACAGG CATTTTGTGG ATCCCAAAGA TGCAATGATA

AATAGGACAC TTACTGATCT CAAGAAGTTT TCAGTACCAG AGGAGACGGA CAAGTGAACA GATGACTTCA

ACATAAGTGG GAGAAATGAG GAAGAAATAT GTGGAGCTAT CAGAACTAAG AAAGCTTCCT AGAAGAAACT

GTCTTTGAAC AATGTCTTAA AGATGACATG TTTTTTGGCC ATGTGCAAAA TGAGAGAGAA GGCCACCAGC

AAAGTCAGTG TGCTACAGAG CACATGTGTT AAGTGTGGAG AACTGCAAGA AGGAAAGGAA CTACTAGAAG

GAAAAAGCAA GATACTTTCT GGGTAACTCA GCCTCCTAAT GATAAATGGC ATAGTTTCTT CCAGACCTTA

GAGTTCTAAT TAATCTAACA AGCTCATTAG ATCGTGAGCT TCTTGAGAGC GGGAATCTAC CATGCTAATT

CCTTATGGTA ACCCTGACAG CTTTTATCCC AACACTGTGC TTCTTGTGGT ACTCAAAAAG ACTTGTTGAG

AAGTGAGTCG AAACTTCATG CTGACTTATG AAATCTTTAC GGAAAGGTAA CAATATTGTG AAAGCAGAGC

TTTCTGATCA AAACTTCCCA TTTCTCAGAG TGGCTAGTAT CATTTTGTTC CAACCAGCTT CATGATAAGC

TATAATGATT CCTGTGACTT TACCTAAGAA GAAGCAAAGA AAGGAAAGAG ACTTACCAAA CTGACACTGG

GGCCCATAGT ACCCCACATC ACAGTTGCAG GTGTAATTAT TGATGATTTC TACACATTCT CCATGGCCAC

TGCATGACCA GGGCTGGCAA GAAGCTTTAA GGAGGTCAGA AAAAAAATAT TTTAATGTGA TTACATTTTA

GTACTCAAAG TCATTTCTTT AGACATAGAT AACCTTTTGT CTGAGATGAT TTAAATAATC AGGAAAGGTT

TATTTGTAAA TTCATAGCAT AAAAATCATA TGCTAAAATT TTTACGTATA AAATACACTA AGCATATAGT

CATAGGCATT TATTTGCTTT TGGAATGAAA TTACCAATAC TAATATTCTG TAACACTTAT AGGAAACTTA

GTGGCATACC TTGAAACTCT TGAAATTACT TGTTTTTAAT GAGTGAGAAG GTTAAATGAT GACCTGACCT

CAATCATTTC TGCATGCAAT TATTTCTTGG CAATCCCTTT CTTTATAGAA ATCAAAGATT AAAAAGTCCA

AATTTGCTAA AACGGTAGAG TCCAATTTAT AAGAGACCAA ATTAACTATG GTTCATTATT AAAACATCAC

TTGGAAAATG CTGGCTGTTT TGGAATTGTA GAAGATTTTA CAGAAATATT CATACACCAA AGATAGTGCA

ATTTTTATAT AAAATTATAT AAGGTTAGAC CAAGAAGGAA GCACGCAGCA CCACACTCTC TACTTCACAA
```

```
TGTGAAAACT GAGGTGATGT GAGCCTAAGT TTCCAACTGG CCCCAGCTGT CAGCTTCTCC TCCCCTGCCT
TATTATCAAA GGCACTGATT GTCTAGCTCT TCCTCTGTAC TTCCTACGTA GATCTATCAT TTTGATGTAA
CTTGATTTAG GGGTATAGCT TTTGTGCACA GGGACAAATC TTACACACCA AAAATTCTTA GGAGTGACAC
GATGCAAGAT TATATAGAGG GCTAGATGTA TTTTAGAATG AACCAGAAGC TGTTCTCATC CCCCCACCTT
TCCATGGGGT AAATCTGAGT ATTCTCTTAA CCGTGGCCCT TCCTGAGTCT GAGGCAGCAT AGCCGTCTTG
TCACTCCCTA CCTGTGTAAC AGAGGGCTGC CTTTAGTTTG TGGCAGGCGT CATCGTTCCA TTTGCCTGCA
TCTTTGTTTC TCTTGATATA GATCTCCACG CAGTCCTCCT TGTTCTTCTT GTTGTTGGGC TCACCATCTC
CCCAGTTCTC TGCTTCTTCA GTAAGAGATT TGTTGGTTCC CACCCACGTC CATATTCCTC CTATCTTCCG
GATTCCTATC CAGTAGTAAG AACGACTGAA AGGCAGAGTC TTCTCCAGAT ACTCAATTTC CGCCTTGTTT
TGTATGGCAA CTAAATCTGT GTAATTGTCT CGGCAGAATC TTCTAGCCCT TGCCAGTTC ATGGTTTTTT
CAGAATAATG GTAAGTCCAG CAGTCGGTTC CATGATGTGC CAGGAAATCT GCAAGACATC AGTGTGACCT
ATGCAGACTT ACATAATGTT ACAGCTAAAA AGAACCTAGC ACTACTCCAG GCTGAGCTAG ACACTTAGAG
ATGAGGAAAC AGAGCCTAAG AGTGTATGTG ACCATCTCAG GATCACAGAA TAGTTGTTTG CAGATTTGAA
GTAGAACCTA GACCTTCTGG CTTGAATATA AGATGCTTTT ATCTAAGGTT CTATTTGAAA CAAATTTAGT
GGTTTTCTAG GTTTATTTTC TTATTAATTT TTTTCTCAAA ATTATTTCAG GTGAAATTTA ACCAACATAT
TTTAGACATT CATATTTCTT TTTCTTTGTA GCTGTTAATG ATTTACAACT AATTACCGTG TAATATCATA
TAACTATACA ATTTACGTAT ACTTTTTAAT CCTGGAATCA TTTCTTGAAG GCCAACACAT ATGTACCTAT
GGGAGAAGCA TAATAAGGAC AGGAAGAACA GTGACATACT TTTAAGTAAC CTCTTTTACA TAAAAAACAT
TTTATTTTAC CATAGGAAGA ACTGCTTCTG GAAAAGCCCA ATATACCACT CAACTCTTAT ATATCTAACT
GTATAATTTT TAAAAGAAC AATTTACAAA GCCAAATGGT ATAGGATTAT GAAATTCATT AGATCATGTT
CTATACACAA AGAGACTCAA CTGATGATGT TTAATAAACA TATGGACCCA TCAAATATGA GGGCTTTGAA
GATATCTAAT TAAACACATA ATTACACAAT GACTTCATAA TAATATATGG CATTCTAAGC ATGGTATGAT
CTACATGAAT CACTATTTAA TACAGTAAAG AAACAGATAT AATTGATGGT AAAGAGCATC ATAAAATAAA
CATTTTGAAC AGAGTTTTGA ATGAGCATTC CACTAGAATG CAAGTTCTAA GAGGGAAAAA ACTGTTGTGT
CCACTGCTGT ATCCTTAGTG CCTAGCATAA ATTTCACACA TTGTAGGGAC TCAGAAAATA CCTGGTGTAT
GAAAAGAGCA CTAAGTTTCT ATGTGACACA GTGCAGACAT GGCATAAGGA ATGTGTGAAC GGGAGAGTTA
GCATGTTTGC TTGGCTAGAG CTGAAAATCC AGGCTAGGGA GAAAGAAGAC ATTAGTTTAC TTAGGAAATG
AAAAACCAAG TTCAAAGCTA TTGCTGGAGA GTCTTCAAGA ATCAGATATA AAATTTGTCA CAACAATGGG
AGAAGGACCA AAAAATGATA AACCCCCGTC CCTTAATAAG CTCGTATTGT AATTGTAGAA ATGACATTAA
TGTACACTGA ACTATGAATA AAAAATAGAA AATGAGGTGC TAAATATTTG GTACAGATTG TAAGTACCTT
AACAGAGATT TCTTAATTAA CATTATTCCT TTATAATTGA GGGATTTTGT GGGGTTATTG GGATTTGAAC
TCTACAGCAT GGGCTATTAT AGGTTAAAAA TAGTGTTCAG GAGTTTCTGG GGAAGAACTA AAGGTAAGAA
GAAAAGAGAT GTTTACAGAA GGGATAGAAT TAACAGCTCT GTGAAATAAT TTCCCTTAG ACTATGTATA
ACTAGTGGAT ATTTAAGAAA AATGAATATA AGTAAAATAG ACTTAGCGAT ATATAAATAT CATAACATAC
CACAACAGAG CATTGTCCAC CCCCACAACT TGAAGATGTT CCATAAGTCC CTCTGGGTGC TCTGACATTT
CCATGGAAAT ATCTGCAAAT GAAATACAAA ATTATATTTA GATGTATACT CTTAAACCAC ACATTTATAG
CCTTTGAGGT GGTGCTTACA ACTTTCTTAA TAATCAGAAT AAAACACATA TGTCTACTAA CCCTGTCTGA
GGTAACAGGT TTCTCAGACA TAGATGAAAA ATTACTTCAA ATTTACATCA GAACTGATGC ACAGTTTTGT
TTTGTTCTAT TTTATTTTTA CGCTTTAGTC TCAAGTTGCT AATCGGTACT GCCCTGAATT TTTTCTATGG
```

-continued

```
TTTGGTAATT TTTATACCTG CTTTTCTGCT GAGCTATTAG ATAAAACTAT TTAATATTTA CTATGTATAT
TTTTTAAAGT ATTGTTGCTG CTTAATTAAC TATTGATGCT TATATTTAAT GTTATAGCCT CACTCTTGAT
CATAATGGGT CAATGCCTCA AATACCTAAA AAAAAAAAAA ATTAGATAGC CAGACACCAG GAAAGAAAAG
TATTTCTTTT TTTAATAAAA AGAAATACCT TTTTGAGCAA CTGAAATGAC AAAGTCACAA ATTTCCTGCA
CACCTTAAAA TATACTTAAT GTAAATGACG AGTTAATGGG TGCAGCACAC CAACATGGCA CATGTATACA
TGTGTGACAA ACCTGTATGT TGTGCACATG TACCCTAGAA CTTAAAGTAT AATTTTAAAA AAATTCTATC
TTCCAAAGCA TATCACTTCT CAGGTAGACA CAGTGTTTAT TGCAAAAGAT CTGATTTCAA TAGTATTTCT
TCAAGAGTCT CCCCAGAGAC AAAGTCAAGA AGAGGAAATC AGCATATCTG AGAAGAAAGA TTTGAGGATC
ACTTTTTTTG AGGGTCTGAG AAAATGTTTA GTTTCTATAT TATTTAAAAC CAGAATTGAA ATGGGGTGAT
TCCTATCCTT GCCACCTGCC TCTACAACCC AAGAGTTTC TATCTGAGCA TCTAAACGTC TTTTAGGCTG
AAAGGCTCAC CATGGCTTTG CTTGGTCCTT CTCTAGTTCT TCTGCAGCCC ATTGAGCCTC TTGACTTAGC
ACAAGGGTCT CAGGTCCTTG CCCAAGGGA GTGTGCTGTG CTGCAGGTAG ACTGCACTGA ATGTCAACAG
AAAGCCTTGC TTTCTTTCAT TTCTCTAACC CAGTCTCACA TCCTCCTCCT CCTCCCCTTT TCCCTCCCCT
TCCTCCTGCA CTTCTCTTTC CTCTTTCCCC ACCCCTTTCC TAGACTGGCC TCTATTGCCT CCCACTGAGA
CAAAAATGAA CTGCTGATCA GAAAGTAATG TGACTAGATT CTCTCTTCCT TCCCTCCTTT CTATCCTTCC
TTCCATTCTC CTATGCATCT TTCCTTACCC TCCTCCTCCT TCACTCATTG TTGTTGCTGT CTTCTTCCT
CTTCTTTTTC CTCCTGCTCC TCTTCTTCTA CTTGTTCTTG TTCTTGTTTT TGTTTGGTTC TTGTTCTCCT
CTTCCTCCTT CTCTCTCTCC TCCTCCTCCT TCTTTTCCAC CACCCTCCCC TATCTTTTTC ATAAATGCTA
AACTAACTCT TGGCTACCTG TGGTAAATGG CCCTTGGAAA TTGCAAATAC TACAAATCAA AACTGCATTT
CAGACATATT TATGATGTTT GCAAAACTTC AGTAGAGCTA AGCAGTGGAC TTGACTCGTT TCGGTTCCTT
CACCTCCGTC TTTCCTTGCT CACCACCTAG TGGACGTCCT TGTTAGTGGC ACTTCCTGAA GTTAACCCCT
GAAGAGAGCC CATGCTCTCT AGCTTTTCAC CGTGTAGGTT TGGAGCCTA CAAGTACCTT TAATATTCTT
GGACTATAAA ATGAGATGGT TTTATAAGAC TGCATGTGAA ATTAGGACCC ATATGATGAA GGACAATAAA
AAGGAAGACC CACTGATGTG AGTCAATGAG TCAAATGCAA ATCAGATTTG CATTTTTAGG AAAATAATAA
TAACAACAAC AAAAACTCTG AAGCTCAGCG CCCCATATTT ATTATATTGT TTAATCTTTA TAACAGCTCT
CTGCTATAGA TATGATTATT ATCCCCATTC TAAAGAGTCT CAAAGAGGTT AAGAAACAAA TTCAAAAACT
AGCGAAAGAC AAGAAATAAC TAAGATCAGA GCAGAACCAT AGGAGGTAGA GACACGAAAA AGCCTTCAAA
AAATCAATAA ATCCAGGAGC TGCATTTTGA AAAGATTAAC AAAATAGATG GACCACTAGC TAGACTAATA
AGAAAGAAGA ATCAATAGAC ACAATAAAAA ATGGTAAAGG GGATATTACC ACTGATCCCG TAGAAATACA
AACTACCATC AGAGATTACT ATAAACATCT TTACACAAAT AAACTAGAAA ATCTAGAAGA AATGGATAAA
TTCCTGGACA CATACACCCT CCCAAGACTA AACCAGGAAG AAGTCAAATC CCTGAATAGA CTAATAACAA
GTTCTGAAAT TAAGGCAGCA ATTAATAGCC TACCAACTAA AAAAAGCCCA GGACCAGATG GATTCACAGC
CAAATTCTAC CAGAGGTACA AAGAGGTGCT GGTACCATTC CTTCTGAAAC TATTCCAGAG AATAGAAAAA
GAGGAACTCC TCCCTCACTC ATTTTATGAG GCCAGCATCA TCCTGATACT AAAACCTGGC AGAGACACAA
CAAAAAAAGA AAATTTCAGG CCAATATCCC TGATGAACAT CATTGCGAAA ATACTCAATA AAATACGGCA
AACTGAATCC AGCAGCACAT CAAAAAGCTT ATCAACCACA ATCAAGTTGG CTTCATCCCT GGAATGCAAG
GCTGGTTCAA CATACACAAA TCAATAAACA GAATCCATTA CGTAAACAGA ACCAATCACA AAAACCACGT
GATTATCTCA ATAGATGCAG AAAAGGCCTT GGATAAAATT CAACACCCCT TCATGCTAAA AACTCTCAAT
AAACTAGGTA TTGATGGAAC GTATCTCAAA ATAATAAGAG CTATTTATGA CAAACCCACA GCCAATAGCA
TACTGAATGG GCAAAAACTG AAAGCGTTCC CTTTAAAAAC TGGCACAAGA CAAGTATGCC TCTCTCACCA
```

-continued

```
CTCCTGTTCA ACATAGTATT GGAAGTTCTG GCCAGGGCAA TCAGGCAAGA GAAAGAAATA AAGTGTATTC

AAATAGAAGA GAGGAAGTCA AATTGTGTCT GTTTGCAGAT GACATGATTG TATATTTAGA AAATCCCATT

GTCTCAGCCC AAAATCTCCT TAAACTGATC AGCAACTTCA GCAAAGTCTC AGGTTACAAA ATCAATGTGA

AAAAATCACA AGAATTCCTA TACAGCAATA ATAGACAAAC AGAGAGCCAA ATCATGAGTG AACTCCCATT

CACGATTGCT ACAAAGAGAA TAAAATACCT AGGAATCCAA CTTACAAGGA ATGTGAAGGA CCTATTCAAG

GAGAACTACA AACCACTGCT CAAGGAAATA AGAGAGGACA CAAATGAATG GAAAACATT CCATGCTCAT

GGGTAGGAAG AATCAATATC ATGAAAATGA CCATACTGCC CAAGGTAATT TATAGATTCA GTGCTATCCC

CATCAAGCTA CTACTGACTT TTTTCACAGA ATTAGAAAAA AACTACTTTA AATTTCATAT GGAACCAAAA

AAGAGCTTGT ATAGCCAAGA CAATCCTAAG CAAAAAGAAC AAAGCTGGAG GCATCATGCT ACCTGACTTC

AAACTATACT ACAAGGCTAT AGTAACCAAA ACAGCATGGT GCTGGTACAA AAACAGATAT ATGGACCAAC

GGAACAGAAC AGAGGCATCA GAAATAACAC CACACATCTA CAACCATCTG ATCTTTGACA AAGCTGACAA

AAAGAAGCAA TTGGGAAAGG ATTCCCCATT TAATAAATGA TGTTGGGAAA ACTGGCTAGC CATATGCAGA

AAACTGAAAC TGGATCCCTT CCTTACACCT TATATAAAAA TTAACTCAAG ATGGATTAAA GACTTAAATG

GAAGACCTAA AACCATAAAA ATTCTAGGAG AAAACCTAGG CAATACCATT CAGGACGTAG GTATGGGCAA

AGACTTCATG ACTAAAACAC CAAAAGCAAC AGCAACAAAA GCCAAAATTG ACAAATGGGA TCTAATTAAA

CTAAAGAGCT TCTGCACAGT AGAAAAAAAA AAACTATCAT CAAAGTGAAC AGGAAACCTA CAGAATGGGA

GAAAATTTTT GCAATCTATT CACCTGACAA AGGGCTAATA TCCAAAATCT ACAAGAAACT TAAACAAATT

TACAAGAAAA AACAAACAAC ACCATCAAAA AGTGAGTGAA GGATATGAAC AGATGCCTCT CAAAAGAAGA

AGTTTATGCA GTCAACAAAC ATATGAAAAA AGCTCATCA TCACTGGTCA TTAGAGAAAT GCAAATCAAA

ACCACAATGA GATGCCATCT CATGCCAGTT AGAATGGCGA TTATTAAAAA GTCAGGAAAC AACAGATGCT

GGAGAGGATG TGGAGAAATA AGAATGCTTT TTACAGTGTT GGTGGAAGTG TAAATTAGTT CAATCATTGT

GGAAGACAAT GTGGCGATTT CTCAAGGATC TATAACTAGA AAAACCATTT GACCCAGCAA TCCCATTACT

GGGTATATAC CCAAAGGATT ATAAATCATT CTACGATAAA GACACATGCA CACTTATGTT TATTGAGGCA

CTATTCACAA CAGCAAAGAG TTGGAACCAA CCCAAATGCC CACCAATGAT AAACTGGATA AAGATGATGT

GGCACATATA CATCATGGAA TACTATACAG CCATAAAAAA GGATGAGTTC ATGTCCTTTG CAGGGACATG

GATGAAGCTG GAAACCGTCA TTCTCAGCAA ACTAACACTG GAACAGAAAA CCAAACATTA CCCATTCTCA

CTCATAAGTG GGAGTTGAAC AATGAGAACA CATGGACACA GGGAGGGGAA CATCACACAC TGGGGCATGT

CAGGGGATGT GGGGCTAGGG GAGGAACAGC ATTAGGAGAA ATACCTAATG TAGATGCACG GTTGATGAAT

GCAGCAAACC ACCATGGCAC ATGTATACCT ATGTAACAAA CCTGCACGTT CTGCTCATGT ATCCCAGAAA

TTAAAGTATA ATTTAAAAAA AGTTTAAAAA AAGAAAGTTG CCTTAGTCAC ATAACTAGTA AGAGACATGG

TTGGGAATTT GAACAGAGGC CAATCAGTTC CAAATCCATG CTCTTGATCA TTAAGCTGAA CTTATGGCAG

GAACTTGGAA GACATGGTAA AATGGGGAAA ACGTGGAGC CAGGGAGACT TGTGAAAGTG CCAGTGCTCC

CACTATACCC TGAAAGAAGT ATCTAGACTT ACTTTTTTCT AAGTCCTCTC CTCTAATTCT CTCAATCTCT

CTCTCTCTTT CTCTAAGAGA TGGGAATGCT GCTCTGTCAC TCAGGCTAGA GTGCAGTGGT GCGATCATAG

CTCATTGCAC TCAAGGAATC CTAGGGTCTA GTGCCCCTTC TCCCTCAGCC TCCCATGTAG CTAAGACTAC

AGGCACATGC CCCAACCCTC GACTAATTTT TTTATTTTT ATTTTGTAG AGACAGGATC TCACTATGTT

GCTCAGGCTG TAATTCTGTC TTGAAGCTTG TCCAATCAGG CTTTCAGCCA CACCAATTCC CTGAGACTGC

TCTCACCAAG GTCCTACACT TCACTAACAC AAACAGCCTA TTCTCCATCC TCATCTTACT TCACCAGGGA

GCTCCTGGTT TTCCTCCTAC TTCACTGGCT ATTTCTTCTG TATCATGTGT TGATTCTCCC TCATCTCCCC
```

```
AACCTCCAAA CCCTTGGAGT ACTCCAGAGA TCACCGCTTT GCTCTTCTGT GTCTAACCTC ACTAACTTGG
TGGTCCAATT CACACTCTTG ACTTTGAATA CCATTTAAAT GCGAACGAAT TCTAAATTCT GTACAACCAG
AACCATTCTC CTGTAGCCAA ATGCCTACTC AACATCTCCA TCCCCAAACA AATTTAGTTG TTCAATAAGC
CTCTCATATT TTACATATCC CAAACTGAAC TTCTGAATTT CTCCTCCAAT CTGTAGGGCT CTTCCCACAG
CCTTTCCATC TCAGTGGATT ATAACTCCAT CCTTCCAGTT ACTCAGACCA AAACTTTTGG AGTTAACTGA
GACACCTCTC TTTTTTTTCA CAAGTCATAT CCAATGTGTC AACAAATTTT GGTAGTGGAA ATATTGCGGG
ATTTTTTAAG AAATCAGAGA GACCGATGGG GTTCAGGAGG ATATTTATTA TTTAGGTGCA CTGGCCAAGT
CAGATTAACA TCCAAAGGAC TGAGCCCTGA ACAAAGAGTT AAGTTACCTT TTAAGCATTT TGTGGGGTGG
GAGAGAGGGG TATCTGTGCA GGGGGAAGCA TACTACAGAA GTGAGAAATA AAGACAGTTA TTCAATTAAT
TGAGACATGC ATTACATCAT TTCTTACTTT TCAAGAAGAA ACATGTTTTG CGACTTGAGT TTATCTGTCT
AGTGACCTTG CAGCTGCACA GCTAGAGAAA CAGGGTCTTC ACAATGCCTG GAAAGGAGG AGAGGTAAGT
CTCACTAGCC ACAGAAAAAC AGGCAGTTAA TTTTTAAAGG GCTCCAGCTC TTTCTCTTTC TCAGGGGGAG
TTGGGTTTTG TTACATACAA CTGAGTTTCC GCTTACACAT TATTTAATTT CTTTTAATTC CTGTTCCAAA
AGAAGCCAGA TACAAAAGGT TACATGTTGT CTGATTCCAT TTATATGAAA CATATAGAAG AGGTAAATCC
ATAGAGACAG AAAGTAGATT AGAGGTTCCC AGGGGCTGAG GAAGAAATGG GGACTAACTG CTTATAGGGT
ACAGAGTTTT CTTCTGATAA AAATATTTTG GAACTAGATA GACATTTTGT TAGGCCATTC TTGCATTGTT
ATAAAGAATT ACCTGAGACT TGGTAATTTA TAAAGAAAAG ATGTTTAATT GGCCTACACT TCTGCAAGCT
TTACAGGAAG CATGGTGCCG ATATCTGCTC AGCTTCTGGT AAGGCCTCAG GAAGCTTACA ATCATGGCAG
AAGGTGAAAG GGGAGCAGGC ATATCACATA GCAAAAGCAG GAGCAAGAGA GGGATGTGGG GAGGTGACAG
TCACTTTTAA ACAGCCAGAT CTTGTGAGAA CTCATTCACT ATCATGAAGA CAGTACCAAG AGGATGGTAC
TAAATCATTC ATGAGAAACC CCACCCTCAT GATCAAATCA CCTCCCACCA GGCCCCACCT CCAACACTGG
GGATTACAAT TTGACATGAG ATTTGAGTGA GAACACGGAT CCAAACCATA TCAGAGATGG TGGTTATACA
ATGCGATAAA CGTCACTGGA TTGTACACTT TAAGATGGTT GTTTTATGTT GTGTGAACTT CACCTCAATA
AAAAAAAATA TTTAATGTAC ATTCAGCCAA AAGAAGATTT GGAATAGGAA AGGTCATGGA GATATATTAA
CAGCCATTTG ATGGGTGGTA AGGAAAAGAG TGGTTATTAG ACTGTTTTGT GGCCCTCAAA AGGTAGAACT
AGATCGAGTT GGTGAGCATT ATAAAACCAT CACAAAACCC TGGAGAGAGG ACCCAGTGCT GAAGAACCGT
TTGCCTGCCA TGAGACATGA GGGAAGTACC AGTGAATGCC ATTGAAAGCA GCATCCCTGG GTCCAAGGGA
TGGTCAAAGG ACCACTACCC AACCCTTCCC TAGCCTACGC CTCCATTACA GATGACCGCA AGATTTATTT
GCTCATTGCT GCCAACCAAG GCTGCACTCA CTGCAGTTGC TATCAGTTTA TCATGGGTAA AAGGAATGTG
CAGTAGAGAA CTAACTAACT GCCCACCTAC CTCCACAATC CTATCAGGAC AAATCACCAT GGCTCACATT
TCCTTACATT TGGCATGTAA GCCCCTCTTA CTGTCTGTCA TCTATCTCCT ACACAGTTCA CCTAAACTGT
TCTCTCCTGA CCCAACCTTG ATTTTCATCC CAAATGCTTC CTTGCCATCT CTGGGATTCC TGTCTTCACC
ATCACCAAAC TCCCCTCAAT CTTCCAGTTT CCTGTTCAAA CTTTTCTCCT ACCTCCTTGC TTTGTCATTA
GCCCGACTGC CTCCCTAGGA CATCACTTCC CCTGCAGATC TCTCAAGATG ACAATATTTA TTCTCCACAC
AGCACATACT TCAGGGTTGG AAGGCAGGGG CAATCTTCTC CTTTATAATG AGTGCCTCTT ATATATGTTT
ATTCATCTGC CCTCTTGTAA AACACACACA CACACACACA CAAAGAAGAA ATAAAATAAC TCTGCTTCTT
TGAAGCTTGT GACACTGAGA TAAACCATCT CACTGTCCTC ATTGTAGTGA CCTCTCAACT CCTCATGCAA
GATTGGCTTT GGCACCTAGT TCCTGATCTT CCTTTCCCTG TAAGCACTTC TCATAGTCTT ACGGGACTTC
ACCATCCATG GCACAACCAA TACCACAGCC CAGATCCTCA GCTCTCCAAT GACATTTTCC TCCACTAGAC
TTGAGCTACC TCCTTCCCTA GGCACAGCCT CAACCTCGAC AACACCTAAG ACTGTACCGT CTCTAAAGTC
```

```
ACATGTTCAA ACACTTCACT CTTTAACCAC TGTCTCCTAT TCTTGCAAGT GTATTGCTCA AGTATCTCAT

TGCAATGCTT TTTACTTCTA CCTCATTGAA CCTCCAGGCC ATTAAACATT TCCTTATTTC TAACCATCAG

GTTTCTCCTT ACTTGTTTGT TTGTTTATTT GTTTTTTTTT TTTTTTTTTT TTTGAGACAG GGTCTCACTC

TGTTGCCCAG GCTGGAGTGC AGTGGTATGA TCTCGGCTCA CTGCAGCCTC CATCTCCCTG GTTCAAGTGA

TTCTCATGTC TCAGCCTCCC GAGTAGCTGG GACTACAGGT GCATGCCACT ACGCCTGGCT AAGATTTTGT

ATTTTTATTA GAGAAGGGGT TTTGCCATGT TGGCCAAGCT GGTCTCGAAC TCCTAACCTC AGGTGATCCA

CCTGCCTCAG CCTCCCAAAG TGCTGAGATT ATAGGCATGA GCCACTATGC CCACCTGGT TTCTCCTTAT

TTATTTCAAG TCTATGCTGC ACTATTAAAA CTGCCTTGAC AAAAATTATA ATAGTGAGAA AATTATGACA

GTGAAAGAGA TCTGAAATAA TCAACCCCCA TCTTGCCTTT ACCTTCCAGA CTGCCCTTAA TAATTCCTGA

GCTTGGGCCA AGCTATCTTT GGCAGAAATT TAGTTTATAG TTTAAATGAT AATAGCCCTT CTCCAAAACT

AAACTGCCTT TGTAAAACTA ATAAAAGACC ACCAATGAAA GGTTAGGAGG ATGAGAGGAG CCTGAATTCT

GCTAAGGTGT AGATGTAAAC AATTACCAAC TGTTATTCCG GAGGTCACAA GATTTGCAAC ATCGCCAATT

ACTCCTGCAG ATAACAGCAC TATCATAGAA TCTGATTGGC CTTTTGAGAT GTCTTTCAG ATTCTTACAT

TTCAACTGGT GGCTCTACCT GGACCCATCA ACAAGTCCTG TGGCTCCACC CAGAAGCAGA CTTAACATGC

ACAAGGACCA TTTTCCACAC CGCTATGATT GCATCCCAAC CAATCAGCAG CAACCATTCC TCTGCCTGCC

AAATTATCCT TGAAAAATCT TAGCCTTAGA ATTTTGGGGG AGGCTGATTT CAGTAATAAC AAAACCCCGG

TCTCCCATTT GGCTGGCTCT GCATGAATTA AATTCTTTCT CTATTGCAGT TCCCATCTTG ATAAATCACC

TTTATCTGGG CAGCAAACAA AAGGAACCCA TTGGACAGTT ACACTGTTGG CAGATATATC TTGCTTCCAA

AATTGGATTT TTGTTTAATG AATTTATTCT GTTTTCTTGA TATTTACAAC TGTGAATGTT GTGTCTGAAT

TCTCTTTATT TCTTCTTGAA AAGAACTATA TTGCTACAGC CAGTACATAC AGATGGATAG CTAATTACTC

AACACGGGGG GATGTGACCA TCACCGCACT GTGCAAATGA ATGTTACCCA TTGTCCACTT TCCCAAACT

ACATAGTGTT ATATGGTATA TGACCCAATC AACGGTGGCA AAGCTCCAGA ATACCACAT AGACATCAGG

GACACTTTAA ACTAATCAGC CTATAGTCCT TTTTCAGTAA TTTCCAAACC TGGTTGTGCA TCCAAATCAC

TTGGTAACAT TAAAAAAACA AAAAAATATA CACGCAACAT TCGCTCCCAA TCCTACTGAA TCAGAATATT

TTGGGTTGGT TCAGGAACAT TCAGGAGTTT TCAGGGTCC AAGGTTTATA TAATTTGAGG TCTCTCTTTG

AGAAAAGGAA CGTAAAAGCG TCTTGCTTTT ATAGATCTTA CAAAGATGTA TTACCATGTA AACACATTCC

TAGGACCCAG GCCCTTGTAA TTTAAAGGTT TATCTAAGTA ATGGGCCCTG AAGCTTAATT TTCATTATCT

TCAGGGCAAA TTACCTGTGG GTTAGGGTTT AGGAATATAT CTCTCTGTGT ATGTGTGTGC ACATTAGCAT

GTACGCTTGT GTGGATTTTT TTTTTTTTTT TTTTTTTTTC TGAGACAGAG TCTCGCTCTG TCGCCAGGCT

GGAGTGCAGT GGCGTGATCT CTGCTCACTG CAAACTCCGC CTCCCAGGCT CAAGCGATTC TTCTGCCTCA

GCCTCTTGAG TAGCTGGGAC TATAGGCACG CACCACTATG CCCAGCTAAT TTTTGTATTT TTAGTAGAGT

TGGGGTTTCG CCATGTTGGC CAGGATGGTC TTGATCTCTT GACCTCGTGA TCCACCCGCC TCCACCTCCC

AAAGTGCTGG GATTACAGGC GTGAGTCACC ATGCCCAGCA CTTGTGTGGA TGTTTTAAGC TCCCAGGTGA

GTGAATACAA AACTAGATCT TTCCCTTCTG TAGCATCTGT ACTGTTTACT CTATGCATCT CAATATTTTT

TCTTTTAGTA TCTTTCCTTT TTCTCTCTTA TTACTTCCTC TTGTGCTATT TTTACACCTC CTTTTTTAAA

AAATTTTTTC CCTTTTATTT CTATTGACCT TTAGCCCTCK CAATGATTCC TACAAGCCCC ATTTCTGTAA

ATGGGGATTG AAATAATTGC TGGACTTTTG AGAGATAGAT ATATTAAATT GCAAACTGGC AGTAGTGGGG

GCAGTTGATA CATAACTAGG TTTTAAAGTC TAGCCTTCTG AGACCACTCA TTCCATTTGT GAAAAGTGAT

TCTACTTCTT ATTATGAGCC AAAATATGCA TTCATTCACC CATGCATTGA TTATTCATT CAATAAATAT
```

```
TTGTTGGATG TCCACTCTGT ATCAGGAATG TGCTAGGTTC TGGGAATACA GCAATGAACA AGGTAATTTT

TCCCTACCCC TAAGGAACTT AGAGTTTAGT GGGGAAGACA GACATTAAAC AAACAATTGT GCAAGTAATA

ATCTATAATT ATTTATTACA ATTAAAGGAA GGAAGAGACA TATGGATTAT GAGGGCATTA AAGAGGAGAC

CTAGTGTAAG TAGCCAGTTC TCGTGAAGGG ACATGTATTA GTTGGAGTTC TCCAGAGAAA CAGAACCAAT

GGTGTGTGTG TGTGTGTGTG CGTGTGTGCG TGTGTGTGTT GGGGTGTGGG GGTGTGGTAT TTTTTATAGA

AATTGTCTCA CACAATTATG GAAGCTGAGA AGTCCCATGG CCTGCTGTCT ACGAGCTGAG AACCAGGAAA

GCCAGTGGAA TACTTCAAAG TCCAAAGGCC CTGGAACCAA GAGTGCCAGT GTTGGAAGGC AGGAGAAGAT

GGGTGTCCCA GCTTAAAAAG ACAGTGAATT CACTCTTTTT GCTCTACATA GGGCCTCAAT GGGTTGGATC

ATGGCCACCC ACATTGGTGA AGGCAATCCT CTTAGTCTAC CAATTAAATA CTAATCTCTT TGGAAATACT

CTCACAGACA CACTGAGAAA TAATGTTTTA TCAGGGTGAT AGAAATCTTC TGGAGTTAAA CAATGGTGAT

AGCTGTACAA TCACATACAT TTTTAAAGGG TGCGTTTTAT GGAAAGTGAG TTTTATCTAA ATAAAATTTC

TAAGAAAGAG ACTTAACACA GAGATAAACA TAAGCACATT TATTGTCAAC CTTTATAGTG TTATGTCAAA

TAGGTCTGAC ATAAGCTTAA ATAAATATAT ACTTTAAAAA TTATAAAATA TTTTAAGTTA TAATTTAAAA

TTCTCAATAA AACTCAAACA CAAACCACAC TGGTATTTCA CACAGCTAAT TTCTAATGCA GTTACATAA

ATATTTACAA CACTTAAACA ATTTCAAAGA AAATAACACT GTATTCCATA CATAGCCTGA TCACAGTAGT

TGTTCTCTCT TATTTCCCAG AGTTTTTCTG CCCCTTTAAA AGAACCTCTG CTGTTCTGAT CCTTATCACA

TCTCTGTTTT GACTGTTGGC TTTGTTGTTG CCAGTGTTCA GCCAGAACTT CTCTGAAACT TTTTTTTCAA

CACATGCTAA GTTAATGGAA GTGTAGGAGA GTTTTGATTC TCACACTCCT CAAGGCTAGA GCAGCTTTGG

CAATTACTGA CTGAGAATTT TCATTGCCA GTGATCAACT GAAAACTGGA GATTCCTTTG GAATTGTTAA

ATCTGCTTAT AAATAAACAT AAATGCTTGC TCACACAGGC ATTCCTCTCT TCCAGAGCAC CCTAACATAC

AGAAGAAAAC AAATAGGGAA TAACTATTAG ACATCTTCAT TCGTTAAAAA TCTACCAGAT GACTCTTTTA

CATGGTGAGT TTCTATTGTG AATTTAAAAT CTTCCATAAT ATACAAGAAT TATGTTTACA TATCATATCT

GACAAACATC TTTGTAGGAA TGCAAAGCAC ATCCATCTTT CTGTATTCTT TTCCAACAAA GACATTCATA

AAATTATACC TTTGTGTGTT TGCATTTATG CTTTTATTAG TTCAAAACGT TTGGCCTCAT GGAAGTTTTT

CATCGTGGAA ACCACATATT TCTGAAAAAA TATCTGACAA TATACAAACC TTCCATTCAG TTTTTACTCT

CCAATTCTAC CATGTTTTCA AAAAACAACT GTAGTAAAAA CACTCAGAAC TTTATTCTGG TTAACATCAT

GCCTTGCTAG GGGACAATAG TTTCCCTTTT TGAAATAAAT TTAAAACAGA TGTAACATAA TTTGTTAATA

AACAATGAGG GGGTAATCTA GAATAAGTAA CTTTTACCAT ATCATAGTTG ACAGCATTTA CAAGTTTTTT

AAGTCCCTAC CACACTTGTA TTGAATGAAG AAGTATGGAA GATTATAATA TATTCAATGC AAGTAAAAAT

ATCACAATCC TTAAGAACTC TTTAAGAAGC ACTGAATCCC ATAGGGATGA AAGTGATTAA ATTGTGCATA

GTAACCCTCG CACAGAGCAT TCAGTAGGAT TTGCACCATT AACAACCCTC CATGCATTTG CCTGTGGGCA

TTCAACATCT GTCATTTTTT TAAGTTATAA TATTTTTAGT CATTTTTTTC CTCTAAACTC TGGATAATTA

TTATTCATTC TTATGACAGC AACTGTGTAA TCAGCTGTCG AAACACTGTG AAGGGCAAAA GAAAGAAAGC

CACAAAATAT TGTGTTTCTG TGCCAAGATT TTACAGCGAG CAAGGGAGAG TTAGAAAAGG AATTCTGAGA

TTTCAGAGTC TTGGTCTCTT CACCTTTGCT TGGAAGAAAA TATCCTTTCC CTTCATTAGC CAACACTTTC

TTGATCCTGA GAGTAGGAAA GGGAACACTG AGTCTTTTCA GTTGAAGGCC GTCCTTGCCT GCTGGACTTT

GATCTATTGA AGTGGTGATG GGTGTTGCGG TTTCAGCCAT AAAGGCATCT GGCATAGTAG GCAAGAAGGG

CCAGAGACCC GAGGAGAGTT ATCTGTCTCT GTTAACTTCA GTGTATCCCT CTAGTTCCCC AGATGCACCT

GTTTCTGTAA ATATAAACAT GCATGTCATC AGAACACTTA ATATTCTGCA TACTGATCAT GACAACAAAA

TGTACCTTCT AACACAGACA CTCTCACTAG GATAGACCAT GTAGGAACAT CGAATTCTAT TCAGTTAGGA
```

```
CAGTGATGAT GTCTACATAT TATACCTCTG TCAAAACCTA CAGAATATAC AACACAGCAC AGAGTGAATT
CTAATGTAGC CTGTGGACAT TAATGAATAA TAATGTATCA ATATTGGCCC ATCAGTTGTA ACACTAATAT
AAGATGTTAA TAACAGGGGG AATTGAAGGG GTGGTGGGGA GATATGTTGG AACTCTTTGT GCTTTCTGCT
CAATTTTTCT GTAAACTTAA AACCGCACAC ACAAAAAAAG TTATTTTAAT TTTTTAAAAA GTATTCAGAG
GGACTTGACC TTTCCAAATT CTCTCAAAGC AGGTCGGAGT AGTTAAGAAC ACAAATTTTA GAACCAGACT
GCCAGAGTTT GAATCCTGGC TACACCACTT ACTAGCTTTG AGATTTCAGA CAATTTACTT AACTTCTCTG
TCTCATTTTC TTCATCTGTG TGATAAGAAA TAAAGTAACA GGCCAGGCCC AGTGGCTCAC GCCTGTAATC
CCAGCACTTT GAGAGGCCAA GGCGGGTGGA TCAGGAGTTC AAGATCAGCC TGGCCAACAT GACGAAAAAA
TACAAAATCT CTACTAAAAA TACAAAAATT AGCTGGGTGT GGTGGCAGGC ACCTGTAATC CCAGCTACTC
AGGAGGCTGA GGCAGGAGAA TTGCTTGAAC GCAGGAGGTG GAGGTTGCAG TGAGCCAAGA TCATGCCACT
GCACTCCAGT CTAGGCAACA GAATGAGACT CCATCTCAAA ATTAAAAAAA AAAAAAGTAA AAAGAAAAGA
TAAGAAATAT AGTACCAGCC CCTATCTCAG AGTTCCTAGC TTAGAAAAAT TCCCAGAATA TAATAAGTGC
AATGTAAGGG TCAGCTATCT TCATTATTAT TATCTATCAT AAATGAAATT ACACAATAAA GCTAGATCCG
TTTCTTTCCT CTCCTTCTAC AAAAAATAAA GCAACTTTCC AGAACAATAC CCAGGTGATG ATTTCTCCCC
TGCTCCCTCC CTAAGATATT GGCAAGTTTG GAGGGTTCAA GGAGAAACAG AGCATGTAGA AAGATACCT
CTCTCATAAC CATTTGTGAT TTACAAGTCT TACCTGATTC TTTTGAACTT AAAGGATGTA AGAAGGCTTT
TGGTAGCTTC CATCTGATTC AAGGCTTTGG CAGCTGCTGT GGAATACATG AGAACACTAG GTAAAGCACT
GTCTTCCAAC ATGAAGAGAG AAAAATATGT GGAATGTTCA ATGGCATGCT TTGTATAAGA ATGCAACTTA
CCTGGCAGGA ACAAATTTCT TTGCTGCAAA AGAAAAGACA AACAACCATT AATTCAGACT AAATGACTTT
TAAGGATATA TTAAATCCAG ATACAATATG ACTTAATTCA TCAAGTGTTG CAAACTCGAT GCTTCAGGGC
CTCTGTAATA ATCAGAGCAC AAGCATGGCT CTGTGGCATC TAGGGTAAAA TGCAAAGTGC ACAGCCATCC
AAAGGGCATA GCAGCTTCCT AATGCCAGCA AATAGCTACG GGGTCATCTT GCCCAATTCA GCTCCCAATT
TTTCATGAGA AGTCCAAAGT CTTAATTTAA ATGTGAGATT TCCTATTTTG TAAACGTCAG AACTTAACTC
AAAAATGTTT TAAGTACTCT TAAACATGTA AGCCAAACAA ACCATGAGTG TAGTCAGATG TGCTTCCATA
TTCCTTATGA GAGACTCTCA AATTTAAGCC TGTACTCCAA ATAAATCTCC TTAGGAAGAA TTTTATCCAT
TTTCCTTAGA GTGCTCATCA TGGCAGTTCC ATTGCACAAT TCCGGGAGGC ATCATATAAT TCAACATGAA
TAGCACCCCC TGGAGTTGTA CAATATTAGG CACGACTAAC ATTTTTATTT CCTGAAACAC TTCCCACACT
GAGTTGTACT ACTAACTCTT TTCTTAATAC TTCTGCTTAA TTATACTGCA TTTTATCCAG ATTCTAATTA
TTGTTTAAAT CAGTAAGCAA GACCATGACT TATCAATGAG AAAGAAATGT ATTTTCAAAA ACATTTTTGA
AGTACATTCA TAAACTTCCT CACCTTTCCG TAAGCATTTC CGAAGCCAGA GGAGAAATGG TGCTAATGTC
AGGAGGGAGA GTCCAGCAGC AGAAAGTCCA GCTACCAAGG GAATGTTGGA CTCAGTGGGA GCTAAGGAAG
TAAGAGACGA AGAAAGGTCA TGAGGAAGAA TTGATGTTAA AGTCTCTCCG TCCTGTCCCT TTGGCCTTTT
TTCTGTACAT TCATTACTAG GAGCAGAAGA GCTATCTAGT TTAATACAAG AAGCAGAGAT GTGGCATTAC
AGGCCTTTGA GATCTGCTCC AAGCCACCTT TGAAGCTATT TCCACCATTG GCAGGCAGAA CTCTAACTTG
CCAAGCTCGT TCACAATACC ACACCACACC TTGGTTAATA AACACTGCAC TTGCTTGCTC TCTTGCTCTC
ACTCCCTCTT GTTTTCCATT TCCCCTTTCT CCTCTCCTCT CTCTGTCTCC TTTTTCCAGT TGTCAGAATT
CTACCCTTTC CATCAACATG CAACTTCTGT TTTTTCTCTA TCCCCATACA ACTTAATATT CACAACTTGT
CAACCTGGGC GAACTTTCTG GTTTGGATAT AATGAATAGT TGATTACTGT AACAAGATAG CTCCCCCTTT
TTCTTTTTAA TCACCAGACA ACCACCATCA ATCAATGCAT CACCTTCACA GGTAGGTAGC AGGCCAGACC
```

```
AGTGTCCTGT GGCTCCACAT GTCCGAGCTG CAGAGCCATT GAGCGTCCAT CCTTCAGGAC AGGCGAACTT
GCACACAGTG CCAAACACGG GCTCCCCACT GCAGCTCATG TTGATCTTTC CCGGAACTGC CAGGCTTGAA
CATTTTACCA CTGCAAATGT TAGGTACACA GGCAGAGTTT CAGAAAAATC TACTGGAAAA CTTCCAAAAC
TTGCTTAAAA GTCAACAATG AATGTAAAGT GTAAGCGCTA CTTAGTTTTC AGCATGTAGG AAATTAGGAC
CAAACCCCTT TGGGGCAATC TAGGTTCAGA AACTTTATGA AGTATTTGAC CTGTACCCTA AAAAGTCTG
CACTCAATTC TACCTTGGCA GGAAGGAACC TCTTCTGTCC ATTGTCCCTG AGATGTGCAC TCAAGTTGAG
TTGATCCATG TAATTCAAAT CCCTCCTCAC AGCTGAAGGC ACAAGAGGAC TTGTAGGTGA ATTCTCCAAT
AGGGGAATGA GCACACCTCA CCAAACCCTT CGGGGGCTGG TGGACAGCAT CGCATCTCAC AGCTGGAACA
CACGAGAGAG CACTTTAGAA GTTTGTTTGC ATCTCCAGCA ATACGTTTCC CAAGGTAACC AAGTTCCCAA
GCTCTTCAAT AGTTCTTTTT ATCTTAAAAT AAAATAAAAA CAAAGACTGT ACCTTCACAT GTGGGCTTCT
CGTTGTCCCA CTCCCCTGTG GGCCACATT GGAGCCTTTT GGATCCCTTC AACACAAAAC CCTGCTCACA
GGAGAACTCA CAGCTGGACC CATAACGGAA ACTGCCAGAA GCACTAGGAA GACAATTCAT GTAGCCTCGC
TCGGGGTTGG ACAAGGCTGT GCACTGGAAA GCTGAGACAT CAAAATGATG GTCAGAAAAT ATTGCAGTGG
AACTAGAGAG TACTTGGCGT TTGTTGAGTG AACCCAGTTC ATTCAAGCAA CACTTGGAGA ACTGAAGATT
CTTTATAATT CCCTGGACAA ATGGGAAGAT GGCTGTGTTT TCTTTGAATT TCAGCCCCCT CACTGATCAT
GGCACTAATT AAAAGACTAA TTAATCAGAA CATTAGTTCC TGAGCACTGT TCTTCTAACA CACAAAATAA
ATTATGGTCC AAGGAAAGAT TTCACGCAGT CTGAGGACAA CATATGGGTC ATGGATGTTT ATAGATGGTG
CCAAAAAGAA AGAAAAGAAA GCACCCCTAT AAAATTTGTC TGTTTTGCAG TTTGGTTTTT GTGTTATGTT
TTGCTACTGG AAATCATTCT GTGCTGGCTT TGGCTAGGAC AAGGCCAGTG CCTGATAGTA AAAACTGCTT
GTTTTCAATA TCCTTGCTCT CACTTTAAAG TGAATTAAAA TTTACTGCTT ATATATGCAT CAATACTATC
TCTGTAGCTG ACACCATGCT TGAAACAGTC TCATCACTGC TAATTATGAG CCATTTCAGA AGACAGGTGT
GATGAGAGTT TTACATTCAA ATCATGTTCT CATTATTCTG CTTTCCGAAT TTTCTAATAT GATTCCTTTA
GATTAAGAAT TCTGTCTATT CCATGCTAAT GTCTACAAAG TTTTATCAGC ACATCACAGT TAAAAAAAAA
CAGCAAAGAA TTCATTCTTA ACACATATGA TCCTTTCCCT GGCCAAACAT TAGTTCTTTT AAATGAATCT
CAAAGATACG AGGGTTGCTC ATCAAATCTG ATTTCTATAG TTAAAGTGGG TATGGGTTTT TTTTTTCACT
GTCCAAGTTT GAAGATGGTT GTTCTTTAAG AAAGTATAAA TCGAAGGATC TCAAGCTTAC CTTCACAAAC
TGGGATTTGC TGTGTCCACT GCCCTTGAGT GGTGCATTCA ACCTGGGCTG GTCCCTGCAA CATGAAGCCT
TCCTCACAGG TGAAGTTGCA GGATGATTTG AAGGTGAACT CTCCAGCAGG GGAATGGCTG CACCTCACAG
AGCCATTCTG AGGCTGGCGG ACGGCCCTGC ATGTCACAGC TGTAACAAAT ATACGCATTG ATATTAGCAC
GGCCTAGAAT TAGCTTGCCC ATTTCCAGTA TGGGTTGAGA GAAAGAATGT TCACAGTAAG TCTCCATGTG
GAACAACTCT ACCTTTACAC GTTGGCTTCT CGTTGTCCCA ATTCCCAGAT GAGGTACACT GAAGGCTCTG
GGCTCCCATT AGTTCAAATC CTTCTTCACA GTCAAATGTA CAGGTTGTGT TCCATGGGAA GCTTCCAGGG
TTTTGGAAAC ATTCCACGAA CCCATTGGCT GGATTTGTCA CAGCATCACA CTCAACCACT GAGGATTTTA
AAGAGCACCA TGAATTTTAC AGAAGAATGA TCTTTTCACT TCCTATTGAG CTGGGTGCCT AACAGAGTGA
GGAAGCTGCC TTCAAAGGGT AGATCCCAAA GTCCTATGTC AATTCTTAGG ACATGCACA GCCAGAATAA
AAGCTTTTAT TCTTTTTCAT GGATATTCTA TCTTTTCTGA TTTCCACTTT GCCTATGCTG AGTGGTCTCT
AATCTATGTT ATCATTTACG TGAGGTAAAA ATTTAAAAAA AATAGATTCC AGATTAGGAG TTATGACTAG
TACTGACATA CGTAGGCTAT TCATTTATTT TAGCCCATCA GAGCCTGAAG AACTGATTTT TCTTTTTTTG
GCCTCTGGTT CAGAAAGATA AAATTAAGAG AGAAAAAGAG ATACTAAGAC TGCTTGACTA TCATGGTCTT
AAGTTAGTCC CATGGCTTGG AAAAGTTAAA CAGGGAAACA AGATGAGAAA TCCATTGAGA TTTCTAGAGC
```

```
TTTATTGTTT TATGGTCTCC CTTACAAATC ACCAGAGCCT CAGAAACACC CATTTCAAGC ATAGAATAAA
AAAACCTCTC TCAACCCAAG CAGGTACTGG GTTGGCAATA TACATTGGCT GAGAGAACAA ATTGTATTAA
AAACAAAAAC AAAAAAAAAA CTTTCCCTGA AGTTTTGAAA ATGTAAGTTG AATCAAAAAA CAGAAGCAAT
GAGGGATGAG TTACAGAACG TTCTGTGCAT TCTCAGAGGG ATTTACCATT GCAGGCTGGA ATAGGAGCAC
TCCATTCTCC AGAGGACATA CACTGCATGG TCTCCATGCT GCTTGGCAGG TAACCCCTAT CACAGCTGAT
AGAGCAGGAA GAATTGTAGC TGAAGTTTCC CAGTGGGTGA CTGCAAACCA GGCTTCCATG CTCAGGGGAT
TCCAGGGCTG TACAGTTCAC AACTGAAAAA GAAACCCAAA TCAGTTCTGC TCATCTCTCA CCTTTAACAG
ATAAGAACAC TGGAAACTAG AACTACAGTT TGGTTTTTTT TTTTTTTAGT TTAAAAATTT ATAAAATTTC
TAATGGAATT TGTAAAATTG ACTGTAATTC TACCCCTTTT CTTTTATTCA AGAAAATGCT GATCCATAAC
AACAACAACA AAAAGCAGT GATGACAACC ATAAAAAAGA AATATTGAGT GATATGGGGA GAGTAGTGTA
ATTGTGTTTA CCTCAAAACT GTTCAAATTA TATGAACAAA CACAGCAAAC TTAGGTACCA CAACAAATTT
CTTGTTACTT TTCTCACAAC TGCTAAAAAT ACTACAGTAA GCTTCCAACC AGGATGAGAA CCATTCACAA
AGCTATATTT CAAATTTAAG TACTAGAATA CATTACAAAT TTTAAAACCC TAATGCTGCA CTGTCTACTA
TAGTAGCCAC TATCTGTGTG GCTACTCAAA TTTAAACTTG AATTCGTTGA AATCAAATAA CATTTAAAAT
TCAGTTCCTC AGTGTCACCA GCCACATTTC AAGTACTCAA TAACCACATG TGGCTCATAG GTACACACTG
GAAAACACAG CTATGGAACA TTTCCATTAT CACAAAAGCT CTACTGCACA ACGCTGTGCT AAGGAATCTT
GGAGAGAAGC TCATCTAACT CTCTTAATGT ACAAATTTAG GAACTGAGAC CTCATTTCAT TCAAGTGACT
TGCTCCATGC TACACGGCTA GTCATTACAG AGCCAGAGGC CAGAGCATGA ACCAAGATAC CCTGGACTCT
GTAACTCACT CATTTCTACT GCAACGTCTT GTTACCACCT AGATGAGGTG AGTACATGTT CCTCGCAGGG
ACACAGAATT ACAGTTTATT GAATGTGTCC TGTGTGCCAG GCACCATGTA ACCATGAGCC TATGAAGTTC
ACACTATTAT TATCCTCATT TTACAATGAG AAAACTGACA TAGAGAGTTA AACTATCTTG TCAAGGTGCC
AAAATAAATA ACTGGTGAAT CTAGGACTCA AACCCAGCAG GGTCTGACTT CATAGTCTCA GCTCACGATC
ACCATATGAC ACCATCTGCA CCAGGGAAGG GAAGGCATGC AGACCTGACT CTAATGCCAG CTAGGACGTG
AGATGGTGCT ACCATCTCAA GTGAAGAAAG AGGCAAGAAC CAGACTTACT TTGCTCACAC TTGAGTCCAC
TGAAGCCAGG GTCACACTTG CAAGTGTAAT TATTGATGGT CTCTACACAT TCACCGTGGC CACTGCAGGA
TGTATTGGTA CAGGCAGCTA CGGAAAATAC AAAGCATGAT GAGGAGGACT ATTACTGTGC TTATACTGAG
TGCCTTTGAT TTTAGAATCA ACAGTGTGCA ACAGAGACAT CAGCAGTCCT ACAGAGTGCC ATAGACTTTA
ACTGAAGTGT TTTACAAAGT TCCAAATCTG AGTTTCAGGC CCACCTATCC TAAACCTTGA TGCTAATGTA
TAGCTGTGGC TGGCACCTAC CGTAGAAAAT TTACTTCTTC ACAAACTCTG AAGACAGTTC CCCTACCACA
AATAAACAAG TAATTAAAAT ATGTATTGTG TGTGTGCATT TTTATATGTA AAGAACTACA TATTTGCCTA
CAGTATTTAT ATATATTTTA TATATATACA TACACACATA TATGTGTGTA TATGTGTGTA TGTATATATA
TAAAATGTAT ATAAATGCTG TAGGCTATAT ATATATACAC ACACACATAT ATGTGTGTGT GTATATATGT
GTGTGTGTGT ATATATATAC ATATCCACAT ATTCTTGCCC ACATTCACAC AAAACAGCAA AAGAGAGAAA
CTTTAGCAGT TAAACAGAAT CTTTTGGAAC ATAAAATGAC CACAATAGAG AGCAGTTTTT GCATGCTGTA
AATTTGCCAA GATGCCCACA CACTGAAACT ACCTCCCACT GCTGCCGCAA ACTCCCTACC TGTGTAGCAT
AGGGCAAGCT TCTTCTTGCT GCACCTCTCA TCATTCCACA TGCCCACATC TTTTTCTCTC TTGATGTAGA
TCTCCACGCA GTCCTCATCT TTTTGCCTAT TGTTGGGTTC ACCTGGAGCC CAGTTCTTGG CTTCTTCTGT
CAGAGGTTTC TGGGTTCCTA CCCAGACCCA CACATTGTTG ACTTTTCTGA TTCCAATCCA GTAATAACTT
GGTGAATAGC TCAATATGGA GTTTAGGTAC TCAATCTCTT CTTTGTTTTG AATTGCAACC AGGTGTGTGT
```

-continued

```
ACCTTTGCTG ACAATAAGCA CTGGCCTCAT CATAAGTCAT AGCTTCCGTG GAGGTGTTGT AAGACCAGGC
TCCACTCTCT TTAATGAGAA GCACTAGTGG GAGAAAAAGA AAAGAAATGG TAGAGTTTGG TACTGTTGTG
GTTTAACTCT GACAACTGTG CTTTTTATTG TCTTATTTTT GGCAATGTTT GTGACATGGC CCAGACTTTT
CTCATCTTTT CAAAAGTAAG AAGTACGTAT GAAGAAACAG CGACTTATTG TTTATCTCTT TTGTGACTGC
CACCCACTAG GTACCTTATC CACACTCACT CACAACATTA TAGTATACCC ATTTTGTAGT AGAATAATAA
TCAGAATAAC TAAGCTTTAT TGAGCACTTA GTATGCACCA AGAAGCACTG TATGAGGTAC TTTCCATGAA
CCATGCTATT GAATCCTCAC AATGCATCTG GGAAATAGGT CATTATGATC CACACTTTAC ACTTAAGGAA
AGGGAGACAC CAAGAGGTAA AGTAAATGAC CCCAAGCCCA GGGAAGAACA CATTGCAGGT AGAGGTCAAG
GATGCTGCCA GATATCCTGT GCAGGACAGC CCCAGACAAG CAAGGATATT TCAGTCTGAA ATATCTATAG
TGCGAGAATG AGAAATCTTG GTCTAATGGC ACTGACTTAC CCAAAGTGAG AGCTGAGAGA AACTGTGAAG
CAATCATGAC TTCAAGAGTT CTTTTCACCC AAAGGTTTAG GCTTGAAATA CTTTCCTGGG GAGATAAAAC
ACAAAATGAA TTAAAGAAGG AAATCGTGGG TAGCTAGTTA CATTATTCTA CCATGATGTT TAAGGCAGCA
TCCTAAGATT TTGGGCAAAG GACACTAGTG CAATAATCTT TATTTCAGAG TTTAATCAAA TAAATAAACA
AATTTTAAGA CTTTCATTAT TTAGGTCAAA GAGAAAAGAC AGGTTTTAGC TACAATACAA TAAGAGCTTG
TACAGATGTG GTTTTTATTA GAAGGCCTTT TGCATATCTG TGTTTCATGG CCCGAGGCTG CCCTTATAAA
GCGTTCTGCA CTTACCGTTT TGGGAAGCAG TTGTTCAAAC ACAGGATCTC TCAGGTGGGT ATCACTGCTG
CCTCTGTCTC AGGTCAGTAT AGGAGTTTTG ATGTGAAGTC AGCCAAGAAC AGCTGAACAC TACTTCGGCT
GAGGCCCTTT TATAGGAGGG ATTGCTTCCT GTGAATAATA GGAGGATATT GTCCACATCC AGTAAAGAGG
AAATCCCCAA TGGCATCCAA AAACTTTCCC GGGAATATCC ACGATGCTTA AAATTACAAT GATGTCAGAA
ACTCTGTCTC TTGAAGCTAC TTCACCTTTG TCCATGCCTT TATATCGTAT ATGCAATTTT ATTAATATGA
CAAAAATGCA TGATTTTTAA TTATAATAAC ATAAAGTCTA TGTCTTTAAA AAGTTGTAAA ACTTTGCTTG
TTAGTAGTGT CTCTCATGTA GTTGTGGTAG TAATTAGAAT TTCAGAAACA GAAGGAAACC AAGAATAGGT
TTGTCATCCA TAGTCTACTA CCTTCAATTT CTCATTCATA GCTGTGGATA ACCAATCACT ACTCATTTTT
TCTTCCTTTT TCACCTGCCA ATTCAACATA TTTAACATGC ACTGTCTCAC AGAGGAATGA CTCACAAGGT
AGATATTAAT CTTCAGATTT TGCACGGCAG TTATGCCTAA ATTAAAATAT TATCTAAAAA TAATATCTAA
CACTCAAATG GTTAAAATAA TGCCTTATTT TAAAAAAAGA AAAATGGGAA ATAGATATTT ACATCTGGGA
AACTTTCATG GTTTGTTCAG TGAAAAAAAT AAAAAGGAGG CCAGGCACAG TGGCTCACGC CTGTAATCCC
ACCACTTTGG GAGGCCGAGG CAGGCGGATC ACCTGAGGCC GGGAGTTCAA GACCAGCCTG ACCAACATGG
AGAAACGCCA TCTCTACTAA AAATACAAAA TTAGCTGGGC ATGGTGGCGC ATGCCTGTAA TCCCAGCTAC
TCGGAGGCT GAGGCAGGAG AATCGCTTGA ACCCGGGAAG TGGAGGTTGC AGTGAGCCAA GATCACGCCA
GTGCACTCCA GCCTGGGAAA CGAGTGAAAC TCTGTCTTAA AAAAAAAAA AAAAAAGAA AAGAAAGAA
AAAAATAAA ACGAAAACT ATATATATAT ATTTAATTGG TCAAAATTTT GTTTAAAATT TTTGAAATGT
TAATGTGCAA AGAATAAAAA TTCTTCCACA ATGTTAACAG TGACTAACTC TGGATGGCAG GATTTGGGAT
AATTTTTATA TCCTTCATTA TTATTTTCAG GATTTTAAAG TTTTTTTCAA TTTCCCTTTT TTTCACCTTT
ATAGTAACAA GAATACAGTT TAAAGAAACT TGTCTCTAGG CCAGGCATGA TGGCTCATGC CTGTAATCCC
AGCACTTTGG GAGGCTGAGG TGGGTGGATC ACCTGAGGTC AGGAGTTCCA GACCAGCGTG GCCAATATGG
TGAAACCCTG TCTCTACTAA AAATACAAAA ATTAGCCGGG GTGTAGTGGC GCATGCCTGT AATCCCAGCT
ACTGGGAGC CTGATGCAAG AGAATCGCTT GAACCCAGGA GGCAGAGGTT GCAGTGAGCT GAAATCACAC
CATTGCACTC CAGCCTGGGC GACAGAGCAA GACTCCATCT CAAAAAAAAA GAAAAAAAGA AAAAGAAAG
AAAAGAAATT TGTTTCCAAA TGCAACAGAA GGAGATGTAT GTGGTATCCT ATATTCCTGC TCTTCATTTT
```

```
GACATTTCTT CTGGGTGATT GTATACATTC CCCATCTCTG CATCTTACCC TATCTAAATG ATGGTAACAG

TAAATGGGGA TCATTTTAAT TTCCATATTC TGTAGGTTTT CAGAGCTCAA GTCAAGCTAA TATTCTATAT

CTACAGCCTT TCAAAATAGG AGGTCTATCT AAAAATGTAC TGTCAGCAGA CCTGAACGAG TAGTGGTAAA

AGCCTCGTTT TTCTCTTTAC TTGTTAGCAC TGGTCTTTCT GTGTTCATAA AGATGTCAAG ACCCAAAAAA

AAAACAAGAA AAGAGAAGAA AAATTCCAAA AAGACAACT GATTAGAAAA AATAACTTA ATTAACGAAT

TTAATTCAAC CCCTATCAAA AGCATAGAA TTTATTCCCT CCACCTTACC ACTCTCTTAC ATGATCCAGA

TACTGACATT ATTCCAATTC TTTATCCCAC TTTACTTAGC TCAATGTGGT TGTTGCTTCA ATAAATTCAG

AAGAGTAATC ACTCATATAG TGTTTATTTA GATTTTAGGG CAGAATGTCA AGTTGGGTTA ATACATTATC

TGTATGTATT TTATTTTTAA TAAAGTATGA ATACATAATC TGCTATTTTT AAAAAGCATG GTCAAATGTA

TAGAGTAGCC AAATCTTAAA AAACAATTTA TCTTCGATAT CAATAAAGTA CCTAATAATT ATATTGCTAA

TAGAAATTAG TCGTTAACAT CCCTAGATAA CTAACTTTAT TATTGCGAAT TTTTCATAAC TAAGTTTATA

GTTTATCTCT TCCCCTTTTT AAAATTAGTT CAAAGATATC TAAAAATAGC CCCAGTGGTG ATGAAGTTTC

TATTTTACTT ACATATATAT GTCCTGGACC CCCAATTATA ATCTCTAACA TTTATTGAGT GCTTACTATG

TGCCAGGCCA TATTCTGAGC ATTTTGTATG TTCACCTATT GATTATTCAA TCCGTACAAC AGCCTATGAA

ATAGGTACTC CTATTATCCC CATTTTACAG ATGAGGAAAT TGAGAATCTG GGGATTTTAT CTCATTCAAA

AGCACAGAGC TAAGGGTTGA AACCAGGCAG TTGATATCCA GAGCCCACTC CCTTACCTGC TACTCCAAAC

CATGATTTCT TTTGTTGTTA TGCCCCGAGA TTCCTTGTTC TACCCAAGTT TCCTGTACTC TTCTTGCCCT

CTTCTTCCTG AGACATCCTT GACCATCACA GCTCTCCACT GAGATAACTG TGTCCTGGGT TCTGAGACAT

GGGGGCTGGA AGGGACCCCA GGGACAGTGA GCAGTAGGGA GAGGATGCAG TGAGAACAGA CCCTGGATCC

CCGGTGCATA GGCAGGGAGA AAGTGGACAA AGGAAAAAAC AAGCAAGGCA GGTGGAGCCA TGCCTAGGTA

AAGTTGATCC CTAAGCCACA GTTCCCAGAA GTTCCTGATT CAAAAGCAAA TTTTCTCTAA GGTCAAAGGG

CAAACTGATT ATTCTAAATT CTAAACTGAT TATTTCTAAA TTGAGAAAGC TTCAGGGAGA GATCCCAATA

TTCGAAGGAT AAGAGAAATG AGGAGTGGAA GAGATAGGTG AGTAACAGTA ACTTAAATGT AGACTATATA

TAATATATAA TATATGTAGA GTATATATAT ATAATTACAA TATATTATAT ATGTGGAATA TATATATTAT

TTATATATAT TTATATATTT TATATATATA GATATTTTTA TATTTTATAT ATAAATATAG ATATTTTTAT

ATTTTATATA TAAATATAGA TATTTTTATA TATATTATAT ATAAATATAT GTAAAATACT GTGAAAGAAG

AATAGAATCT TGAGACCTCA AATTCACTAT GCCAAAGGGA AAGTTAAGCT TGGGAAATGA GTCATGCAAA

AACTGCCTTC CTTTTGTTCC CAAATACCTG TAATTTCACA TGCTTACTTT ATCTTATATA AAATGTAGAT

GTACTGAGCA TGAGATCCAT GCATAATTTC CCTCTAGTCC CTTCTTTTTA CATGTAAAGT GTAGACTCAC

TGAGTGTTAC AGAGCCTTGC CACAATGTAA ACACTTGTCT CATTGCCAAC CCATCTTTCG TTTATTTTCT

TCCCCTCCTG CTTGCTCTTT CCCCTCTAAA GATGGAAGTT CCCAAAACTC TCTTTGGAAA AAGCGCAGGT

CACAGATCCT ACAGTGATTT GTGTTTCTTT TACCTGGGAC AAAATAAACC TCTAATCTGT TGAGATATGC

TTCAGTTACT TTTTGGTTTA CAATATGTAC ATGTATGTAT ATAATTTATA TGTATATAAT ATATGTACTT

GTTTTAACCA GAGGTATGTT ATTCAAAATC CATTCATCCT TACAATTACC TGCATTCTCC CACAGTATTT

TCTGTGTCCC TGCCCCCGAG GTTGTCACTG CAAATCAGGT ACATGGATAC TGGGAGCTGA TGGGCTCCCC

TCTGGCTACC TGGGCTGCTG AAGGGGCCAT AGACAGACCC AGCTTTCCTC TCGTGGAGAG GCCCTGGGCC

AGCGCTGCGT GGGAGTGGGA TTACAACCAG ACTATAGCTT CTTCACCTGC TTTTTCCTAT CAGGATTTCA

TAAGAGGCAA TTGCTTGTTT TTGAGGGGTG GGGCAAATC AGGGGAGTT GAAGAGGAAA TTGGGTAAGA

TTTGAATAGT TGGGCATGTT GAATATTATG AATATCATCT CCCTCTTCAA ATAATCCAAA ATATACCCCC
```

-continued

```
AAGAAACAGG CTGATTAGAG GTGCTTCAAG GCTCCACTGA ATCTCCCAAG CTCTGAAGAT GTAGCTAGCT
GTTACCGGAT TGCCGGTTTT CAAGCCTCGC CTCACATGGA CCCTCTTGGC AGTTTCTCGC ATGGGGAAG
CATCCGCTAC ATAGATGGGA ATGAAAAGAG GAAAGAAGAC GGTGCAAACT CAGGCACACC CCGGTGTCTG
CCACCAGTGC TATTTAATCT CTGAGGTGTC ACCCTTCCTG GCTTTATTGT CTCTTCCTGG AAGTCTCTTG
TCCTCTCCTC CACACCCTTT AATCAGGCAT CAAAGACTTT AACCAGTTTT GCTGTGTGCC CAGGCCCACT
CATTCTCACT TTTATGGCAA AGGGAGTGGG AGACAGAGAG ATAGCCAGAA AGAAGAGATT GGGGACCCCA
AGACAAATGT TAGAATTTTA ACCAAGGCCA CCCTGTGGAC AGGAGATTAT TGGGTTTAGT GGAAAGCAGC
ACTGGCCACA ACCACACGTG GCAAAAGCAT CTATCGAGGA GTGAAGTTAT ATTTGGTGAA TGTGACCGGG
AAGCAGGGGC AGTGGTGTCC TCCTGCCTTC CTGAGGCACT CTGTTCCCTT ACCTCTGCGA AGGCTTATTT
TACCCCTGAG TGCTTAGTTT TGAAAGCCTT AGTTCCCTCT CTCCCATAAA AAAGCTCTAC TCTGCTAACA
TCTAAGTTAC CTTTGCAGAG TCTTAGGTAG AGGGAGGAAA TCCCAATAAA GATTCCACCC TATCTGCAAA
ATACAAACAT GGTATTTCTT GCATTCCCAA AATTGTGAAA GAAATGTGT ATCACCACAG TAGAGAATGG
CATTTTTTGT TTGATCAAAA CCTAAATATA TTTGATGAAA ATGTGTCTGG TTCTAAGTTT ATTTCCCAGA
AAGCCATGTT TACTCACTTG GAATTTATAG ACATCTTATA ATATCTGAGT CGAGTAGGAG CTCCGGGCTC
TACCTCACTC TTTTCTCCCA CACCCAGGGG GAAGTGTAGG GTTCTCAGAC TTTAGAATAA AGAGGAATCA
CCTGGACAAC TCACCTAAAA TGCACATCTT CAGGTCTCAT ACTCAGAGGC TCTGACTCAA CAGGTCTGGG
TGGCGCCCAA GAATTTGGGC TTTAAATGAG TATCTCAGAT GATTCTAATA CAGAATGTGT AAGATGACCA
GATCCTATCA CACTTAGATG TATTGGCCTA GGGCCACCTA ACTTGGAGAA AATGTTAGTA AGACCCCGTG
GTTGGTGCTC AGCTATAGGT ACCAGAATTT TGATCAAAAT TTACTATCAT TGTGACACTT CTCTTCGGAA
CTGGAAGGCC AGAACCCCAC TTGTAAAGTG CTGGGAAAAT ACAAGGAAAA TTTAGGGTGA GTAGCATTTT
GAATTCTTAC ACATGGAAAG TAAATGTATA AGAATTCTTA CCAATAAAAA AAAAGCAAGA GAGAATAGCT
GCTAAAGAAT TAACACAAAT ATGTATATAT TAGTTATTCT CTTTTCTCCT CTGATTCCAG AGGACTTTGT
AATTCCACTA ATTCTTCTTG AGCTTCCAGG ATGATCTGAG ACTTGAATTT TCATGTGCT TTTTGCTTCC
TATTTGGCAG CATCTTATCT TGAAGTTTCC GCTTTCTGCT TGGGGACCTA AAAACTAACT AATGGGAATT
TCTTCAAAAT GAGCAAACTC TGGTGAATTC CCAAAGCGGA AGAAACAAGT GAGGATCGGG CTGGTTAATT
AAGAGAACTT TTCCTGAATG TAGCCAGACT GTTTGCCGAC TGTTGTTAAC ATGAGGGAAG AAATACCCCT
GGATTTTAGA AGAGCCCCTT GTTTGTTTTC CTTGGCCATT TGTGCTGCTT GTTTTGTAAG TCAGAAATTT
CCTGAAGGAC TATTATTAGC TTTGTTCTCA CGTCAGAAAA CTTCTGCTCT GGCCACTTTT AAACATATAA
CTTGGATTTT ACTGTATTAG AAAATGTAAC AATTACAGAC AGCACTAAAA GGACACCAAA GGGCAAAGAA
AATGGGTAAC TTTTTTTTCT TCCCCAAATC TAAAATAGGT GATTTTGGAG AAGTAGGAGA AAAACCTGGA
TTTTCTAGAT CTCTTTAGAG CTCAACAACT GATATAGTTA ATTATGTAAG TCTTTGATAT TTGGAAATGA
TTGGATTAAC CGGATAACAA TGAATATTTA AATACAGTGA TTTGGCCAGG AGCAGTGGCT CATGCCTGTA
ATCCCAGCAT TTGGGGAGGC TGAGGCGGGT GGATCACCTA AGGCCGGGAG TTCCAGACCA GCCTGGCCAA
CATGGTGAAA CCCCATCTCT ACTAAAAATA CAAAATTAGC CAGGCGTGGT GGTGCAAGAC TGTAATCCCA
GCAACTCGGG AGGCTGAGGC AGGAGAATTG CTTGAACCCG GGAGGCAGAG GTTGCAGTGA GCCAAGATCA
CGCCATTGCA CTCCAGCCTG GGCAACAAGA GCGAAATTCC ATCTCAATAA ATAAATAAAT AAATACAGTG
ATTTAACACA AGAGATTTCT ATTTCACACT AATGAGCTCT GTCACTGGGG CAAGCTTCTT GCCTCATTA
AGTCTCAGAT TTCCCGAGAG CTTATTTATT TATACCAAGA GTGCTTTACT ACCGTCTCTG CTAGCTGTGA
CATAATATGA CAAAAGGTAT AAATATGGGA AAAGGCACTA ATTTATATCA AAGCGTTCTT CGTTTTTCCT
TGCTGTGAAG TTTTTAGCTA ATAATTCATA AGAATATACC ATATTTAGAG TGTTTACTAT GCATGGGCCT
```

-continued

```
GGCACTTCAC ATACATTGCT TCTTACAAAT TTTACAAAGT GAAAGGTAGA TATTAATCTC ATTTTATGGA

GGACAAGATA GAGATCTGGA GAGGTTACAT AACTTGCCAG TGTTTTTTCA GTTAATAAAT GGTAGGGTGG

AGATTCAATC TGTGTTACTC TAAAGTCCGT GTCCTTTTTA TTGGCTCCAT GCCTACTCAG ATTTAAATCT

CAGCAGGGAA GTAAACCTTA GTTTTTACAT GAGAAAATGT TACAGCAGCC TTCTCGGCTT CCTTTACCCC

CATCCCAGTT TCACGAGCTT AGTGCCTTAG ATCGGGTTCC TTTAGAAGCA GACCTCGAAA TAAGGATGTG

GGTGCCAGTC ATTTATTGAA AAGATGATCC CAAGAAAGCC TAGTAGGAGA GTGAGGAAGT GAGATGGGGA

AAGGAAGAAA CTCCACAAGA AGTGTGTTAA TAAGCAGGTT ACCGCTGTGG GCAGCCATGG GGCTCAGCTG

CACTAACAAA CTCTGTCTAG TACAGAAAAC CTCAGGGTCT CCCCAAGGAG GGGCAAGAAG TCTGCCTAGG

GTATATATCC GCCAACTCAG TCACTGGCTG AGAGCTGATC CTGGGAGGGC ATGGTTAATT CCTCTGCACT

TTCAAGTGGA TTCCTGTGGT CAGAAAAAGC CCTCTACAAT GAATTCCAGA TGCTTGTATT TAAATCTGAC

ATGATCTGAA TGCTGTGTTG GGACAGGGTG GGCGTTATTA GTTTTCTGTC ATTACTGTAA CAGATTACTA

CAAACCTGAT GGCTGCAAAC AACACATATT TATTATGTCA TAGTTTGTGT GGGTCAGAAG TACAGGTTAG

CTCAACTAGT TTCTCTGCTC TAGGTTTCAC ATTGCCAATA TCAAGGTGTC ATCCAGTTGG GCTCTTCTTG

GGAGGCTTGG GGATGAATCC ACTTTCAAGC TCATTCAGAT TGTTGGCAGA ATCCAGTTCC TTGTGGTTGC

AGGACCAAGG TCCCTGTTGC CTTGCTGGCT GTTGGCCAGG AGTCATTCTT AGCTTCTAGA GACTACCTGT

ACTCTCTGAC TCGTGTCTCC ACTTCACCTT TCAAACCAGC AGCGGCTAGT CGAGTCCCTC TCTTCAAATG

TCTCCAACTG TGCCTTCACC TCATTTCTCC TCTGTGTACC ATGTCTGCCT CTACTGCTTG TAAGGGCTCA

TGGGATTACA TTGGATTTAT TCAATCCAGG ATAATCTCCA TATTTAAGG CTAGCTGACT AGTGATCTTA

ATTCCATCTA CAAAGTCCCT TCCAATAGTA CTGTATTAGT CCATTTTCAT GCTACTGATA AAGACATACC

CAAGACTGGG CAATTCACAA AGAAAGAGG TTTAATTAGA TTTACAGTTC CACATGGCTG GGGAAGCCTC

ACAATCATGG CAGAAGTCAA GGAAGAGCAA GTCATGTCTT ACATAGATGG CAGCAGGCAA AGAGAGAGAG

CTTGTGCAGG GAACTCCTCT TTTTAAAACC ATCAGATCTC ATAATACTTA TTCACTATCA CAAGAACAGC

ATGGGAAAGT CTTGCCCCCA TGATTCAATT ACTCCCACCA GGTCCCTCCC ACAACATGCA GGAATTCAAG

ATGAGATTTG TGTGGGACA CAGCCAAACC ATATCAAGTA CCTAGATTCA TGTTTGATTA ACAACCAGG

GAGCAGAAAT CTTCAGGAGT GGGGGGCATC TTTAGAATTC TGCCCACCAA GGCTGGGCGC GGTGGCTCAC

ACCTGTAATC CCAGCACTTT GGGAGGCCAA GGTGGGTGGA TCATGAGGTC AAGAGATCGA GACCACCCTG

GCCATGGTGA AACCCCATTT CTACTAAAAA TACAAAAATT AGCCAGGTAT GGTGGTGGGC ACCTGTAGTC

CCAGCTACTC AGGAGGCTGA GGTAGGAGAA TCACTTGAAC CCAGGAAGCG GAGGTTGCAG TGAGCCAAGA

TTGCGCCGCT GCACTCCAGC CTGGGAGACA GAGCAAGACT GTCTCAAAAA AAAAGAATTC TGCCCATCAT

AGTAGGCTGT CCTACAGAGA CATAACCCAG GAATTAGGTG AATGGCTAAC CTAAATTAGC ACTGTGATGT

GTTTTCTGAC TTGGTCCTTA TAGCTCCTCT GCTTAGATGT GGAACTAATC CATGAATGCA AGGGTTTGTC

TAGAGTTTTA AGTGGGAGTT AAATATCCAA AGTACAGGAG ATATTATGGG TGCCTCATCC ATGTCCCCTT

GGCATTTATC TTTCTTGGAT AACCCAACTC TATTAGTTTT TATATCTCAC TTGTTCCTAT ACTCTGTGAA

CTGATGTCCC ATAAATAGAC ATTTCATTTT GCCAGTCTTC TTGAACAATA ATTACGATTA TTAATCTAGC

AGTTATCATT AATTGGCCAC TTCACATTAG ACACAGCACT TAGGACTTAA GAATACCATG TCATTTGATC

ATCATAAATAT GGTCAGGAAT TAAGTATTGC TATCCAAATT TTACAAAGAA GGCACTGAGG GTTAGAGTTT

AAATAACTTG CTTAAGATGT CATAGCCTGT AAGTGACAAA ACTAGGACTC AAATACAGGT CCATCTGACT

CCAAAGTCTA TGTTCTTGGC TACCACACTG CCTCTCCTAC AAGTGACCTG TGGTTTTACT ACTATATTCA

CACTCTACTA ACTTTACCAT CTCCCATGAG TCTGTCTAGA GGAGGGCACA CACAGCACAG AAAACACATG
```

```
AATGCAAAAT AAGGAAGGGC CTACTTACTA CACAGAGCCA TTCTAATACC TGATGTTTGC TCTAATCCAG
TTTTACTATT AATTAGTTGC TGGTGCCCAA GTTTTTACTG AGAAATGGGG ATAATTTTGG AAGTCATAAT
GATGCCTTCT TCTCATAGGG TATTTTATTT GTTGTTGTAT CTCCAGGCCC AACACAGCC TGGCTTTTAG
TAAATGATCA AAAATACCTG TTGAATGAAT AAATGGAGTC ACCTGAAACA TGTTAAACAT TTGTTCATGT
GTCCTAATCG TGGATTTCAG GATAGTAAGC ATCCTAAAAG GAAAGCATGC ACACTGTTCT TGCTACATTA
ATTTCTCACA ATATAAAAAA AGAAAAGCAT CTGAAAAAG CTGCCAGCCG CTGTGTCTCC TAATATCAAA
CTGAGCACAG ATATGGAGAA GCTAAGGGAG AGGGATGATG GGCCATGCCT CTAACCTCAT CATGGCAAAA
GTCCTGGGGG TCAGACCCGA GGAGAGCAGG AAGTGTCTTT TGAGGGATAC ATTTCCACAG TGGAAATAAT
GAGACTTAAA TAAATATTAT ATACACAGTT CAACTGTTTT TATGTGTAAA GGTAGTAGGT TTTCACAGTA
AGGAAGCACT TCTATTTTTT TTTGTTTGAG ACAGAGTCTC GCTCTGTCTC CCAGCCTGGA GTACAGTGGT
GCTATCTCGG CTCACTGCAA TCTCTGCCTC CTGGATTCAA GTGATTCTCC TGCCTCAGCC TCCCGAGTAG
CTGGGACAAC AGGTGTGTGC CATTACACCT GGCTAATTTT TGTATTTTTA GCAGAGATGC GGTTTCACCA
TGTTGGCCAG GCTGATCTCG AACTCCTGAC CTCAGGTGTT CTGCCCGCCT CTGCCTCCCA ATGTGCTGGG
ATTACAGGCA TGAGCCACTG CACTCACCAA GCACTTCTAC TGATAGCATT TACAAACCCT TCTTAGAATA
TTTAAAAATT CTAAGAGAAG AGTAAATTGA GCCTTCCCAA CTAATACTAG GAGGTTATAA CCTTCATACC
AAAACTGGAC AATGCTTGCA CAAAAGAAGG AAGCCAATGA GGCCACCTAG AAGGAAGACT GGGCATTGGG
CCCAGTGAGT CCTGGAAACC TCATCTGTGC CAGCCACCCC GGCATGGCCT GTATGAGTGG ATGAGGGTGA
CTTGTCCACA GACAATAGCC ATCTAGCTGT GATAAAGGAG TCAAGGTAGT CAGCTGCATC TCTTTCACCT
GTTTGCCAAT GTTACACAGG TTGAAAAGCT AAGGTTTATG TAAAGCAAGC ATCAAAGATG ATGAAATGAT
CAACCTGACA ATGAGTACTA TGCTGCATTG TCCAGAAAGG AACTGTGGAA GATTTTGGGC TGAATTTCAA
AACAGAATTT CCTCACTCTC TGGATGTTGG CTTACTTGGC CTTTGATGTT CAGAGGTGGT GCCTTTGTGT
TGTTGAACAA TGTTGATTTT GGAGAGAAAA CAGAGTTGAA AAACCCACAA GTCATTCCCT GGGGAGTATT
ACCGGAATAC AGAGGATAAT TTCAGCAAGC CAGCAAGGCC TCATCTCTGC TTCTAATAGA TAGGAAGAAA
GGAAGAGAGG AACAATACTT TTTTAAGAAG CTCAGCTTTA TCGCCTTATC TCATAGAAAG ATGCCTCCAG
TCTGTCTGGC TAAAGGTAAT TGGCATGGGA AAGTCTTTAT CTGTGATTCT AACAAGTGGA ATGTTTCCCT
TCATTAAGAG AGCCTTGTCT GGCTTGGGGA ATGAAACAC TTTCTCCGAT ATGAGTGGGC TGTAACCCCT
GCTACTAAAT ACTCAGAAGA AATAAGGCGG TTGTGGAGCA GTCAGGAATG AGTCACTTGC CTCCCTGGAA
TATTCAGAAA ACTGAATCAA AAGTACATTC TTCTGGGTTT TCTTAGTCTA ATAGACTAAG GGTCTCTACT
TTGTTAAATT TCTGGGAAAC AGCATAGAAT GGGAGAAAAA ACTGGTCACT GTAGTCATGC AAATCTGCAA
AACAAACAAA AAAGTCTGGG TATTGCTGCT AACTAGCTAT GTGACCTTAA GCAAGGTATT AACTCTCTCT
GAATTTCAGG TTCTTCATCT GTTAAATAGC ATATCTGTAA AATGGGAATT ATTTTCATAT CATAATGCTG
TAGCTTTAAA AAATAAAATA AAATGGATGA GATAATCAGA ATTAAAGAGC CTGGGATATA TAGTTAATAT
ATAGCAGCAT GTAAAGATCC TGTTAGAAAT GCTAATTTTA CAGTTAACCA TTTGGAGATG ATCCGCCAAA
GCTGCTAGTG TAGAGGCAAC TGAGAATTTG CCTGTCCTTC AGAATATGAA TAAATAACTG TCAATGATGT
CTCAAGCCTA GAAAAACCTA TCCATCTGGA TGGGTGGGAA ATTTCTAGGC TAGTATTGAG AAGCCCATTT
CTTGGGAAAT AGGTCCTGGA CTGAGTGAAG GAAAAGAAAC AGTAAAACCC ATGGTAAAGC AGCAAGGCTC
TCTAGAGGCT CTGGAGAGGA TGAATTGAAT TCTAGAAGAT GAAGTAGGGA AGACGCTTTA CCTTCTTGTG
AAATGGATTC AAAGATTCAA AGACCTTCGG GAATCTCCAA TTGTATAAAT GGCACCATAG CTGTATGTTC
CATGGAACAC TACTTCCCAG AGATGCCCAG TGAAAAAGA ATGCCACAGT CAAATAAGTT TGGAAACACT
CCATTATGTG GCCACCTCCT TGAAGACTCT AATGCACATT AGCATGTTAA ACAGTCTTGA GAAGTCCTGC
```

```
AGAGCAGAAA TTGCTTCACA TCTGCTAAGC CGGCAGTTTC CCAATATACT TGATTATGGA TAGTTTTTTC
CTTACAACAC CATTCTCTGA TATGCTTCCA ATGACATGAA ATAAATATAT ATGCATGAGG TTCTTCATTA
GGGCATACTT TTTAATAGAA AATATTGAGA ATAATCTAAA TATAAATGCA CAGCATTTAC CTTTTCTGCA
TAAACTATAT ACAGGCATAC CTTGGAGATA CTATGGGTTT GGTTCCCACA ATATCTCCAA AACCACATTC
GGTTTTATGA CCACTGCCAT AAAACCAGCC ACATGAATTT TTTGGTTTCC CAATGTATAT CAAAGTTACA
TTTTTACTAT ACCATAGTCT ATTATATATA CAATAGCATT ATATCTAAAA AACAACGTAA ACACCTTAAT
TTAAGGCTGT GGCTGGTTTG ATTTTCTACC CAGACCACTA AAACTTTCTT CATATCAGCA ATAAGGCTGT
TTCACTTTCT TACTATTTTT TGTGATAGCA CTTTTCCTTT CCTTCAAGAA TTTTTCCTTT CTATTCACAA
TTTGTTTGAT ACAAGAGGAC TAGATTTTAG CTTATCTCAG TTTAAGGTGT TTACATTGTT AGCTAAAAAT
GCTAATGATC ATCTGAGACT TCAGCAAGTC ATAATCTTTT GCTGGTGGAA GGTCTTGCCT CAGTGTTGAT
GTCTGCTGAC TGGGTGGCTT TGGCAATTTC TTAAAGTAAG ACAACAATCA AGTTTGACAT ATCAATTGAC
CCTTCCTGTC ATAAATGATT TTTTTTTTCT CTGTAGCCTG CAATGCTCTT TGATAGCATT TTACCCACAG
TAGAATTTTC AAAATTGGAG TCAATCCTTT CAAACTCTGG TGCTGTTTTA TCAACTAAGT TTATGGAGTA
TTAGAAATCC CTTGTTGTCA TTTCAACAAT GTTCACACCA TCTTCCCCAG GAGTATATTC TACCTCAAGA
AACCACTTTC TTTGCTCATC TATAAGAAGC AGCTCCTCAT CCACTAAAGT TTTATCCTGA GATTGCAACA
ATTCAGTTAC ATCTTCAGGC TCTACTTCTA ATTCTAGTTC TCTTGCTGTT TCTATCTCAT TTGTGCTTAC
TTTCTCCGCT GAAGTCTTGA ACCCCTTAAA GTCACTCATG AGGGTTGGAA TCAACTTCTT ACAAACTCCT
GTTGATGTTG ATATTTTGAC CTGCTCCCAT GATTCATGGG TATTCTTAAT GGCATCTAGA ATGGTGAACG
TTTTCAGAAG GTTTTCAGTT GGCTTTGCCC GGATCCATCA GACGAATCCC TATCTATGGA AGCTATAGAT
TTATAAAATG TATTTCTTTT TTTGTGGGGG CATAGCGTCT CACCCTGTCA CCCAACCTGG AATGCAGTGG
CACAGTCATA ACTCACTGAA GACTCAAACT CCTGGGCTCA AGTGATTCTT CCACCTTGGC CTCCCAAAAC
ACTGGATTAC AAGCTTGAGC CACTGTGTCT AGCCCAAAAT GTATATCATA ACTAATGAGG CTTGAAAGTC
AAAGTGACTC CTTGATCCAT GGGCTACAGA ATGGACGCTG GGTTACCAGA CATGAAAACA ATACTCATCT
CCTCATACAT CTCCTTCAGA GCTCCTGGGT GAGCAGGCCC ATTGTCAAAT GAGCAGTAGT ATCTTGAAAG
AAATTTTTTT TCTGAGCAGT AGATCTCCAC AGTGGACTTA AAATAGTCAG TAAACTATGC TGTAAACAGA
AGTGCTGTCA TCCAAGCTCT GTTTTTCCAC TGATAGGGCA AAAGCAGAGT AGATTTGGCA TAATTCTCTA
GGGCCTTAGG ATTTTTGGAA TGGCAAATTG AGCATTGGCT TCAACTTTTT TTTTTTTTTT TTTTTTTGAG
ACAGAGTCTT GGTCTGTCAC CCAGGCTGGA GTGCAGTGGT GCAATCTCGG CCCACTGCAA GCTCTGCCTC
CTAGGTTCAC ACCATTCTCC TGCCTCTGCC TCCTGAGTAG CTGGGACTAC AGGCACCCGC CACCATGCCC
GGCTAATTTT TTGTATTTTA GTACAGACGG GGTTTCGCCA TGTTAGCCAG GATGGTCTCG ATCTCCTGAC
CTCGTGATCC ACCCGCCTCG GCCTCCCAAA GTGCTGGGAT TACAGGCGTG AGCCACAGCG CCCAGCCTGT
CTTCAACTTA AAGTCGCCAG CTGTGTTAGC CTCTAATAAG AGAGTCTGCC TGTCCTTTCA AGCTTTGAAG
CCAGGCATCA TTCTCTTCTC TAGCTATGAA AATCTTAGAT AGCATCTTCT CCCAATAGGA AGCCATTTTT
TATGCCCTAA AAATCTGTCG TTTGGTGTAG CCACCTTCAT CATTGATCTT ACCTAGATCC GCTGGATAAC
TTACCACAGT GTCTACATCA TTACTTCTGC TTCACCTTGC ACTTTATGT TATGGGGATG GCTCCTTTCC
TCTAACCTCA TAAACTAACC TCCACTAGCC TCACATTCTT CTTTTACAGC TTCCTCGCCT CTCTCAGAGT
TCACAGAATT GAAGAATGTT GGGCCTTGGA TTACACTTTG GTTTAAGGGA ATGCTGTGGC TGGTTTGATT
TTCTATCCAG AACACTAAAA CTTTCTTCAT ATCAGCAATA AGACTGTTTC ACTTCTTAC TATTTTTTGT
GATAGCACTT TTCCTTTCCT TCAAGAATTT TTCCTTTCTA TTCACAATTT GACCGTTTGA TATGAGAGGC
```

```
CTAGATTTTA GCCAATCTCA GTTTACACCA TGCCTTTTTC ACTAAGCTTC ATCATTTTAG CTTTTTATTT
AAAGTAAGAT GTGTGACCCT TCCTTTCATT TGAACACTTA CATGATGATG CCTGGCTTCA AAGCTTGAAA
GGACAGGCAG ACTCTCTTAT TAGGGGCTAA CACAGCTGGC GACTTTTAAG TTGAAGCCAA TGCTCAATTT
GCCATTAGAA GCCATTGTAG GGTTAATTAA TTTGCCTAAT TTTAATATTA TGGTGTCTCA GGGAATAAGG
AGGCCTGAGT AGAGGGAGGG AGATGGGAA ACAGCCAGTC ATCAGAGCAC ACACAACATT TATCAATTAA
GTTTATCACC TTGAGGGCAC AGGTCATGAT ACTTCAAAAC AATTACAATA ATAAAATAAA AAATCATTGA
TCGCAGATCA CCATAACAGA TATAATGATA ATGAAAAATT TGAAGTATTG TGAGAATTAC AAAACGTGA
CACACAGACA CAAAGTGAGC ACATGTCATT GGAAAAGTGG TGCTGATAGA CTTACTTCAT GCAGGGTTGC
CACAAATACT CAATCTGTAA AAAATTCAAT TATCTACATA GTACCATAAA AACAAGGTAT ACCTGTTTAT
ATAATCAAGA CCAACAGAAC CCTAGAGAAA ATAGCTCACT CCCTAGCTCG AGACATTCT AACCAACATA
CACTTACCTT TCTTTTTGCT GTGTACAGAA TTCAAATCCC TGTCTCAGCA AAATTGCAAA GTATCAAATG
TCATGTCCAT CTAATACTCA AAACTGCAAA TGTTAAGTCT TGTAAGCCCA GAGACCACTG TATATACAAG
TGTTGCTATA AGCATTAGTT CTTCTCCAAA GAAATAGTC CACTTGGTAG AAACAAACAA AAAGAAAAAA
AAAGAAAGAA AAAACATTTT TTACAAGAAG ATTCAGTCTC TTACCTACAT AAGCAAAAAT ATGAGATGTT
CTCTTATCAT TTTTCCATCT ATCTTATAAT CTTTGGTGCT GACTTAGACA CTCATTTCC TTTTTGTACG
TGACCATGTA AAAGTTCAAG TCAAGAAAAA CTTGTTTGA CATTTGTTTT GCTGAGTGAT GGGTCCCTAA
AAGAAATTTG GCTTTGCTTT TGAAAAGTTC AGCATGATAT TGTGTGAATT TTTCATGGCT AATGATTTTT
AGAACAGTTG TGATGTGTTT AGGTGTTTTA AGAATATGAA GCATTCAGTG GTTTAAGTTG GTTGTTATAA
AATGAAAGAA TATGAAGGAA AGCCTTCTTG TCTTAGAACA CACTGATTCA CAAATAAGCA GCTTCTCTCA
AAATGTTGTA ATTACAAAAA TTCCAAGGCA AATATAATAA ACTCCTTGTC GGTGCTATGT CTAGAAACTT
AACAGCCCCA AAGAAAGTCC TGACAAGGCA AAAATATAT ATATATATAC AAATTGTGGA AGCAGGGTGT
TGAAAGAAGA ATAAAGACTA TATAAGGACA AACTGTTTAA AAGGGAGGGT ATCCTTGAAA GCTTGACACT
TGACTCTTTT GACGAGGCTG AGGGAAAACA CTCAGTTTCA TAGATTGCTG GTACGGATGT AAAATAGTGA
CATCCCTATA GAGAGGAATT TGGCAATATC TAGCAAAAGT GCTTATGCAT TTATTCTTTG ACCTAGTAAT
CCCGCTTCTA GGATTAGTGG TGAAGATACA CCTCAACAAT AAAATATAT ATACATTAGG TTATTAGTTA
TGGTTTAATT TTTAATAGCA AAATATTTAA AACAACCTAC ATGAACAAAT AGGAGACTTA CTGAATAAAC
TATGGTATAT CTGTACAATA AAGTGCAATT CACTTATGTT GTTAATTTGT TCCAAAAATC CAGAGCCAAA
GAGTATTTGT TATGCTCTCT TTAGTATAAG AAAGGGGAAA TAAGATATGT GTGCATCTGT TTATTTTTGT
GAAAATAAGT ACAGAAAGGA TAAGTAAGAA ACTAGTAAAA CTAGTTATCT CCTAGTGTTA GTAGAAATAG
AATGAAAGTG AATTAGGCTT CTTTGAGTAT ATGTTTATAT ATAGTTTTGA CTTTTGAATT ATGTTTATGT
TTACATAGTC AAAATATAA ATTAATCAAC AGAAATAACA AAAAAGAAG AAATCACAAG CTTTAAAATT
TAATACAAAC AGAAATAATT GAATCTAACA GTATATCAAA GTGATAACGT AAACTCAGAA GAAAAAAACA
TAATCCAACA TACCAGTGGA ACACAATATT CTAACTGTAT ACATTCAGTG GTTATAGTCT AAGGACAAGA
AAAATTGCAA AAATATCTTG AACTTTAGCT TGTAGGATTT TTATTGGTAG CAATACTAAT GTACTAATTC
TGAAATTAAT GTTCGTGTAT TATAGAATTG AGTAAATGAA TAAATATGTT GATGTTATTG GGAACTAAAA
TTATCATTCT GGGAGTAGAG AAATATAAAT ATGGACTTGG CAAATGAAAC AAAGACCTGC AGAGAGATAA
CCATATAAAC TCATTATTTT AAAAATTATA AGTGTCCTAG CTCTGTTACT GAAAAGGCCT AGATTCAATC
TTATCTTGAT AGACAGGAGG GCACCCCTTT CTCAGAACAT GGTTTCCAAA TGCCATTCTC CATTAAAAGG
AACAAGGTCT TCTTGGAGAA AAGACTGATT CTAGGTCTGG ATTAGGTAAA GTACAACGTT AGTCTGGAAT
TTCTTGCTGA ATCAGAAGTA AGAAAGTGCT CAAAAACATG GGAACATGTC ACAAACACAC GTGAGGCAAC
```

```
TTGAATCCTC ACTGGCCATA TTTAGGACAA TCGAGCATCA AAAAAAAAAA AAATGTTGAG AATAATGGAT

TCTAACACTT AAAACAAAAA ATAATCCATA GCCCACAGAA GGGGAAGAGA GGGGGAGCTC TTATTTACAG

ATGAATATCA AATAGCAAAG ACAGAAGAAA TGACAGAATT AGAGAAACAT CATTTTGCAA AACACCACTG

TAATAATCAA TTCAGGCAAG TATTATTAAT GGATGTATTA CTATTGCGTA AAACCAGTTG GGGAACAGGA

TATTCATACA GTCTGAAGGT GTCACCCTAA ACATAACTTA TTACAAGTGG AAAATGGTGC CTTTACAATG

AAGAAATCTA GCAGAAACCA TCTTAATCTA GTGATCAAAC TTAGTATCAC AATAATGGA TCATACTGAG

TCATGTGTCT CCTAATATGA TGCACCAGGA AGGATGCAAC GTCATGAACG TTGTATTCTT TTGTATTCAA

CAGACCACCC AGGGTAAAGG CAGCTTTCTC ACTTACTAAT CAGAATTGTT GGTTTTAATT CATTTTGGAT

TTTAAGATTT CTTACTTTCT TGTCAGCTCA GAAATTTATT TAAGATGATT TTTATCTTTT ATTCAATACT

TTAGCTTGGA GAACCATTCA GAGTTTCTAA CTCATTGTAT TGCCAAAAAT AGAAACAGC ATGGTTTCTT

TTGAAAATGT CTAACTTTAA AGTTACTTGT GTGTGTCACT CAGATTCACA TAGCTTTTTT GCCTAGTAAT

GTAGTATCAT GTGGCAAGGC TATAAAAATG TTTACAATCT TTTATTTAAT ATGACTCTTG AGAGTTTATT

CTAAGGAAAT AATTGAATAG TAACAAAACA CTATTAACAC AAAGCATAGC AATTTGATTT GGGCAACCAA

ACACTGGAAA CAACCTAAAT GTCCATTACA GGAATCATTT ATGAAGCAAA CACTAAAATA TTTATTGTGA

AGATTATGAG AACATAGAAG ACAGTTATGA GAGTAAATTT GAAAACCTGA ACACAAAACT TACATATACT

CCAATTGTAA CTTATAAAAA ATACGTGCAT ATAAGGATAA AACAGTACAA ACAAAAAAAT AGTTGCGTTA

GATTGGTAGA ATTATGGCTC CTTTTGCTGT CTTAATTTTT TCCTTTTACA TTTTGATACA TTATTTTAAT

TTTAATTTTA AAATTCAAAA GAATTTGCCA CTCATCTTTG CCACTTCAAG GAAAAAGAA ATGTGTTCGA

TTATTCTGTT CTTAGTATAG TTTTGGCAAT TTCCTCACGT GTAAAAGAG AATACTATTA ATAATTTCAG

TATCTATAAG ACAATATAAA ATTAAAGAAT CTAGCCCAGT AACTGGTACA TGGAACGTAA TTAATAAATC

ATTATGGACT TTTTTTCTCA CACCCAAGTA GGGAGGAATC AGTGGTCCCC TAGAGGCCCA GTGTAGAGGT

GGCAGCACCA ATCCCTAGGG GAGAAGATCT TGGTGATGAT AATTCCTGAG CAGACAGTTA GCTGAGAATT

CAAGAGGAGA AAAGTAAGAA AGAAACAACT TCTTGCTAAC ACCTTTCCAC CCACGTTTCC CTGTTCTGTT

GTACTCTGCT TACCCTTTCA TGGATGGAGG CAGAGGAAAG AGAACCAAGT TTGCTCTTAG TCATTCACTA

TGTTGTTTAA TCTGCCTTCC ATCTTTCTTA TCAGTTCAAA TTAGAATGTA GACCTGAATT TAAATCCCCG

TTCTGTCAGT TATAATGTGA CCCTAGACAA AACACATTCT CTGAACCTCA GAGAACATTC TTCATTTGTA

GAATGGGAAG ATTAATCTAT ATTCCACTTG GATGGCAAGT CTTTTATAAA CTTTATAACC TAAACATGTG

TGAGTTGCTA GTATCATTAT GTTGGTAAAG TTATTCTGAG ATATGATAAC AGAACTGTTT TGTCTAACTC

CACTAGCATG GTTCAGGTTT AGAGAGTGTG GAATTAAAAG GCTTTATCCT CAAATATGAC TTAAATCCGA

TTTTTCTCAT CCACTTTCCT CCACAAACAA ATCCTCAGGA AATGACAAAC TTTACATGGT TAAACATCAG

TTTTGTTTAG TCTTTGACAT CCACATGGTT AAATCATACA TTTGAAAACT GCTTATATTT GTGTTGTCTA

TGTCTAAATT GAAAAGACTT ATTGAGGAAT AGAAGACTAC ACATTTTTCA GCAAACACTG CACGTTTTGC

AGAATTTCCC CAGGCACCAG TCTCCAGGAA TTTATTGGCT ACTAACAATA CTAAGATATG GATGAATGAG

GAAATCAAAA TGGAGATCTT GCAAGTTTTG TGAGAATGGG TGAATGGTCC AAATGAAGAG ATAAGTTGTG

AAATATTAGT ACAAGTAAAA ATTATTTACA ATGAAAGACA TTTTGTCAAT AGCTATGAGA ATTTTACCAT

TGACCCAGAA ATTCCATTTC TTTCTTCAGA AATACCCACG TAGGTATACA TATAAAAAGT TATTCATTAC

AGTATCGTTT TTCATAGGAA AAAGTTTTAA AAATCAGAAG CTATCTAAAC TATGGTATAT CTAGGTCATA

GAAATCAAAT GACTAAAAAT GTTAATATAA GCATATGTTT TTAAATTAAC TTGGCTTGGG TCTTCAGCAA

AATTGGCTTC TTAACATTGC ACTCCAGAGT TAGACTTACC CACTCAGTCA CTTATCATGC AGGAGCAGAC
```

```
TCCTAATACC ACATATCATA GAGCAGAGTA GGACACAGGT TCTCTGCAGG CAGGCAAATC CCAAAGAGAA

GGGAGGAAAG GGCTGAGACA CTGCATGGTC AATTTCTTCT GAACTCTGCA ATGTACGGAG GTGGACAGTG

TCCACAAAGA TTGCTCCCCT GGACCCACCA TCATAATAAC ACAACGGCTT TGTTTTGTTT TTGTTTTTGT

TTTTTGACAC GGAGTTTTGC TCTTGTTGTC CAGGCTGGAG TGCAATGGTG TGATCTCGAC TCACCACAAC

CTCCACTTCC TGGGTTCAAG TGATTCTCCT GCCTCAGCCT CCTGAGTGGA TGGGATTACA GGCATGCACC

ACCATGCCCA GCTAATTTTG TATTTTTAGT AGAGACGAGG TTTCTCCACG TTGGCCAGGC TGGTCTCAAA

CTCTTAACCT CAGGTGATCC ACCCGTCTTG GCCTCCCAAA GTGCTGCGAT TACAGGTGTG AGCCACCGCG

CCCAGCCCAC AATGGCCTTT TGTTTACATC TCTAGTGCAG CACTCATTTC ATGTTCTTTC AAGAAGAATA

CATATTTCAT CTTTTTATTT TATACAGCAA TTAGCACAGT GCCTGGCATA AGGAAAATGA TCATTAAAAG

CTGGGTGAAA AACCTAATAA AGCTACTGAG GATAGGAACT GCAGACCAGC ATGGAAAGAA AACTATGAGC

CAGATATTGA CATCATCCTG AAAGGCAGAA GATTTAGTAT AGGCAAGAAG TATGCTTTTG GAATATAGAA

AATCTGGATT ATGATAAGAA AAGAATCATA TTTGTCTTAT CTTACCTACT CACTTCTCAG TTCCACATGT

TTCTGAGGCT GTTTGTCCTT ACTTTCTTTT CTGTTTTATC CACTCTTTCT GTTCTTTAGA TTGGATCATT

CCTATTGAGC TGACATCAAG TTAACTGACC TTTTATTTTG TCCAAACTGC TGTTAAATGC ATCCAGTGAA

TTTTTAACTT TATATAGTAT ATCTTTTAGT CCTAGAATTT CCACATGAGT TTTTTAAGTT TCCATTTCTC

TGCTGAGATC TCCTATTTGT TCATTCATTA TGACCTATAT TTTCTCTACA TTATTGAGCA TAATTATAAC

AGCTCTTCTA AAATTCTTGT CTGCACATTC TAACACCTGA ATTATTCTGG GGTCAGTCTC TGTTACATTG

CCTTATTACA AAAACAGTAT AAGTCACATT GCCTTGTTTC TTAATATGCA AAATGATTTT TGATTGCAGA

CTAGACATTT TGAATTAAAC ATTATAGAGA TTCTGGATTC TCGAGAGAGT ATTGACTTGT TTTTTCCATC

AGGCAGGTAA CTTGACTGGA CTCAAACTCC AAACTCTAGG TCCTCTGTAA TGGGCAACTG CAGTAATCTT

TGTTTAGTTC TTTAAGACTT ATTGGCCAGG CACGGGGCT CATGCCTGCA ATCCCAGCAC TGTGGGAGGC

CAAGGTGGGA GGATCACCTG AGGTCAGGAG TTCGAGACCA GCCTGGCCCA CATGGTGAAA CCCTGCCTCT

ACTAAAAATA CAAAAATTAG CCGGGTGTGG TGGTGGGCGC CTGTAGTCCC AGCTACTCAG AAGGCTAAGG

CAGAAGATTC ACTTGAACCT GGAAGGCAGA GGTTGCAGTG AGCCGAGATT GTGCCACTAT ACTCCAGCCT

GGGTGACAAA AGCGAGACTC CCTCTCAAAA AAAAATTTAT TGGCACTGCT TGGCATCTGC TATGAATACA

TGAAGTTCAT GGGTCAGCTA TAGATCTGGG CACGTTATAC ACAGAATTTG GTCTCCCTT TCTCTGGATT

TCTCCTTTTC TGGATTTCTT TTCTCATTTT CCAGCAGCTG TGGTTGCCCT AAACTCGGTC CTCTGTTTCT

TTACGGCAGT AAGATTTGGG AACTTTTAGG TTTTACCTGC CTCTCAGACA AAATAAAAAA TAATTTTCAT

CTTGATGCTA CTCCTTTCTT CCAGATGTAG ACACCTCTCT AATTTCCAGT TGCTTTTTAT TGCTCTCCAG

AGTCTAAAGA TTATCATTGT TTTCTGTGGG AGAGTTGGTC TGATAAAAAC TACTCCCCCA AAACTGGAAG

CTGGAAGCTT GTAATTATGA ATAGACTTTG AGTAGTATTC TTCTTTGGAA AAGGATTTTA ACTACTCCCT

ATGTACTTCT TTATTTCCTG TTTTTCTCAT CCGTAATCTT TTTATTTTCA TACTTCCTAA GTCAGACAAT

TTTCCTACTT GAAGATTCAG TGACTGCTAT CAAATGACCC CCATATTACT AAATACAATA TCCCCAACTG

CATTTATAAA AAGAAAATTT ACTGTTTATT AGTAAACAAT GTTGTAGAAT AGTAAAATAT TGCTGGGCTT

TGGAGCCAGA TAATCAAGGT TAGAATCCCA GATTCTAACT TACTAGCTGG TGTATTAGTC CTTTCTCATG

CTGCTAATAA AGACATACCC CAGACTGGGA GACTGGGTAA TTTATGAAGA AAAGAGGTTT AATTGACTCA

CAGTTCAGCA TGGCTGGGGA GGCCTTAGGA AACTTACAGT CATGGTGGCA GCAAGGAGAA GTTCCAAGCA

AAGAGGGAAA AGCCCCTTAT AAAACCATCT GATCTTATGA GAACTCACTC ACTATCACGA GAACAGCATG

AGGGTAACTG CCCTCACGTT TAATTACCTT CCACCAGTTC CCCCCATGA CACATGGGGA TTATGAAAGC

TATAATTCAA GATGAGATTT GGGTGGAGAA ATAGCCAAAC CATATAATTC CACCCCTGGC CCCTCTCAAA
```

-continued

```
TCTCATGTCC TCACATTTCA AAACTCAATC ATGCCCTCCC AACTGTCCCC CAAGGTCTTA ACTCATTCCA

GCATTAAGTC AAAAATCCAA GTTCAAAGTC TCATCTGAGA CAAGGCAAGT CCCTTCTGCC TATGAGCCTA

TAAAATCAAA AGCATGTTAG TTACTTCCTA GATACAGTGG GGGTACAGGC GTTGGGTAAA TACACTGATT

CCAAATGGGA GAAATTGCCA AAACAAAAGA GTTACAGACC CCATGCAAGT CCAAAACCCA ATAGGGCAGT

CATTAACATT AAAGTTCCAA AATGATCTCC TTTGACTTCA TGTCTCACAT CCAGGTCACA CTGATGCAAG

AGGTGGGCTT CCAATGGCCT TGGGCAGCTC TGCCCCTGTG GCTTTGCAGG GTATAGCCTG CTTCCTGTTT

GCTTTTTCAC AGGCTGACAT TGAGTGTCTG TGGCTTTTCC ATGAGTATGG TGCAAGCTGT TGGTGGATTT

ACCATTCTGG GGTCTGGGCC AGGTGCAGTG GCTCATGCCT GTAATCCCAG CACTTTGGGA GGCTGAGGTG

GGGGATCACA AGGTCAGGAG ATCGAGACCA TCCTGGCTAA CACGGTAAAA CCCAGTCTCT GCTTAAAAAA

TACAAAAAAT TAGCCAGGCG TGGTGGTGGG TGCCTGTAGT CCCAGATACT TGGGAGGCTG AGGCAGGAGA

ATGGCGTGAA CCCAGGAGGT GGAGCTTGCA GCGAGCTGAG ATTGTGCCAC TGCACTCCAG CCTGGGCGAC

AGAGCAAGAC TCCATCAAAA AAAAAAACAA AAAAACCATT CTGGGGTCTG GAGAATGGTA GCCCTTACAG

CACCACCAGG CAGTGCCCCA GTGGGGACTC TGTGTGGGGG CTCTGACCCC ACATTTCCCT TCTGCACGGC

CCTAGTAGAG GTTCTCCATG AGGGTTCTAC CCCTGCAGCA AACTTCTGCC TGGACATCCA GGCATTTCCA

TACATCCTCG GAAATCTAAG CCGCGGAGGT TCCCAAACTT CAATTCTTGA CTCCTGTGCA CCCACAGGCT

CAATACCACA TGTAAGCCAC CAATGCTTGG TCAGGGCTTG AACCCTCTGA AGCAATGGCC TGAGCTGTAC

GTTGACACCT TTTAGCCTAG ACATCTAGGA CACAGGCAC CATGACCCGA AGCTTCATAA AGTGGGAGGG

CCTTGGGACT AGCTGAGGAA ACCATTTTTC CATCCTAGGC CTCCAGGCCT GTGATGGGAA GGGCAGCCAT

GAAGGTGCCT GACATGCCCT GGAGACGTTT TCCCCATTGT CTTGGTAACT AACATTCAGC TCCGTGTGCA

GCACCAACTT ACTTATGCAA ATTTCTGTCA CTGGTTTGAA TTTCTCCCCA GAAAACAGGA TTTTTCTTTT

CTATTGCATC ATCATGCTGC AAATTTTCAA ACTTTTATGC TATGCTTCCT GTTGAAGACT TGCGGCTTA

GAAATTTCTT CCCCCAGATA CCCAAAATTA TCTCTCTCAA GTTCAAAGTT CCACAGATAT CTAGGGGACA

AAATGTTGCC AGTCTCTTTG CATAGCAAGA GTGACCTTTA CTCCAGTTCC AACAAGTTT CTCATCTCCA

TATGAGACCA TCTCAGCTTG GACTTAGTTG TCCATGTTAC TATCAACATT TTGGTCAAAG CCATTCAACA

AGTCTCTATG AAGTTTCAAA CTTCCCCATG TTTTCCTGTC TTCTAATAGC CCTCCAAATT TTTCCAACCT

CTGTCTGTTA CCCAGTTCTA AAGTCACTTC TACATTTTTG GGTATCTTTA CAGCAGTGGC ACTCCCCATG

GTACTAATTT ACTGTATTAG TCTGTTCTCA TGCTGCTAAT AAAGACTTAC TCGAGACTGG GTAATTTATA

AAGAACAGAG GTTCAACTGG CTCACAGTTC AGCATGGCTG GGAGGCCTCA GGAAACTTAC AAACATGGTG

GCAGCAAAGA GAAGTTCCAA GCAAAGAGGG AAAAGCCCCT TATAAAACCA TCAGATCTTG TGAGAATTCA

CTATCATGAA AATAGCATGA GGGTAACTGC CCCCATGATT AATTTACCTC CCACAGGGTC CCTCCCATGA

CAGGTGGGA TTATGGGAAC TACAATTCAA GATGAGATTT GGGTGGGGAC ACAGCCATAC CATGCCAGCT

AGAGAGCCTT AAGAAAGTCA CCTAATCTCC ACAAATAAAA GGTTTCCTAT TTGTTCAACA AAAATAATGA

CACCCCTTTT ATGGGATTTC TGTGAGGACA AATGATAACT AACATAGCCT TGCATAGTGT CTGGCACAAA

ATAGCTACTC AAAAAATAAT AGAAACAACA TTTAAAAAAT GTAGACTTTA TTTTTTAGAG TTTTATGTAC

AAAGCAAAAT TGAGCAGAAT GTACAGAGAG TTTCCGTATA GCACTCCCTA CCCCCAAGCA CAGATAGCCT

CCCCCAGTAT CAGCATCCCG CACCAGAGTG GTACATTTAT TATAACTGAT GAATCTATAT TGACGTGTCA

TTTTCATCCA AAATCCATAG TTTATATTAG GGATGCCTCT TGGTGTTGTA CCTTCTATGG GTTTTGACAA

ATGTATAATG ACATGTATTC ACCATTACAG TATCATAAAG AATAGTTTCA CTGTCCTAAA AATCTTTGAT

CTTCTTCCTA TTCATCACTC CCTCCCCATT AATCCCTGAC AACTACTGCT AATTTTCCTG TCTCCATTGT
```

-continued

```
TTTGTCTTTT CCTGAATGTC ATATAGTTTA AATATACAGT ATGTAGGATT TCAAACTGG TTTATTTCAC
TTAGTAATAT GCATTTGATG TTCTTCCATA TCTTTTCAAA GCTTCATAGT TCAATATTTA TAGAATTGAA
TAATATTCCA TTGTCTGGAT GTACTACAGT TTATGTATTC ATTCACCTAT CAAAGAACAC CTTGGTTGCT
TCCAAGTTTC AACAATCATG AGTAAAGCTG CTATAAACAT CTATGTACAT GTTTTTTGT GAATTGAACA
TTTTCAGCTT TTTTAGCTCC ATTCCTAGGA GTGCAATTGC TGGATTGTAT GATAAGGGTA TGTTTAGTGT
TGTAAGAAAC TGCCACGCTC TTCCTAACTG GATGTACTGT TTTGCATTCT CACCAGCAAT GAAAGAGTTC
CTGTTGCTCC ACATACTCAC CAGCATTTGG TGTCGTCAAT GTTTTGAGCA ATAGCATTTT GATCTAACTT
TTCCTAGGTA TTCTTTTTGA AGGAAATAAT ATGACAGATA ATAGAGAAAG GATATACGAG GACAGTTCTG
TCCTTTATTT ATAGTCCATC ATTTAATGAA GGACTCTGTC CACACTTGGT ATTTTTAACT CTGATCCTCC
TCTCCCATGA ACTCTGACAA TCTCCTAAAT CCCTGTTGCT GGCACACATG GTTGTGTATC AGGCCCCCTG
TGGTCTGTCT GAAGCATGGC TTTTTTTTTT TTTTTTTTTT TTTTTTTGAG ACGGAGTCTC GCTCTGTCGC
CCAGGCTGGA GTGCAGTGGC GCGATCTCGG CTCACTGCAA GCTCCGCCTC CCGGGTTCAC GCCATTCTCC
TGCCTCAGCC TCCCGAGTAG CTGGGACTAC AGGCGCCCGC CACCACGCCT GGCTAATTTT TTGTATTTTT
AGTAGAGGCG GGGTTTCACT GTGTTAGCCA GGATGGTCTC GATCTCCTGA CCTTGTGATC CGCCCGCCTC
TGCCTCCCAA AGTGCTGGGA TTACAGGCGT GAGCCACCGC GCCCGGCCTT TTTTTTTTTT TTTTTTTTT
TTTGAGATGG AGTCTGTCAC TCTGTCACCC AGGCTGGTGC AGTGATGCAA TCTTGGCTCA CTACAACCTC
CATCTTTCAG GTTCAAGTGA TTCTGCCACC TCAGCCTCCC AAGTACCTGG GATTACAGGT GCCCGCCACC
ACACCCAGCT ATTTTTTTGT ATTTTTAGTA GAGACGTAGT TTCACCATGT TGGCCAGGCT GGTCTCATTC
CTGACCTTGA GTGATCCACC TGCCTTGGCC TCCCAAAGTG CTGGGATTAC AGGCATGGGT CATCACATGT
GGCCTGAAGC ATGACTGTTG CTTTAATCAT ATGAAATACT GCTCTGTATT GTTATCTATT TGAAATGCCA
CACCTCCTGA GCTAAATTGC AAGCTTTTAT GGAGCACAAA CCATATTTAT ATATATTAGC ATGATACCAT
GACACATATC AAAAGCTGTT ATATATTGTT ACGTGAATTG ATTCTTTCTC AGTTAAGAGG ACCTCTGTAG
TAGCACTTTC ATACCGTTAA TTTTTCATTT TGTGCCCAGC CCCTACTCTG TGAAAAATGA AATGAATCCT
GTTATCATTT CCCTCCCAGG CCTTTTCTCC TTGTGGACAA TGTGTGGCTC AAGAGAAAAT TCAGTCAGTA
AATTTGTTCA GTGCACAAAC TCTTTATCAC CTCTCACTGT TCTCAAGTGA GATAGAACAG AACATCCATC
CAGTGTCTTA CAAATTGTCT GGTATATAGT AGGCACTCAA TAAATGTTTT TTGAATAAAT GCATACATGA
ATCCTATTCC TATATATAGT ATGGTAGACA GATCATTGAT ACCCAAAGAT GCCCAAATGC TGATCCCCAG
AACTTGTGAA TATGTTACAT TTCATGTCAA AAGGGACTTT GCTAATGTGA TTAAGGATTC AGACCCTTGG
ATTGTAAGAT TATCCCGGAT TAACCAGGGC CAATCTAATC ACATGAGACC TTAAAAAGC AGAAAACATT
TCCCAGCTGG GTTAGAGAGA GATGAGACAG AGTAAAAAGG AAAGAGATTC AGGGCATGAA AATGACTCTA
CCCACTGTTG CTGGCTTTGA AGATAGAGGA ACTAGGCCAC AAAACAAGGA GTATGAGTGG CCTTAAGAAA
TAGGAAAAAG CCCTCATCTG ACAGCCAGCT AGAAAGCAGT CCTCTGACCA CAAGAAATTG CATTCTGCCA
ACCACTCAAA TGAGCAAGGA AATGGATTCT CCCCTAGAAC CTCCAGAAAG GAACACAGCT CTGTAATGCC
TTGATTTTAG CCAGGTGAGA CCTGTTTCAG ACTTTTGACC TATGGAAATA TAAGATAATA AAGTTTTATT
GTATGCTGCT AAATTTGCGG TAGTTTATTA CTGAAGCAAT GGAAAGCCAA TACAGACAGA ATATACAGAG
AGAAAGAGAA TGAGTTCTTT CCTGATAATT TGTAAATATT TGGGTCTTCA CTGGACAAGC TTCACAGAGG
ATTCACTGGT TCCCTAGCAA ACCAGCATGT CCAGTCCTGC AGCCTCCCTT TCTTAGGCCC AGCATATGTC
AGCTGTGTGC ATAGAAAAAT CAAAGCAGGA CCCTGAGTAG TTGGAAAGAA AGATGGTTG GAAATGGGTT
GCACTTCAAG TGAGGAAACA AGAGGTAGGA GACCGGCATC TCTTTCTCAT ATGTCCCAGG CTGACTCTTG
TGAGTTGTTT TCCCTTGGAG GCTATCGATG ACAGTCACAG TAACCTGATG GAACCTGGAT CATGATGAAA
```

```
GAAGTAAGTG TCAATGGCTC CGACTTCCAA GGACTCTGAT GTCCCACAGC ACTAGCTAAA CAAAGCCAGT

TGGAAATGAG CTTAAATGGG GAATTTCCTG AATATATTCC CTATTGTTAG GAAGCCAGGT TGGCTTCCTT

GCCTACAATT ATGCCAAGCA GTCACACTAT AGAGTCCCTA GGGACATGAT ATTAAGTGAT TCTTTTAACA

CAAACAACTT AATAATCATT TATACTAATA GCAAACGGC CAACGGCTGA TATTCCACTT GAAGTAGAAT

TGGCTATCCA ACTGGAAGAG AAGACAGGAA GACGTGATCT CCAGGGAGCC ACTAAAAGGA TTGGCACCTG

CCTCTGGATT CCCCTTTTCC TTATATTACC TCTCAGCACT GGCAGGCCTT TATTTCAGGA TACAGTTTCA

CAAGTATTAT GTCACGTCTC TGAGAATTAT GTTGGTAGAT ATTTGCTCCT CTGGCCAGAA AGACCTAGTT

TGGAGTCTGG AGTCATGAAG GTGACATACA TGTAGCTAGT GACATAAGTG TAGCTAGTAA AAATAGTGAG

TAATGGCCCT GAAATTCTAT TGAATGCCCA AAGTGCTGAC CAGGAACAAG CATGCTCTAG CTTATCTCAC

AAGGAACTTG ACAATTTTCT TCAAAAATCC TAGTAGCTAA GATTTCTTAG TAACAAAGCC ACTAAGGCAC

AATTATGATT AACTTGACCC TTAGGTGACT TTTAAGGACT ATTCTATAAA ATATTACAAC TAATAGTGGA

TCCAAGCCAG CACACTCTGC TATATAAGAT TAATTGACAG TGTCCACACT GGTAAAATAA GTTGTTTCAT

AAATACATTA GAATTCATTT GCACTTTCTA CACAGCCCCA AGTCCAGAAC TTTCCCCAGA ATAGGTCTAT

GTTTTGCAAT CTGCTACTCC ATACAGAGAT TTGAGTTCAC TTGGCAATTT AGTGCTGCTT ATATGTGACC

AGTTAGTCTG TTTTACTTAT CTATGCCTTA AACATTACTA TACTTACTAA CTCCAAGATG CCTGGTCTCA

ACTTGACAAA AATACCCCAA GTTGGGAAAT CCTTATGTGA ATATGTAGAT AGTCACAATT GCTGGTTGAT

GATGATCTGT CTTTTCCTGT ATTTGAGAAA ATGGAGATAA AATGGACCAA TCCAAATAAT GGATTAAACA

TGGGAATAGG TGAGAGAGAG AGAGGAATAC ATGGTGGCTC TCAGTGTCTG GCTTAGGCAG TAAACACTTT

CGTTAATAAA GACGGAAAAT AAAAAAGGAA TAATTGGTGT CTAGGGGAAA ATAATGAGCT CAAGTTTTAA

CACTCTGAGT TCCCGGATGT GAGACATCCA GGCGCATTTA TCCAAGAGGC AGTTGGAAGC AACGTTCCGG

AGCTTAGGAG AGAGGCATGA CCAAAAGCTG GTGGGACTGT GAAAAGGTAT GGCCATTCTG GAAAACTGTT

TGGCAGTTTC TTAGAAAATT AAACATGTAC TAACAACCCA GCAATTGTAC TCTTGAGCAT TTGTCCCAGA

TAAATGAAAA AAAAAAAAAG CATTTTTTTT ACACAAAAAC ATATACATGA AGTTCATAG AAGTGTTATT

CATAAAAAAC TGGAAAAAAC TGAGATGTCT TTATTGAGTG AATGCTTAGG CAAACGGTGG TCTATCCATA

CAATGGAATT ATGCTTAGCA ATAAAGAGAA AAGAACTATT GATACATGCA ATAACACAGA TGAATCTCAA

AGGAATTAAT GCTGAGTGGG AAAAAAAGCA CATCTCAAAA TGGTATATAC TGTACTATTT TATTTACTTA

ACATTTTAAA AATAGCAAAA TCATAGAGAT GGAGAACAGA TTAATGGGTA CTGTGTTTTG GGATGGGGAG

TGAGAAAAGG GTAAGGTGTA AATATAAAGG GGTAGCACAA AAGAGCCTTG TGGTTGAAGG ATTCTATGTC

TTGGTTGTAG TCGTGATTGC AGGAATCTAC ATGTGATAAA ATTGTATGGG TCTACATACG CATACACACA

AGAGCATATA AAACTGGTGA CATGTGAAGA AGCTCCGCAC ATTGTGCCAA CATCAGTATC CTAGTTTCAA

TATCAGACTA CAGTTATACA AAACATTGTC ATTGAGGGAA ACTGGGTAAA GGGAACACAG GACATTTGGC

ATATATTTTT GCAATTTCCT GTGAATCCGT AATTATTTAA AATAACAGA TATACTACAT ATCAAAAATT

TAATGTCATA AAGTTGATGA GTTTACCTAG TGGATAGCTT TGTTAATATC TGCTATAAGA CTACTGAAAA

TGACAGTTAT GCAAGTATAA GCTCAGAGAA CTTTCCTCCC CCTTCGTAAA TGAAATGAGC AAAAGAAATG

AAACAGGAAA GGCAAGCAGT ACTGAAAACA GGGAAGGGCT CTTCCCCATA TAACTATATC TGCGACTTCA

ACAGCTATTC ATCCAGAAAC ACAGCCTCTT GCGCTAAGAG GAAACTTTGG ATAACAATAT GTTTTCACTC

TCCAAGAGAG AAAATGGATA GATTAATTTT TAAGAAAAAA AAAAAAACCT CACCAATTTC ATGCTGTGGC

TTGCACCTTT AATCCCAGCT ACCTACAAGG CTGAGGTGAG AGGCTTACTT GAGCCCAGGA GTTCAAGGCT

GCAATGAGCT ATGATTGATT GTGCTATCGC ACTCCAACCT GGAGTACTAA GCTAAGAGCT AAGAACACAG
```

-continued

```
CTGAGAGCGG AGAAGAAACA AACAAATCTG ACCAATAACC CCCACTCCCC TCATTTTACT GGAGTGAGCT
GAGACTGCTG GCAAACATGG CCTTTGACCT AGCCTGAACT GTAGCAAAAG TCATCAGATA TTTTTCCACC
AATCAACAGA CAGAAGTGGG GAGAAAACAA TCGTAGTTCA TAACTACAAC AAGCAGATAA ACGAAGGCCA
TGGTGAGGGA TGGAAGACAT TGTGATATAT CAAAGGCAGG CTCATTTAAA ACTCAACCCA AATTCCAAAC
AAAATATATA ATTGAATATG TATTAATGCC AAAGGAGCTT GAGTGAGCTT TAGCACAAAC CCCGCCCTCC
AGCCCCCACC CAAAAAAATC ACTCTGTTCT CTCCCCATTC TTTGATAGGC ATACTTGCTG TTTTCTCACA
GCCAAGGTAC AGAGGGGACT TAGAGGAACT AGAACTCTAA TACACTGCTA GCAGGAATGT AAAATGAAGC
ATCTACTTCA GAAAACCATT TTATCAGTTT CTAGAAAGTT AAACATAGAC CCACCATGCA GCCCAGCCAC
TCTACTCCTA AGTATTTACA CAAGAGAAAT GAAAACGTGT CCCCACACAG TTGTATTTAA AGGTGATGGT
TAGCCTTGTG TGTCAACTTG GCTAGGCTAT AATACCCAGT TACTGAATCA AATAGTAATC TAGGTGCATC
TGTGAAGGTA TTTTGTAGAT GTGGTTAACA GCTACAATCT GTTGACTTCA AGTAAAGGAG ATTGCTCTTG
ATAGTATGGG TGGGCTTCAT CCAATCAATT GAAGGCCTTA AGAGCAAAAA GTAAGGTTTC CCGGAGAGAA
AGAAATTCTG CCTCAAGACT GCAGCCTCAA CTCCTGCCTG AGTTTCCAGT CAGCCAGCCA GCCTAAAGAT
TTGCTAGGCA TTATAATCAC ATCAGCTAAT TTCTTAAAAT AAACCTCTTT ATATATATTG ATACAATGAA
TGGTTATAGC AGCCTTATTT GTAATAGCCA CAAACTGGAA ACAACCTAAA TGTCCTTCAA TAAGTGAATA
CATAAACAAA TTGTGGTATA TCCACAATTT TTACGCAGCA GTAAAAAGGA ATAAATGGTT GAATAAGGAA
TAAACACATA ACAAGGATGA ACCTTAAAAC CGTAAGGCTG AATGGAAAAA GTCAGACAAA ACTAATACAT
ACTGAATAAT TCCATTTATA TTGAAGTTCT AGAAAATGAG GACTAACCTA TAGTAACAAA AGCAGAAAAA
ATTTTGCCCA CTGGTGATGG AGGGGCGCA GGTATTGTAG AGTATCTGAG AAAGGACAAC TGGATAAAAG
GGGGCACAAG AAAACTTTTG AGGGTGATTG ATATGTTCAT TATCTTGTGG CATGGTTTCA TAGGTGCATA
CATATGTCAA AACATCAAGT TATACACTTT TAAAATGTTC AGTTTACTGT ATATCTATTA TACTTCAGTA
GAGAGGAAGG AAGAAAGTGG GCAGGGTGGG GGAGAGGAAA GGAAACGAGG GAGGAAAGGC CCTAATAGGA
AGGATTTTGG AGTTTAGATT TTAAAATGAT AAAGGATGTT TGACACTCTA GGCATATGAC GAATATAGGA
TTATGAGTCC ACAAAAACCA CCAGGAAGTC ATGTATGTTT ATACTTTTAA GTGAAGGATC AGTGGATTAT
CAACTCCCTA ATGCTTTGCC TCTCTATGAC TGGCTGCTGT CCTTCTCATC CCAATACTCC TTCCAAAGCC
CCTTGCTTAA ATGTAAGCCT TCTTTCCTCC TTTCAACACA TCCTGCATTC CGTGACAAAA TAAGTTTTCC
TTAAACAGAA TGTACAGCAT ATTATTTGTA CAATTAAAAA TTTTTGGCCA GGTGTGATGA CTCATGCCTG
TAATCCCAGC AATTTGGGAG GCCGAGATGT GTGGATTACC TGAGGTCAGG AGTTCGAGAC CAGCCTGGCC
AACATGGTGA AACCCTGTCT CTACTAAAAA TACAAAAATT AGCTGAGTGT AGTGTGGCAG GTACCTGTAA
TCCCAGCTAC TCAGGAAGCT GAGGCAGGAG AATCGCTTGA ACCTGGGAGG TGGAGGTTGC TGTGAGCAGA
GATCAGACTA TTGCATTCTA GGCTAGGAGA CAGAGTGAGA CTCGGTCCCC AAAAAAAAAC ACATTTTTTT
TTAATGTTTC CTCCTTGCCT GTAGGAAAAA GGCTCTGACT CCTTAGCCTG GGCATCAGAG CTCTATCTAA
ATGGACTTTA ACCTGATTTT GTGGCACTAA TTCCATTGCA GTACTTGTCC GCTCACTGGC TGTGCCTCT
CTGCCACTAT TTTTGGAATA ATGTCCTCTC TCCATCTTGT TTACTCAACT ATATCCAACC TCTAAGGCTG
TGCTCCTACA AAGCCTCCCC TGGCTACTTC AGCCCACAGA GATATTTAAC TGCTCTGCAG TTCAGGACAT
TCTTCTGACT CTTTAAATCA CATTTACTTA TATATGATCT TGTGATATTT TTGTTGACG TGTTTACTTT
AATTTTCTTC CATAACCTAT TCATTCAACA AACTCAACAA TTATTTATTA AATGCCAAGT TAGAAAAATA
TTATTGATTT TATATAGATT ATAGATATGT TTGAAATTTT ATTTGGCAAT CTGCAAGTAG AAAAATAATT
ATAATGTGGT ATATCTGTGA TAGAAGTATT AGTGCAGAGA CCATGGGAA CATAATCCAG CCTGGAAGTT
CAGGAGAGAT ACGTGGAAGA AAGGACGTCA GAGCCCTTTT CCTACAGGCA TGGAAGAAAC ATTAAAAAAA
```

```
ATTTTTTTTT TTGAGATGGA GTCTCACTCT GTCTCCCAGC CTAGACTGTG GTGGTGCGAT CTCTGCTCAC
TGCAACCTCT GTCTCCCGGG TTCAAGTGAT TCTCCTGCCT CAGCTTCCCA AGTAGCTGGG ATTACAGGTA
CCTGCCACAC ATGGATGATA AATATGATCA TATTTTCTTG TTCTTTTCCT CCTCAGTTGT CTTCCCTGAA
GAAAGGAATG CCTTTTATAG ATGACAAACT CCCATTCTCA AGAACAAGGA TTTTTGACCA ATTTAATTTA
ATCAGATGTC TGGCTTTGAC CTAGAAACAC AGTCACGAAA CTTGGTGATT AGAGACCAAT TCCCAAACAT
GAGCATTTCT TAGGAAACAC AGTAAAGATC TGAGAGACCC AAGAGCAGAA GGGCGAGAAA CCAAAAGCCA
TCAGTTTGCA TAGGAAACAC CTTGTTTAGC CTAATCTTTT TATTTTTATT ACTCTATTAG TCACTACAAC
TATTTTCTGA TTGCTATGGT GATAGATGGT TTAAAACAAG CCTTCATTAA GAATTGTCAC ACCATGGTCT
CAGTCAAAAA CACCAACATT TTTATTGGTA TTGACAATTA TGGGAATATC CAATTCCAAG AAGACAAGGA
GACCTCTGAA CTTTCTAAAT GAAGACTCCA ATCTTCCTGA TCTGATGGGA AGCAGCTTGG CAAGATTACC
AACCACCACC ACAGAGAGTG GACTCTAAGC TAAGACTTAA AAGATAAGTA GAAATTATCC AGGTAAAGAT
GTGTACAGAG AAGGAAGTAC ATCCAGGGGA AAAGAACAAT ACGTGCAAAA GTACGGAAAT GGTAAAAAGT
AATACTACAT AGTCAAAGCC AAGCAGAGTT CAGAAGGGAT CTGGTGGTGA AAAATACGGC TAGAGAAAGC
AGCAAGGATT GGCTTCTAAA ACCTATGTAG TATCTTGGAC CTTACCCTAA ATGTAATGAG AAGCTTCTAA
AGAATCTTTC ATTTATTCAT TCATTGAACA AATATTTTGA GGCTTTCTGT GAAGAACATC ATTCTAAGTA
GTAAAGATAC AGCAGTGAAT AGGACACATA AAATCCTAGA TCTCACAGAA TTGACATTCC AGAGAGGGAA
AGGTAGACAA TAAATACATA AACAAATCAT TTAACAAGAT GATTTCAGAC AATGGTACGT ACTGTGAAAA
AAATGAAACA AGGTAATGGA CAGCGAAAAG GCACTGGAAG GAAGCCTGCT TACCTTTGCA TGGTTAGAAA
AGATCTCTCT AAGAAAGAGA CCACATGTGA GCTGCGACCT GAAGGATACC GAGAAGCTAG GTGTGCAAAG
ATGTGGGGAC AGAACTTTTG GACTGAATAG CAAATACAAA TGCCCTTGGG TGCAAGCCTT GCCTGTTCAA
GGACCAAAAA GAAGGCCAGT GTGCCTGCAG CATACTAAGC ACAGAGGAAA ACACTGTTAT ATGCTGAGAT
TGGAATTATA AGTAGAGCCA GATAATATAG TCTCTTATAG GTCATAATAA GGCAACCAGA TTTTATTCCA
AGAGGATTTA AAAATCACTG GAGGTTTTGC ACTAGGGTGA GAGGTGTGAT TTGTATTTTT AAAAGATAAT
TCTGGAGAAT TAACTATAAT GAGGTAGGAG TAAACTAAGT TAGGGGCTAT TTCAGTGGCT CAGACAAGAG
ATAATGGTAG CTTAGACTAG GATAGTAGTC GTAGAAATAA ATAAAAGTGG CACTCTACTT TGGGGGTAGA
GTCTATAATA GGTTTGGTTT ATGGATCATA TATGAGAGTA AAAAAAAGAA AATAAATTAA TAATGGTTCC
TAGGTTTGTA CCTGAGCAAC TGAATAAATG GGTGCTGTGA ATTGAGATAA AGGAGATTGA GAATCACAGG
CTTTGTTTTG CAAATTAATT TTGAGAGGCT TATTAGACAT CCCAGTGGAG ATTTCAGGTG AGTGGAGCCC
ATTGAAAGGT AAGGGACAGG GTCAGGTGTG GTAGGTCAGG CCTGTGATCC CAGGACTTTG GAAGGCCAAG
GCAGACAGAT CAGTTGAGCT CAGGAGTTTG AGACCAGCCT GGGCAACATG GAAAACCCT GTCTCTACAA
AATATGCAAA ATATTACCTG GCATGGTGG CATATGACTG TGGTCCAAGC CACTTGGGGG CTGAGATGG
GAGGATCACT TGAGTACAGG AGGCGGAGGT TGCAGTGAGC CAAGATCTCG CCACTGCAAA CCAGCTTAGG
TGACAGAGTG AGAACCTGTC TCAATAAATA AATAAGAAAC GTAAGGGAAA AGGAAATTAA TCTGATCATT
GGCAAATGCA TAGTATTTAA AGCCAGGGGA GTAGATGAGA TACTCAAAGT AGGTGAAGAT AAGGAGGCAA
TGAAGGCCTA GGACTCTGGT GTACATTTAG ATGGTTATAA GAGGAATAGA AACTGGCAAA ATAAGTAACA
CTGAGCACCC AATGAGGTGG AGAGGAAAGC CAGGAGATGA AGCATCATAG AAGGCAAGAG AAGAAGGGTG
TCAAAGAGGC GAGGCAGTCA TCAACTTCTG GGCAGTCAAA TAATATAAGG ACAGAAAAGT GACCATTGGA
TTTGGAAATA TGATGAGCAC TTTGAGTGGA GTGTTGAGAC AGAAGACCAA TTAGAGTAGA TTGAGGAGAT
AACGAGAAAT GAGAAAATGT AACCTGCAAG CACAGACAAT TCTTGAGAGA CTTTTCTGTG AAAGGAAACA
```

-continued

```
GACACAGAGT CTTAGCATGT CTTGTCTTTC TATGGGAAAT GTAAATAGTT TGAGATCAGG GATAGTATTT
TATTCTGCTT TTTGTACCTC TACATTACCT AGCATAGAGC TAGCTAATGT GCACTTAAGT ATGTTCTCAA
TTCTTATCGC CTGAATGACT GGATGGGTGA AGAATGGAT GGATGGATGG ATGGATGGAT GGAAGGATGG
ATGGATGGAT GGAAGACTTC TGATTTGCCA AGAAGAGGAT ACTGGTAGCA GAAATAAAAA CAGCACTGGA
GAAAGAAGAG TTTAGATTTT TATTCTTTGG TGTCAGTTAG ACAGGAAAGT AAGACATTAG AAGAGTCCTT
AGATAATTTA TGTAATTGTT CACTTAGGAT TTTTAAATGT GATCACTGAT ATTGGACATG TTCCTAGTGA
AGCATTTTTG GTGTTTCACT GGTTGAAGTT AATAACTGTA AAATTATTTC CCGTTCAGGA CAGAAAAACA
GAAAACTTGA AGCTCCTATT AGAAAGTTCA AGATTCTCTG GGGTTCTTAG GATTTACTGT TCCCAAAACT
CTGTCAAGAA CAAGAAAATG ACCTGTATAC TTAACTGGTC TAGGCAACAG TGGAAAGACA ATTCTCAGAG
AAGATTTGTT TTAAGAAGAC ACTTTCCATA GGAATCAAAC AATAGCTTTC AGTGACTAAC ATGGTAAGAC
ACAGGGTGTT AGCTCTTTCC TTCCAACCTC ATGGCTGTTG TACCTTACCT TTCGACCCCG TGTTCCTGAA
ATTGTTAAAT TCATAAACTT ACCAAGGACT AACCAGCCTC TGGGGAATTG CTGTATACTT AGCAAACTTA
CAATGGACAT ATTTATAAGC CATAATGATA ACTGACTAAT AGGAAATACC CTCAACTGAA AATGAGAGAT
CATCATTTGC AAATGAGTTC CCTTGCCCAG GCAACTACTG GGGAAAATGT CATGCAAGCA AAATTAATCT
TTGAAATCCT CCTTTTCCAT TTTTTGTGTC TTCCTTTTCC ATAGGCACCA GAAATATCAT GGTGCCTGGA
TCTCATCTCT ACAGAAAAAA AAAGTGATTT GATAAACTGA TTTATATTGT GTCCAAATGT GATTGTATTT
TCAAAGATAA CCTAAGGGGA GAATGCTGTC TGGCCCAACA GCAGGCTCTC GACTTCATTT CAGACACTGT
GGCCAATGGC TGGAAACAG GTATGAACAG TAGGTTTCTG AGTCCCCTGG AATTATTCCA TTTATGTAGC
CACCTCCATG ACAGGAAGCC TCCCTACTCT TACTTCCCAG TTTGTTCATT CATGGCACCA GGTTGCAGAT
TAAAATTTGC TCAGTGACCT TTTATCTAAT AATGTGTTAC CTTCTTCTCT TAAAAAGTAC AAGGGACAAA
TGCTCATGGT ATACTTTTAG GAGATTGTGG CTCTCTATTA ACAGTATTTA TTCAACAAAC ATTTATTGAG
CATTTATATG TGCATCATGC TAGGGACTGG AACCTAGTAA GTGTAGCACA TATTATTTCA TTTAATCCTC
ACAACAAACC CATGAGGTTG GTTTTATGAT CCCAATTTTT CAGAAGAAGA AACTGATATT CAGAACCAGT
TAACTAACTG GTTCAAGGTC ATGCAATTTC TAAGATACAG AACCAAGAGT CAAAGACATG ATTTTAAACC
AAAGCTTTTT CTGCTACTCC ACATTGCTTC CCTAGGTGAG ATCTGAGGCA TTCCGCGAAA AGAGAAGGGT
CATAAAGCCA AGGGAAGACA AGCTTAGGAA AAAAAAGGGA AATGTCCTAA ATAAACAGCT TTCCTATTTA
CCAGAAACCA CTAGTTTAAA AATATAATGG GAAAAATCCT ATTCACTTTA ACAATGTTAA AAAAAAAAA
GATAGAAGAA ACATAGGGAT AAACTTAACA CATTTGTAGG ATATGTAAAG AAACTAAAAG ATGTTAATAA
TGGCCTAAAG AAAAAAAAAC TTACATGTAT GGGGAGATAG ACCATCTTAC TGGATTCTAA TATTTAATAG
TCTAGGTGTT CCATTTCTCA CCAAATTAAT GTATACATTT AATACAATGT CAAACGAAAT ATCTTAGGAA
TTGCTTACAA ATTGTCAGAT AATTACAAAG TTTACCTGGG AAATATAAGC ATATATGAAG AGTGAATGGG
ACCCCACCAC TCCCCCCAAA ACAAAAAAGG TCTGAAAAGG ACAGAAATCA AGGAGAGTCT TGCCTGCCAG
ATACAAAATT CTATTATAAA GGTGTATTGA TGAAAACAAT TTAATACTAG TGTAGCAATA GGCAGCAAAG
CAATGAAACA GCATAAAAAG ACCAGAACTA TACCTAATTA TGATGAAGAT TTAAGGTATG ATAAACATGA
CATAATTCAA ATCAGCAGAA ATTGGCATAG ATAGGGTTAA GACAAATAGC TAATCATTAG AGGGGAGGAA
GGAAAGGAGG GAGGATAAAA TTAGGTTCCT GCCTTCATCT TACATTAAAA TAAATTCCAG ATGTATTACA
TTTAAATTTT TTTAAAAAAA GAAACCACAA AATACTTGAA GAAAATATAA GTTGTTATAT AGTCTTTTGA
TGGGAATTTT TTTTTTTTTC AGAGACAGGG TCTTGCTCTG TCACCTAGCC TAGAGTGCAA TGGCATGATC
ATGGCTCACT GCAGCCTTGA ACTCCTGGGC TCAAGTGATC CTCCCAGCTC AGCCCCCAG GTAGCAGGAA
CTACAGGCAT GCGACACCCC ATCCAACTTA TTTTTTATTT TTTGTAGAGA CAGGGGTCTT GCTTTGTTTC
```

-continued

```
CCAGGCTTAT CTCGAACTTC TGCCTTCAAG CACCTCAGCC TCCCAAAGAG CTGGGCTGAT GGCACATTTT
TTAACATAGT GCCACATTAC CATAAATGAA AAGCTTGTAA AATACTAATT TTTAAAACTA ATATATATCA
GAAATTTTTA TAAACAAAGT TAAAAAGCAA ACACAAAAAA TTTGTAGCAC TTATGACAAA TATATGTATA
TATATGAATA CAAAAGAGC CTTTACAAAA CAGTAAGAAA ACAATGAATA CTCCCAATGG AGTATTCAAA
ACTAAACTGC TAAAAGCAAT TCAAAACAAA AAACATAAAC TATGCATATA TGTATGTGAA AAAGTTTAAC
CTTATCAAAG AAGTAAACTC TCAAAGAAAT AAACATCAAA TAAGGAAATA GCCTTTTCCC ACAAATAACC
AAAATCTGTA AGAATACTGA GCTGCGAATG TTTCAGAAAA AAAAAAAAAT CATACACCTA GTTCGGCATG
TAATTAATAT AGATCAGAAC ACTTTAAAAA TATTTATAGG CCAGGCACGG TGGCTCATGC CTATAATCCC
AGCACTTTGG GAGGCCAAGG CGGGTGGATC ACCTGAAGTC AGGAGTTTGA GACCATCCTG ACCAACATGG
TGAAACCCTG TCTCTACTAA AAATACAAAA ACTAGCCAGG CATGTTGGCG TATGCTGGTA ATCCTGGCTA
CTCGGGAGGC TGAGGCAGGA GAATTGCTTG AACCCAGGAG GTGGAGGTTG CAGTGAGCTG ACATTGTGCC
ACTGTACTCC AGCCTGGGCA ACAAGAGCAA AACTCTGTCT CAAAAAATAA TAATAAATAA AATAAAATA
TTTATATACT CTGACCCATC AATTTGTCCA GCATAATTAG GCATGTGTAC AAGGGTTTAC ACACAAGAAT
GCCTATTGCA ATATTGCTTT TAATGCTAAA AAAAATTGGG GAAAATGCTT TAAAAATATA GATTAAGACT
GTACATTGTG GTACAGTCAT ATAATCAATA GTATACAGCT ATTATTTATT TTCAGCCACT GTCCAAAATA
TAGCCTGGCC TAACAACATT CTGTTAGGAT ACGCAAGCAC CGTGAGGAGA TCAGCTATAA AGTATCAGTG
TTTCACACCA CTGCTCCTTT GCTAATAACC TTCAATGGCT TTTAAAGAAG TAAAAAACAA AGGCAAAATT
CCTTAGTCAG CCCTTAAGAC TCTCTGTTAC TTAGCTCAAA CTACCCTTTT CAACAACACT GCCCTAACCA
GGATGAGTTT TTTGCCCCCC TGGAGTACAT TCAGCCTTTC CTTATCAAAC CTTCCTTTAA ATAAGTATCT
TCTCCAGGAC CACTTCACTT TCTTCCCCAA TTTAGCATTT TCTATATCTC CAGGCCTACC TCTATAAAGC
CTGTCCTAAC CACTCAAACC CTAGCTTTTT CTCTGAACTG CTAGAAATAT TTTTCTCTCA TTGGCCATTT
AGGTAAAAAG GTTTTTACTG TTTATTACCT ACTCAATAAA AATTTTCTTT TTTTGAGACA AGGTCTTACT
CTGTCGCCTA GAATGGGGGG AAGTGGTGTG ATCACAACTC ACTGCAGCTT CTACCTCCCA GCTCAACAGT
CCTCCCACCT CAGCCTAGTG AGTAGCTGTG ACTACAGGCA TGTGCCACCA TACCCCACTA CTTTTCATTT
TTTATTTTTT GTGAGATGGA ATCTCACTAT GTTACCCAGG CTGGTCTGCT GATCTCAATT GATCCTCCCA
CTGTGGCCTC CCAAAATGCT GGGATTACAG GCATGAGCCA CAATATCTGG CCCCAGTAAG CTTTTAAGGC
CATTAACATG AGGAACAGTG TTCTTTACAC TATTTTATCA GCTAGGGCTT TGCATGGAGT AGGAGTTTAG
TAAATGCGGT TGATGGGTTA ATCAATGTGT GAAAATATTC AGAGCCACCA AAAACAGATA TTATGTCTAT
TCTCATCAAC AATCAAAATT GAGTAAACAG CCATTTTCTA ATACAGGAAA CCACAAAACA TTGAATGGTG
ACATTAAAAA ATTCCCCCAG CAGGAGCCAA CCAATTTTTT CATCCTGATC CAAGTTAGCA AACTGCAAAA
GATAGGAAGC ACTAATGAGT GGAAATTTGA GTAGAAGCAT TTCTTATGAA GGCTGTCTTG ACTGGATCAC
ATTTTTATTG CTGTTGGAGG TGCCAAATGT GTGTGTTTAT GCTAATCCTC CACCTCAGGC AACACACAGT
CAAGGATCCT ACCAAGTGTT ACCGTCAAGT GTCTGTTGGC AGCTCAAGGC CCCAGCGTTG TTCCCTTGCA
CTAGGGAAAA GACATATTCC AGGTACAAGT ACTCCCACTT TGATGCTACA GAGGAGTTGC TGAACTTTGT
GTCATTAATC TCTCTTCGTT AGATCCCAAC CCTGTTTAAA TCCCACTATC TGCCTACTCT GGGTCTTCAC
CAATTTACTA GATCATAGTT GGAGAAAATC TACAAAGCCT TGCTCCCTTT AGATTTAAAC AGGTCTCCGT
TTAAATTTAG AATTGCTAAC TTCAAGCGGG CCCTTATGCG ACAGTATGCC TGTCAGTCAT ACTACATTTC
CTCAATTCCA TTCATGTGAC TGCTCCATAC CCTTCCCTCT CTCTTCATAC TACTATTATC TCTTCCCCCC
TCCCTCATTT TTAACTGATG ATCTTGTTTC CTATTTCTCT GAGAAAATAG AAGCCATCAA AAGAGAGTTT
```

-continued

```
CCACAAACTC CTACTGCCTT ATCTAGCCCT GTACCATATA CTTTGCATTT CCTCTCATTA CCATGGATGT
ACTGCCTATC TGTGCTTCTA TCTAAGGCTA ACCCTTCCAC TTCAGTTTTG AATATTATCA GCTCTTACCA
ACTCAAGGCC ATTGCTCTAG CAATTCTCTC ATTCTCTCTC ATTTTCTTCC ATCAAGTTTT CCTTTTCTTC
AATTAACAGA GTAGCTCCTA AAGGGAAAAA AAAGTCTTCT TTTTCAATGC TCATCATCAC TGGCCATCAG
AGAAATGCAA ATCAAAACCA CAATGAGATA TCATCTCACA CCAGTTAGAA TGGCAATCAT TAAAAAGTCA
GGAAACAACA GGTGCTGGAG AGGATGTGGA GAAATAGGAA CACTTTTACA CTGTTGGTGG GACTGTAAAC
TAGTTCAACC ATTGTGGAAG ACAGTCTGGC GATTCCTCAG GGATCTAGAA TTAGAAATAC CATTTGACCC
AGCCATCCCA TTACTGGGTA TATACCCAAA GGATTATAAA CAATGCTGCT ATAAAGACAC ATGCACACGT
ATGTTTATTG TGGCACTACT CACAATAGCA AAGACTTGGA ACCAACCCAA ACGTCCAACA ATGATAGACT
GGATTAAGAA AATGTGGCAC ATATACACCA TGGAATACTA TGCAGCCATA AAAAATGATG AGTTCATGTC
CTTTGTAGGG ACATGGAGGA AGCTGGAAAC CATCACTCTC AGCAAACTAT CACAAGGACA AAAAACCAAA
CACTGCATGT TCTCACTCAT AGGTGGGAAT TGAACAATGA GAACACTTGG ACACAGGAAG GGGAACATCA
CCCACTGGGG CCTGTTGTGG GATGAGGGGA GTGGGGAGGG ATAGCATTAG GAGATATACC TAATGTTAAA
TGATGAGTTA ATGGGTGCAG CACACCAACA TAGCACATGT ATACATATGT AACAAACCTG CACGTTGTGC
ACATGTACCC TAAAACTTAA AGTATAATAA AAAAATATAT ATATATATAT AAAACAACTA AAAATAAATC
TTCTTTTTCT GCAGGATCAG TCCATCACCA CACACACAGG CTGTGTTTTA TGTTGTTCCC CAGCTTAAGA
GATCGTTCTC CAGATCCCAC TGCTCCTTCC AGTTGTCACC TCAGTTCTCC ACTTCTTTTT GCTGATAAAC
TACTCTAACT AGTTACATAT GATTTCTGTC CCCAGGTCCC CTCCCTCAGT TGTTTTGAAC ATAATCATTT
ATATCATTTA TCATTTTCAC TCTAATTGCA CAACCAAAAA CTCCCTTTTT TTTTAGATGG AGTCTCACTC
TGTCACCTAG GCTGGAGTGC AGTGGCATGA TCTCGGCTCA CTCCAACCTC CGCCTCACGG GTTCAAGTGA
TCCCCCTGCC TTAGCCTCCT GAATAGCTGG GATTATACAC ATGCACCACC ACACCTGGCT AATTGCTTTG
TTTTTGTTTG TGTGTGTGTG TGTTTTTTTT TTTTTTTGGA CAGAGTCTCA CTCTGTTGCC CAGGCTAGAC
TGCAGTGGCA TGATCTCAGC TCACTGCAAC CTCCACCTCC TGGGTTCAAG CGATTCTCCT GCCTCAGCCT
CCCGAGTAGC TGGGACTACA GGCATGCACC ACCATGCCAG GCTAATTTTT TTGTATTTTC AGTAGAGACC
AGGTTTCACC ATGTTGGTCA GGCTGGTCTT GAACTCCTGA CCTCAAATGA TCTGCGCACC TGGACCTCCC
AAAGTGCTGG GATTACAGAC TTGAGCTACT GCGCCGGGCT ATTTTGTGTT TTTAGTAAAG ACGGGGTTTC
ACCATGTTGT CCAGGCTGGT CTCAAACTCC TGACCTCAAG TGATCCGCTC GCCTCAGGCC CTCAAAGTGC
TGGGATTACA GGAGTGAGCC ACCATGCCTG GCCATAAAAC TGCCCTTTGT TAATATGACT GTTGGCCTGC
ACATTGTCAA ATCCAGTGGC ATTCATCTTA CTCGGCCAAC CTACGGCATT TGACACTGTC TGTCTTTCCT
TCTGTTCCTC TATCTGTTTC CAGTATACTG GCCTGGCTTT CTTTTTACCT CTTTTATATG CTCTTCCAGT
CTCAGGCTCC TTTGGGGATT TGAAGGTATG TTGCATTTTG CTATTCAATG AATAATGACA AGTAATGATC
ACTTAAGACA TTAAGTGGTC AGTTCCTTTA CTAGGATAAA AATAATTTTC TTCCCAACAT GGGCATATT
CCATTTCCAG TCTGACTGTT CTGTGTAATC TTTGTATTCC TTGGCAGCCC CTTTTATATC AGTTCATCTA
CTGTGCAGGA AATTGGACAA ACATTTGCAC TGGTATAACC AAATACAGTT GAACTTTTGG CTTGACTCTT
AGCTGAACTC ACCAAAAATA ATTTCTGTAA GAGACTGAGA CGTCTACGAG TAGGTTTTTC AGAATTAGTA
AACATAAATC AAGGATACAC AGGTAGATTT GAATTTCAGA TAAACAACAA ATACTTTTTT AGTATGTCTA
CTGAAATATT TGTATCTTAT CTGGCAATTC TACCTGGTAC AGAACTAATC CATTCTCTTG AAAGATCTTG
ACTCTGTAAT AAGTTCTTTG GTGATGGAAG GGAGGTATTT CTGTAATTAG AGTCACTGTC TTCCTCCCAG
TTTTTTATCC TGGCCCAGAT CTGCAATGAA CACACGACAG AATCCAGGGG GGATGAAGAT GGGTGCTTTG
CAGGGAAAAA AAATTAAAAA CATCTGAAAA AGCTTTTGTA CTAAAGAATG TGATCTAAA AAAGAAAGCA
```

```
GGAGAACTTT CTGTCTGCAC TTTACATCAG AACAACCTTG GCGTCTAGAA GCTGTGCCCT GTGGGAAGTG

GTGGTGCTTG GTAAGAGATG CCAGGACCAG TGGTACCCAC TGGGAGCACT GCCAATACCC AGCAAGGAGC

ATGGGTGCAC AGTAAGGCAT TGCACTGTGA TTCAGCATAA AATAACAATA AGGGAACGTC ACGGAGAAAA

GGCCAGACTT CCTTTGTTTA GAATGTGGGA AATGTCTTCT GAAAAATGGT AGTAAAAAAG CATGCTTGGA

TGGTCCACTC CAGGCAAAAC TGACTAATCG GGGGTCAGGG ATACAACCCC TGCATCATAT GTTTGTTTCT

GTTGGGCTGA CATGAGGTTC ACTGTGACCA CTGTGGTTTA ACCCCATAGT CTCCTGGAAA TACAGCCAGG

TCAAGAGAGC TCCACATAAA ACATAATCAA AAAAATAAAC TCAAGTTTCC ACTGATCAGC TTTTCACAAC

TCTTATCCTT TCACTAACTT TGGAGCAAGA TTTGAGAATT GGATGGCTAT TTGAGGGCTA TTTCTGCGCT

TTAGTTCAAT GTTTTGTTCT TTCTTTATTA GAGAACTATG GTTTTTTATT ATATTTACAC TTTAAGTTCT

AGGGTACATG TGCACAACGT GCAGATTTGT TACACAGGTA TAAATGTGCC ATGTTGGTTT GCTGCACCCA

TCAACTCGTC ATTTACATTA GGTATTTCTC CTAATGCTAT CCCTCCCCCA GTCCCCCACC CCCCGACAGG

CCCTGGTGTG TGATGTTCCC CTTCCTGTGT CCAAGTGTTC TGTTTATGTG ATAGATTACG TTTATTGATT

TGTGTATGTT GAACCAGCCT TGCATCACAG TCACTTGCTT ACAAGAAACA AACACTTCAC AGATGGATCA

TTATGTGTGA TAAGTGAAAT CCAAGGATTT ATGCTCAGAG GTGGGCTTAA CAGGTAGGAA GAGCAGTATT

TTCCTTCAAC CATGAGTGTA TGCAGGTTTT CTTTTCTTT TTTGAGATGG AGTCTCACTC TTTTACCCAG

GCTGGCGCGC AGTGGTGCGA TCTTGGCTCA CTGTAACCTC TGCCACCTGG GTTCAAGCAA TTCTCCTGCC

TCAGCCTCCC AAGTGGCTGG GATTACAGGC ACCTGCCACT GTCTCCGGCT AATTTTTGTC TTTTTAGTAG

AGATGGGGTT TCACCATCTT GGCCAGCCTT GTCTTGAACT CCTGACCTCA TGAATCATCC TTCTCAGCCT

CCCAAAGTGC TGGGATTACA GGCATGAGCC ACTGCGCCCA GCCCACAGGT TTTTCAAAGA CTAAACTTAA

AAAAAAAAAA AAAATTTCCC AATGAAATAT AAAACTAAAG TGCTAAACTG TGATAGACTG TTTTACAAGA

ATGCCAGTTT TCACAAGTGT CTATAGAACA TGTAATTTAG ATAGGTAAGA TGAAATTTTG ATAATATTTG

ATGGCAAATT TAAACAGGTA TACAACAAAA ATAAAATTCT AAGCCCCTCA ACCAACTGAA TGGACTCCTT

CTCTCAGCCA AAGGAATACC AAAGTAAACC TGAAAAACTA GTTTTGGCCA GGATTGGGGG TAGGTGGGGG

AAGCCCAACA TGACTCATTA TTCTCTCCTC CCTTTGGAAT TCAGGCACAA CTGAATGTCA GCATTGACAC

TAAAACACAG ATCTTAAGAC TGACAAGCCA GACTCTTTGT AGCAGAGAGC CAGGCCCTGG AAGAAATCAA

GTTATTTTAT CCCAAAAAAT ATTTCTTTGA TATATTTTCA AATGGCCCTG CAAAGCTGTC TCTTGTGGGG

AAAATTGACA TGCTGTACAG AATTTCCTTC TCTTTCCAAG TTTTTACTGA TCCAGGAGAG ATTTAACTAA

GAGGCTAGCA TGTTTTTTTT TTTTTTTTTT TGAGGCGGAG TCTTGCTCTG TTGCCCAGGC TGGAGTGCAG

TGGCGTGATC TCAGCTCACT GCAACCTTCG CCTCCCGGGT TCAAGCGATT CTCCTGCCTC AGCTTCCCGA

GTAGCTGGGA TTACAGATCC ATGCCACTAT GCCCAGCTAA TTTTTGTATT TTTTGTAGAG ACAGGGTTTC

ACCATGTTGG CCAGGCTAGT ATTGAACTCC TGACCTCGTG ATCCGCCCAC CTCGGCCTCC CAAAGTGCTG

GCATTACAGG CGTGAGCCAC CGTGCCCAGC ACAAGACATT TACCGTCTAT TCTCTCTGAA GCTACTATCT

AGAGGCTTCA TCAACATAAT AAGACCCTTG GTCTCCACAA CTCCTTATCT TATCCTATTA GTTTCTACTG

ATTCCAGGTC TTTAGATAAT AACAACTCTT TCACCAATT GCCAATCAGA AAGTCTCTGA ATCCACCTAT

GACTTAAAAG CCCCACTCCT TCAAGTTATC CCGCCTTTCT GGACTGAACC AATGTACACC TTATATGTGT

TGATGGATAT CTGCCTGTAA CTTCCATTCC CCTAAAATGT ATAACATCAA GCTGTAACCC AACCACCTTG

GGCACATGTT TTCAGGAACT CATGAGACTG TGTTGCAGAC CTTGGTCACT CATATTTGGC TCACAGTAAA

CTTCTTTAAA TATTGTATAG AGTTTGGCTT TTTTCATTGA CACAGGAAAA ATAAAGAATT GGAAGGTCTT

TCATCAGTCA CTGAGCCAGC TTCATATCTG ACTGAGGTCA TACAGTTCAG TGATTTGTAG CTTTGCTACT
```

```
TAGATTGCTA TCCATTATCT AGAAGCATCA GGATCACGTG GGACCTATTG GAAATGCAGA CTTTCCTCCT
AGAACCCAGG ACCTTGGAAT ATTCTTGGCA CATAGTAGGT GCTCAATACA TATTGAACTC CTAGGTGCAA
TTCATTAATT CATGAATTAA TGAATTAACA CGCTCTCAAA GTTTAGTGCT TTTTCACAGA CTAGTCTTTC
TGCCTCTTAA GCACTCAGCT CACCACGCTT CCAGTCTCAC TCCCCTATTA GTCTGATTAA AATCTGCTTA
CATGTGAGTC TGAGATCAAG TGTTATCTCT TCTGAGAAGT CTTCCCTCAC TGGCCCAAAG GAATTTCTCC
TCTATTTTAG CACTGTCCCA GTTGACTTGT CATTATTCTA GTCTTTTTCA TATTAGTTGT TTTTCATATA
TATGTTATTA AGGAAACTAG TCATTTCCCC TAATAGAACA AAATTGCTGG CCTTTGGGGT TGGCAATGGA
GGGGAGGCTC TTCTTGAAAA GGGGGAAGAG TGTTCTCCTA ATATTTTTCT TACGAGATTT ATGTTGCTCA
TCTTTAGCCT TTAGTCCCCC ATTGCCTGCC TACAGTTGGC AGAGACCATC TGTTCTCTCA CTGTCAGGAA
CTGTCTCAAT TCTTGAAGTT CAGAGTCAAA AAGAAGCAA GTTTTCCTAG CTCTTTGATC AACTTTCAAA
GTTTTACTTC CATTTGAAAA TTTACTAAGT CACCAGGAGA TGGTTTATAC TGAGAAATAT CCACTCATAC
TCTTCCTCTT CAACTTTCTT CCATATACAC CCTATTACAG GGATATAGTC TTACTCTATA GCTCAAAAGG
ATGACCCTAT CAGAAACCTG CACAGTATGT AAAACATTCT CACCAGAGGT TCACTTGTGT ATTTTCACCC
TAGAATGGAA GCTCTACAAA AGCACAGAAT GTATCATTTT AACTTTAGAT TCTATTTTCA CACCCAGTGC
TTGACACATG ATTTGAAGTT AATATTTATT TATCAAGTGA TTGTTTTAAA ATCATGACTC ACTCAACAAA
GTTATAAGAA TAAGAATAGT GTTACAGAAT TGGTATACAC AAGCTGACCA TAATCAACAC ACCTATTATC
ATTTTTTTGC GACAGGTTCT CGCTGTCTCA CCCTGGCTGG AGTGGAGTGG CATGACCACG GTTCACTGCA
GGTTTGAACT TCCAGGGTCA AGCAATCCTC CCACCTCAGC CTCCCACATA GCTGAGCCCA CAGGTGTGTG
CCACCATGTC CAGCTAACTT TTTAATTCTT TGTAGAGACA GGGTCACCCT ATGTTGCCCA AGCTGGTCTT
GAACTCCTTG GCTAGAGAGA TCCTCCCTCC AAGGTCCCCC AAAATGCTGG GATCTCAGGC AAGAGCCACC
ATGCCTGGCC ATAATCAATA CACTTTTAAG AATGCTAGAA TGTTATATCA GATGCATACT TCAGCACTAT
CTCAAGCAAA CTGGGGTGTG GGTTATTCTA CATATAAAGT TCAGCAGTGT TGTTCCACAG TCCCAAACTC
CAACTGAGGT CAAATGTAGG GTGCAGCAAG GTCACTGGGG CTGTCATCAA GGGCCTCTCC TTGCACTCTT
GCCAACCCTG TTTCTTGATT GTCTCTACCA CCATGAGTCA CCAGCAATCT CCCACAGTCA CTTGTTTAAA
AGTTCACAAG TATTGTGTGA ATTGCAGGCA ACCCCTTGAC TCCCTGATTG CCTGGTCTTC TTCCTTGGGC
TCTACCATTT TTTTTCCCCA GCACTCTTTC TGCTGCTCTA AATTTTAATT CATGCAATTC CATATGTGTT
TCTCTATCAT TCTTCATCTC TTTCCTCTCC CTTCCATCCA ATTTTGTTTG TCTGTTTGCT TGCTTGCTTG
CTTTAATACA TTTCTCTTTT CTGAGAAGG CTTGAGTCCA AAACTCTCAG TTACCTGTTG TTCTGTTTCC
CGTTAGTTAA TCTCCGAACC TTCATAAATT AAATCTGACA AAGTCCCCTG ACTAACAAAG GAAATGCACA
AGTCACAGTA AAAGGGGCAC ACACAGAACA CAAATAGACC CAGGGTCTTT TCTGTTCATC ACTCAGCTTT
TTATAGGAGA TCCAGGAGAA ATGAAGTGGA AAGGGAAGTG TGTTGAGTTA CTATACAACA CAAGAGTAAA
CTTTCTTATA AGTGGTAATT TTTTTTTACA GGAATAATTG AAAATGGAAA TTACCTTCTC TACTCATAGT
AAGTACTCAG TGCGTTCTTG ATGGGATGAG AATGTGTTTG AGCTTTAGTG TAAGGCAGAA TTCTGTTTAG
TCTGCCAGTA TTGGAGAAAA ATAAAACACA AAGGGACTGA CATGTAGGAA GTGGCACCTG GGAGGGTCTC
AATTCTTCCT ATTACAAAAA TGCCCCAGAG AAATAAAAAG CTGGTGTACA TGTTGAGATG GGAGAGTTCT
CTGGCCCCCC TCGCAGGATG TGTGACAGTG GGGTGGCTCT CTGCTGCGCC ACCATGAGCT CAAACCCCTC
ATAGGAGGGG GAGCACACAG GCAGGAAGGT GCAGGAGCTG GGCGAGCTCT TTGGGCTCTG GCCCCGTGGT
ACTGTCTAGA GGTGGGTGCC TGCAACTCCT GAAAGCCCAA GTGGGCATGT GTTACAGTGC ACTCTTTCAG
CTTTGCTGTC TGCAGCTTAA GCGTTAACCA GCTCAGTTTC TTCTTGGTAC CCAGGTCCTT GTCTGGCATC
CAGGAAGAAT CAGGTTACAC ATGGACTTGA AGGATGAATG TGGGAGTTTT ATGGAGTGGT GGAGGTGGCT
```

```
CTCAGTGGGA TGGATGGGGA GCTGGAAGGG GGATGGAGTG GGAAGATGAT ATTCTCCTGG AGTTTGGCTG
TCCAGCAGCC GATCTCCTCT CCAGTCGTCC CCAGCCTCTC GACGTTCAGA TGCTCCTCTT CTCTCCTTCT
CTGCCATGCT GTTCTGCCGT TCATCTGCCT GTCTCTCTCT GGAGCCTGGA ATTTGGGGTT TATATGGTAC
ACAATAAGGG GCATGGCAGG CCAAAAGGGA ACTTTTTAGG TGCAAAAAAC AGGAATGCCT CTTCTCACTT
AGGGCTATAG ATTTTCAGGC TTGAAGGTGG GGCCCTTACC AGCGAACCTG TATTTCCCTG TCTCCTGTGC
ATATCAATGT AATCAAATAC TGGGCTGATC CAGGATGTTT CTTTAGACCA ATTATGGGTA AATAATTTA
CATTCAGGTT TTTATATTTG CTTTTGTCAT TTCTCTTTAA GCAATCATGT AAAATATCTA TACGACAGTA
ATAGATGATA GCGAACCTAA TTAAAATTAC CAGAAACTTA AGAATCTCTA ATGATTTCAA CTGTAACTAA
GGTTATTTCT CTTTATGTTG AACAATGTTG GGAGATAAGA CACAAGAGTT TCTGAAGTAT TCAGAAACA
CAAAGAGGGA GGTTATATAA ATAATATTTT TTTCCTACTT TGGGAAAATG AAAGCTAGTC ACAAAGTTAA
ACGAGTGGTT ATTTTAATAT TTAAAATACA GGCTTGGATG TATTTCCTGT TAAAGAAAAT AAAATGCAGA
ATATTCAAAA CGTCTGACCA CCCTTCTAAG AAAATGCATC TCTGAGGTAT TTTTCCTTAG AAGTTATTGT
AAAAATCCTG GAGAAGCTTG AACACAGCAA AGCAAACAGG ATGCAGAGTT TAATCTGTGG AAAGCTTAGG
GAAGAAAAGC AAATCATTAA AAATAGGTCT TCCTCTGAAG ATTTTTAAAA CGCAAAGAGG GTGGAATAGC
AATGATAATA AAAAAGCTGG CATAGAGAGT GGCACAATTT GCTGTGCCAC TGAGCTGACT GGATGTGTTC
TGAATTTCTA GGCATTAGTG TACCTTTCCA CACGCATTCT CCCTTTAAAA AAAATGCCCA CACACTGAAT
ACTTTTTTCA TGCAATTTAA AATAAGCGCA CCATCTAGTT TACAGAAATT CACTAGAAGT TATTTATCCT
AAAATAGCAG AGATCTAGAA GAATTTTGAG CTCTAGGACA TTTTAGACAC ACAGAAAGAA GAATCTGGAC
AAGTCTTGAC CAGACATGAC AGAATAGAAA TTTCTTTTCC TATTTATCTC TTTGAATAAA ATTTTTCGGA
TCTTACAGTG GACAAGTTTG TTATCTACAC ATTGTGAAGC ACATTGATTT CTCCTCTGTA GCCTTAGGAA
GATCTGAGAG GTGACTGAGC TGATTGAATG ATCCGTGACC GCTCTACTGG GACCAGTAGT AGAACTTTAC
TGGTGGAGAC CTGCTGGAGG TTTGAGAGCA GACTTTGAAA ATTACTAGAG CTACACAGAT ACTGTGTGGC
TAACTGGATT ATGTTTAGAG GCTTTCAGAA CTATGCTGCT GCTGCTGCAG TGTAGCCAGG ACGCACAGAG
AACATCTAAG GCTCTTGAAT GGGGCGATAG GGACAGATTT CAGCAGCCAT CTGACTTCAG TGCTCATTTT
GATGCTTTCC CTGCAGGGTG CAGTGTGCAG TGTGCAGTGT GCAGTGGTGG GAGGCTCACA CAGGAATACT
TGCTTCTGTA GCCCTAATTT CCGGTTCAAA CTCTGCATTC ACCTTGACAG ATTCTTTCCT TGGCCAAAAT
TTAGTTAGGC TTCTGGGCTT TCTCTTATGC CCACCTGCAG ACTTTTTGGT AAAATCCAGT TTTAGTAAAG
AGCTCTGCTA AGTCAGTTTA GCAAGAATCC CCACCTCAAA AGTCACTATC TCCCTCCCTG GTAGTGTCTG
GCTTGTCTTC AGCGAGAATT CTATTAGGTT CTGTTAGATT AGAATCCTCC TTACCCTTGA TGCTTCCTCT
TAGTATTTTT TCATCCACTG ACTCCTTGAC CCACCTTGCT CCTCGGCTAT AAATTCCCAC TTGCCCATAC
TCTGCAGTTA AGACTATTTT CTCCCCACTA CTGCAAAATC CCATTGCCAT GGTCCCTATA CTATCTCAAT
GGTAATGAAT AAAGTCTGCC TTACCATGCT TTAACAAGTA ACATTGAACC ATTTTTTTCT TTAACAATCT
GCTGCACAAT GAGATTACTA AAACTTTATT CCATTTTGCC ATGCTGGATG TCCTCAATGG AATGGCTCTT
GTGAGCACCA AATCATTGTG AGAAGGAAAA CCCATCTCTT ACAGCCCCCT GTAACGTGAT GTATGTTACA
TGTGATGTAT GTTACATAGT TTTTTTTCAT GTTGATCACT TTTTGCCCAT TTTCCTATAT CTTATCAGTT
GGAAGACTGT GGAAGTTTGT AGTACTAAGC CACAAGATGA CTAAGAAGAG TTGAAAGGGC AAGTGGGGCT
AAAAACAGAT TTTGTTTGAC TTACCCCACC ATTCCCCCTA TCATGGGCT GAATCTGCCT GGAGGAAGGA
GCATCTTTAT CTTTGTACTG TGAACCACAC AGTCTAGCAG CAGCACAGCC AAGGCACTTG GGGTTTCATG
AGACTAAGTA CATGCAATTC TATTGTAAAG GCTTAAAATA TATACAACTG ACCCTTGAAC AACATGAATT
```

-continued

```
TGAATTGCAT GGTCAGTTAT ACGCAGATTT TCTTCCACCT CTGCCACCCC TGAGACAGTA AGATCAATCA
ATCCTCTTCC TCCTACTCCT CAGTCTACTC AAAGATACTT GAAGTCTACT TGAAGATGAC AAGCACAAAG
ACATTTATGA TGATCCACTT CCACTTAGTG AATAGTAAAT ATGTTTTCTC TTCCTCCTAA TTTTTTAACA
CTTTCTTCTC TCTAGCTTAA TTTATTGTTA AGAATACAAT CTATAATACA TATGACATAC AAAATATGTC
TTAGTTGACT GTTTATGTTA TCTGTAAGGC TTCAGGTCAA GAGTATGCTA TTAGTGGTTA AGTTTTCGAG
GAGTCAAAAG GTGTATGTGG ACTTTCAACT GCAGGGGGGT GGGCACCCCT GCCCCCATGT TGTTCAAGGG
TCAACTTTAC TGCCAAAGGC AAGCCTTTAC ATCCACTTTT TCCATCCCAT CAGTAAATGG AAAAAGATAG
CTACAGTATC CCTGCGTCAA ATCTTTTTTT TTGCAGATCA CAAATTGGCC ACTCACCTTG CTCTGTGAGG
GGTAAAATGC CCCACTTTCT TTAGTAATAT TTAAGTTAGA TAATATTTAA GTTATAAAGT TGTTCTTTGT
AATCGTTAAT TGTAATTTTT ACATAGTTTC TTTCAAACAG AAATAGCATT TTTGTTAGAT AACCTCCCGT
ATAGATGATG AAACTCCTTT TAAGGGCTAT CTGAATTTTA ATTCCTTGAA AAGGCAGAAA TTGGATAGCT
AGTAGTCATA AATGTACTGT GGCTTCCCCC AACCATCTGG GCTATATAGA AGCTGCATCC TTGGACTGCA
GTAGAGGAGT CTTACAAAGC ACAGAGCAAC TTCTCTCCTG GGTTGCGCTA GTTATGATGG CAATTTTAAA
TGTGTACTTT TACCCAAAGA AAATCCTTAT TATCAACAAT CACAATGCCA TCATAACCAT GGTATAAAAA
ATTCAAAATG TCCCAGCTGA AGTGGAGGCA AGACTCAAG TTCATGGAGT CAGAGTTTCC TTGCTATTCC
TCTTTTTCAA ATGACCATTT AGTAAGCACC TGAAGAAAAT ACTATGGACG GCATTGAAAA GTGAAGATAG
GTTTAATCTT CTCGAAAATC TAATTCTCCA GATGAAACGC TGACACTTAT CCACCCCACA GACCCTATAG
CAGATGTGTC ACTGGCCATC ACATTTGACA CAGAGAAGTC ATAACTCAGT CAGCACAGAG ACATTTCCAT
GAGTTTCTGA ACCATGGACA GAACGTCGTC TGTGGGACAT GAAAACTGGA ACTTAGAGGA CAGGCACATC
TGAGAAATGG GCAGTTTAAA GGCAGAACAT AGCACATATG TGACTGGGTT TTAGAAGCAA ATTTACAAGA
CGCACTCTTC TTCATCCTAA ATAATCTGCA ACCAAAGCTT CCAAAAAAGA CAATTTAGGA ATGCAGAGGT
GAGGAGTAGG GAGGGAATG GGATGAGAGA GAGTGGAGAT TAATGGTGGG CAGAGCGAGG TTTAGAACTT
AGTGGTTTCT TCAGGTTCTG AACTGAAATT TGTATACTGT AAAGGCACAA ACACCATTTT TAACAAAAGT
GAGCAGGACT TCCTATCTGG TTCAGAAAAT AGGTGAATAA ATAGTACGAA TTATTAAAAA TAATAATTTC
CACTTATACA TAGGAAACTT GATAGGAACC ATGATAAATG CTTAACTCTT AATCTTCAAG GAACTCTGCT
AGGGATATAA TATTATAAAT CTTGTTTTGC AGATGGAGAA ATTGAATTTT AACCCAAGTT ATCATAACCC
TTAAATGATT AAATGATACT GTTACATGAG AAAGCTGCGT ATCTGTTTCC TGGATTTGTA GCCATAATTT
GTGTCTCAAG TCCCTTTTGC TGCCAGCTAT CTTGGGTAGG TGTGTTCCCT TTGGGCTGTT TGATACCCCC
ACATTTATCT TTTTTTTTTC TCTTTTTTTG TTGAGAGAGT CTTTCCCTGT TGCCTAGGCT GGAGGGCAAT
GGCGCGATCT CGGCTCACTG CAACCTCCGC CTCCTGGGTT CAAGTGCCTC TCACGATTCT CTTGTCCCAG
CCTCTCTAAT AGCTCGGATT ACTGGCATGC ACCACCACGC CCACCTAATT TTGTATTTTT AGTAGACAAG
GGGTTTCTCC ATGTTGGTCA GGGTGGTCTC AAACTCCTGA CCTCAGGTGA TCTGCCTGCC TTGGCCTCCC
AAAGTGCTGG GATTACAGGT GTGAGCCACC ATGCCTGGCC CCAAATTTAT CTTTAATGCC CCAAATTATC
TAGTTCCCAT GACTGGGCTT CTGCTTTGAT CCTTTCTGCA CTTGCTGGAC CCTCTCCCTG GGAAATGAGA
TTGTGTCCTG AGCCCCTAGT TAGAGGCTAT GTCTCTGCTG TTCCTGAATG GGCCTCCTGG ATGAGACCTC
ATTAAAAGTC TAATTCTCTT GGAGAATTGA GAGATACCTA TTTGTCTCAA AATCATTGAA ACCAATTAAT
GTATTATGAG CCTCTATCCA GTGATTTGTA CCTCAATTCC CCAATCCAGC TGTCAAGGCC AATTTGTTCT
ACCTTACCTA GTAGGTAAGT CTGGAATTGT AGCTGTGGCA TTTTCAGTAA TGGTACTCTA GGTTAGCAGT
CCCCAACCTT TTTGGCACCA GGGACCAGTT TTGTGGAAGA CAATTTTTCC ATGAAGGGCT GGGCAGGGGA
GTGGTTTCAG GATGAAACTG TTCCACCTCA GATCATCAGG CATTAGATTC TCACAAGGAG TGCGCAAGCT
```

-continued

```
AGATCCCTCA CACATGCAGT TCACAATAGG GTGTGCACTC CCATGAGAAT CTAACACCGC TGCTGATCTG

ACAGGAGACA GAGCTCAGGC AGTAATACTC ATTTGCCTAC CGCTCACCTC CTGCCGTGCA GCTCAGTTCC

TAACAGGCCA CGGACCAGTA CTGGTCCACG GCGCAGGCAT CAGGGACCCC TGTTGCTAGG TATAAGCATC

TGGCTGCTGC ATGTCTTCTG TGTAGCTACA TCTGTATGTG TATCTGATGA GATATAAATT ATTTGATTAT

AAATTACTTT CTTCATATTA GAGTTGTGAA TGAGTATCAC ATATAATTAT ACATAAACTA GGAATATGCT

TTTTAATAAT GTATATAAGT AAGTTTCCTT AACTATGACT TTCATCTTAG CGTAGTAAGA GGGTGCTAAG

AAATATTTGT GATGAAAATA GGCATTGGTA GAGTTGAGAC CACTGGGTGA TGAAAGAGTG TAAAGATTTT

AAAGCCTTCA GATGCTGGTT CAAGGTGAGA ATGTGATTG GGAGCAAATC AATTAACTTC TTGAAGTCTT

ATAGGGCAGT TATGAATACT TAATGTTAAC ATATGTAAAG CTCTTCTGCC CTGTATACAG TAAATGCTAG

TTAGCTATTA TGATCACTAC TAAAATGGGG ATGACATAAA CCTCATAAGG TTTTAAGTAT TATGCAAGAT

ACTATACAAA GTCCAGTAAA TATCACATTC AATTGAATCC ATGATGTCCG ATTATTTTAG CTACTTCCAA

GAGAGAAAAA AATGCTGTCA GTTTTACTGT TCTTATAGAG AGCAAGGCAG ATCCCAATTC CCAATGTGGT

AACGTGAAAA TTTTTGCATT TGAATCAACA AAACACTTTC TCCTTTCTTT CCTACTATTT AACAACTGGT

AAGTCTATAC TCCCCCAAAT CTGGAATTCT CCTTTCTTAT TCTTTTTCCT CCTACCAAGA CCGCAGGATC

TTTTACTTGG CTATAAGGGG TAAACCTCAA GTAGTACAAG TTCTCTGTAT TACTTTTATA CTCTGTCACA

GATTCCCTTT GTTTCCTCAT CTCCATGTGA ATTTAGTTAA ATTCTCAGCA TTCTGATCCT TACTATACAA

GGTAAATGAA TATAAAAACA AAACGAAACA AAAACCTCTT CCTATTTACA TAAGGCCCCA ACCTAATATT

TAGTGATATA TATTAATGTG AACAAGGAAC TAACGAAGAC TGGGAAGAAA TTCACAGACT TGAGAGAAGA

AATGGCAGGA TTTCCTGGGA ACAATTTCAT GTAACGTCAA AGGTGGTAAA AGGTCAAATA GAATGAAGAT

GGAGAATACC GGATTTTCTT ACAAAATGAT TTCCCAGGAG ATCTCATCAA ATGCACGAGG ATACCTTCTC

AGTTTCACCT AGTGAGTAAA AGACTGGTAA CATAGCTCAC TTACAATTTG GATAAACAAA ACTAAACAAA

CAACATCAAA ATTTCAGAAA AATAATAGC AAAACAGAAA TCAAACACTC AAATTTTTGG TCCTTCTGTT

TATTTCATTT TGGATACTCA GTGAATGTTA ATTAACCAGG AAACTTAAAA GTTATTTCAA TTATGAACCT

CTTCAATCCT TCATCAATTA TTTTGAGTAT TCTGGTCTTA AAAACATCTC TTTCTTCTAC AAACTTCTGA

AAGAGATGAA CACCTCCACC TACACCAAAA TAATGTGCTT TGCTGGCCAA AGTACACGT CCATTTTTAC

TTAACAGTCT AAGGAAAGTC TGGTGCAAAT TACTATAATA ATCTGGGTTG TAAATGGTTT CTGAGGTGAG

AATGAGATCA TATTTTACAA AAAGTTTTTC ACTACTTAGT ACAAGCTTAC AAAACTCAGA CCACTCACCA

GAAAAAAATC GGCATTTATA TAGTTGTGTT ACTTTTGGTT TCCTGCATCT TTTCACATCT GGCTCATTTA

CATCATTTTC TTCATCTTCC AAAGTGGAGT TAGCTACTAC ATTAGGTAAG GTTACTTCAT CAATCACCAT

ACTGTTATAA TCTTGAAAGT GAATTTCTTT GGACCCTCCC TTGAATGCAG TTATACCTAG TAAACCTGAT

CCACAACCAA GATCCAAGAC TTTTTTCCCA GCAAATTTCA CTTTGGCCTT TGTGAAATAA GCCAGGAGGT

CAAAGGTACA TTCCCAGATT TTTAAGCCTC CCTCATAAAC ACCTGTAATC AGATCAGAGT GAGAAGAAAA

GCTTTTTGAA ACTATGTTTT CTCCAGGGAA GTTCTCTTTC AACAAGATGG TTTTCACTAC TGATAACTTA

ACATGCTGGA AACCTGGTAA TGTTTCTATG ACTTTATTTT CTAACATCTT CTTTAAATCT TTAGGCATAG

CATGCTCTTT GGCAGCTCTC AAGGAGGGCT GTTTTCCATG TGGCTCCAAG TTCCTTGAAC TGCTGGCTGC

ACTGAGTGGA CTGTCTGTGT CTTGAGAGGG AGCTGCATTT TCCATTGACT TATGTTCCCA CAAGTGATCC

TGAGGCAAGT CAAATTGTTC TGCAGAACAT TTTCTGTCCC TCTCTTCTCC TTTTTGACTT TCTGAGACTG

ACAGCTCTTT TGAGGAATCC AGGGTCAAAG CTCCATCTCT AATGGGTGTT AATTCATTTT CCAGATGGTC

TTCTATAGTG AAATTAAACT GAAAGGTCAT CCTCTTATTA AATGCACACA ATCTTTAAAT TCAGATTCTT
```

-continued

```
CAACTTCTGG ATAGAATTTG ATGATACACA CAAATCTGCC TCAATTATTC AATTAGTTTT GTTGGGCCCA
ATTTCTCTTT AGCAGCTTAT ACATGGTAAC AAATATTTAG AGATATTTCC AAATGACTTT TTAGACGTCT
TTGGTCCTCT TTCCAAGCAG CTCTGGAAAG AAAAAAAAAA AAAAAAGAAA GAAAATGATG ATTAAAGCAA
AATGGCACAT TTCACTAAAG TGTAATATTA AACAGCCACC CCCACCCCTC CCTGTCCCAC CATACAGCTG
CTTTTTCTTA AAAAGTTGTG GGGAAGAGAG AGAGATAAGA GATTTGGACA CTCATACACA CCTTAAGGGT
TCCAAAGTGG GAGAAGAAAA TCAACTATAA AAACAAACAG AAGAACAACA GCAACCACCA CCACTACCAC
CTGGACAAAC ATAAAGTCCA AGATATTCAG ACAGGACAGC CTAGCTACTT GCTGTCTTTC AGCTGTCTTG
ATTTGTGTCC AACCATATTC ACCCCCTAAG CTTCCAGAAT AACTTCACTT CTGTCTTTTA CAGAAGAGGT
GCAGTATTTT ATTTTGGTAA GTCAGCGTCC CTTTAAAAAC ATGCATAGGT ATGGCCTGGT GTGTGTAAAT
TCATCCAAGA CTTCACTCCA AACATTTAGT CGAGAACAGC AGCCCTAAGT GTATAGAAGT GGGGGTAATT
TGGCAATAAT TAGTAAAGAC TAATTCGGTG GCAGAGCAAA CGCAAACTAG GGCACTGCAG TAGTTTGGAG
AGACCTGTAG AAATAAGAAG CAACTTTATT GAGAATCTTC TATCTACTGC GCTAGACACT ATACCATCTG
CCTCAATTTT CACAGTTCTG GCAAGTGGGA TCTTTGTTCC CTTTATACAA GATTTACAAT TTGGGGGAGA
GGCGGGTCAC CCAGTCCCGC GGCTAGGAAC GCGCCTCTTT CCTCTCCCAT CACGCTGCAA GGCTTGGAGT
CACTTCCGGC TGCAGGTCCC GGAACAAATC CGACCCCAGA AGTGGGACT TCTGGCCCTC ACCTCCCCAT
TTGAATGTAA TGTTTACAGT GATCCAGACC TGGGGATGCT TGCTTCCCGA CGTGTCCTGG GATCGCGCTT
CTGAAAAAGC TCACCTCACA ACGCCTCCTC CGGACCTAAA TCGCGCACCA GTGAGTCGAG TCCTCCAGGG
GCTAGAGAAG CCCGACTTTC TTTCCGGCCT TGAGGGACCC GGGCTCACCA AGAAACCAGC CGCCCTCCTC
TCTATGGTTT TGGAGCCGGC GGAGAGCGCG CAAGGGTTGG CGGGACTGCG AGTTTCCGGT CTGGGCTTTG
GCGGGTCTGG TTTGAAGCTC TCCTGTTTGA CGAAAGTATG TCTCAGGAAG GTGCGGTCCC AGCTAGCGCG
GTTCCCCTGG AAGAATTAAG TAGCTGGCCA GAGGAGCTAT GCCGCCGGGA ACTGCCGTCC GTCCTGCCCC
GACTCCTCAT ATCCTTCCTT GGTTGTCACT TCTACCTAGA GAAGGGTGTG GGCGGGTCGC GAACCTTTCT
CTTCTGTCCC TTCAGACCCA CCGCCAGGCT GGGTTATATT ACCGCGGCCT GAACCCCCTC TTTTCTTTGT
CAGTGAGTGG GATGAAAAGT GAGGGACTGG AGGGGAAGCG ACAACCGTGG TAGATTTAAG TAAGGCTTTG
GCCCTGGAAA GCCTCGCGGA CGTGTTCTGA CCCAAGGTTT TAGCAGTGGA TGTGGCGTTT TCCTCCATTC
CTTCTTTCAG TTTTTCTGTA CTCGTTGCTT GCAATTAAGT GTAAATACTT TTGCTAGTGA ATAATGGGGG
AGGCAAGGAC TGAGACCTGC GGTATGACGA TAGCTCTGGC TCTTAATAGT TTGAGGTAAA GCGAGATACT
CTGAGCTTTT GTCTCCCGTA AAAAGGGTGG TGAATATGAA TAAGGGCTTT CTTAGCGTTA TAAGAATTAA
AGGGCATAGT TCTGTGGTGT GAAATCTTTA AAAGATGTTC AGTAAATAAA AATGATTTTC CTCCTTCCCC
TCTCAGACCT CTTTTTCTTC TTTCTTTCTT TTTTTTTGAC AAGTTCTCAC TCCTCTCACC CAGGCTGGAG
TCTTTCTGAA AGAGTTCTTC CGCTTGTTGT TGGCTTTCAA CTGTTGGATT TGAGGCGCTT AGCGCCTTCT
TCGTCCGGGT GCAGCACATT CTTGATTGGT CTCATGCCTT TGTGGTTGTA AATGTGCCTG GAATCCTAGC
CTTTCATGGT AAACCATATG TATATGTATC TTTTTCACAA CATTTGAGCC CAGCTTTATA CAATTACACT
CAAAAGAAAA AAAGTAACCT TCACTTGAGA GAATCTCAAT ACTGCACAAA TATTGTGCAG CTAAAGCCCT
ATGTAATCAC ATAGAAGTCA TTCACCTAGG CATTAGCAAA ATCTCAGAAG GTGCCAAAGC CCCCTTTTTT
AGTTTTTGTG TAGGTACAGA ACTGCCGTCT TCAAGGAGTT TCAACTTGAA AACAAATAGC CACCCTCAAA
ACATTCAAAA ACACTTAAAC TGCGTGCATA ATGTGTGTGA GACATGGTGT TAGGCTTTGG GAGAACAGAG
ACACGGAACG TGATTCCTCT TCTTCCCCAC AAGCTTATAG AGAGACTTCA TTAAGTTGAA AGTCAACATT
CCCACCTAGC TTTGCACTTC AAACGACATA TTCAAAAAAG CCCAAACTTC CTCTAGTTTT CTTCATCTGA
GTAAATGGTT TCACAAACTG AAACCTTGAA TCCTCTCTGT CTCACACACC CGATCAGTAA GTTCTATTGT
```

-continued

```
TTCTGATTCC AAACTATGTC TTGAATCAAT CCGTTTATCT CCATCCTCAT TGCTACCACT CTGATTCCAA
ACCCTTATCA CCTCTCACTT GGAGTATTAA TAGTTTCCTT GTTTCTACTC ATAATTCATT ATTCCAAAAA
AGTTAAGAGG GGAAAAACAT AGATCTCGTC ATTTCCCTTT TTAAACCACT TTACCTTCAA GGTTCCAGGT
GATCTAAGCC TTGCCCTTCT CTCATACCTA GTTAATTAAC TACACTCTGT TCATGAATAC ATTAGGCTCA
CCTACCTCAA GATCTTTTTG CTCAGCCTGA TTTGTTCTCT CAGCCTTTTG CATATTTCAT GTTTATGTCT
TGGCCCAAAT GTCACTTCCT TAGAGGGGCT TTTTCAGAGC CTTCAATCTT AGGCAGTTCC CCCAAACGCA
GTCTTACACT TGTATCACAT TGGCCTGTTC AGTTTTCTAA AAAGCACATT ACCATTAAAA GAAATGCTCT
TGTTTGCTTT GTATATTTTC CACTTCTACA CATTATGTTG CAAAGTTCAT AAAGGCAGGA TGTTGATTTT
CTTCACAGCG TTACCCTCAG CACCTAGAAC AGTGCCTGAC ACATAGTAAG CATTCATTAA AGGGCTAAAA
ATATTTCATG TTTTAAAAAT ACTTGGGAGT CTAATTAGAC AATACTTTTT TCAGCTTAA TGGTAGTATT
TTAGCTTCAC TATTTTAACA AATGAAAAAT TTGCAATAAA TCTACAATGC CATTACCCCC AAAATCTTT
TTCATGTTTT GCATTTTACG TATTATTTTC CAGGCCTTAC CTGCATGTCT GCATAATCAT AACTGACTAA
TTTTGGAACA GCTGGTAATT ATTTGAGCTT TACTGAAATT TTTTCATGAG CCAATTCTA CCCTACTGAA
CTCAAATTTG AGTTAATGAT GACCTCATTT TGATTGCTGC TGTAAAAAAT AAGATTTCGG AAGAGGAATG
AATTCTTGTA TTACTGTGGT AGGACTATGG GTTTTTTTTT GTTTGTTTGT TTGTTTTGAG ACGGAGTCTC
ACCCTGTCAC CCAGGCTGGA GTGCAGTGGT GCGATCTCAG CTCACAGCAG CCAGGTTCAA GTGATTCTCC
TTCCTCAGCC TCCCGAGTAG CTGAGATTAC AGGCACGTGC CACCATGCCC GGCTAATTTT TTGTATCTTT
AGTAGAGATG GTTTCACCAT GTTGGCCAGG CTGGTCTCGA ACTCCTGACC TCGTGATCCG CCTGCCTCAG
CCTCCCAAAG TGCTGGGACT ACAGGCGTGA GCCACCGTGC CCGGCCGGGT TATTCATTTT TCTTATTAAC
ATTCTTTGAT GATTCTTATG GTGTTGTTAC AGTAAAACAT TTCTAACAAT TATTCTAACA ATTATTCTTG
ATGGTGTATA TGAAGAATTT ATTGTCGTGT ATTTGTAAGC TGCTATGTGC AGAAGAATTT CAGTCAAATA
AAGTTGGTAA GATAGGTATG TAAGTAATAT GAAAAAAGAT AGAAGGTGAT GAGTGACTTA GGTATAAATT
AAGTACAATA GAAATGTTGA GGAAAGAAAA ATTTCTTGTA ATAGAAATCG GAAGTACAAA CTGGGCATGG
TGGTGTGCAT CTCTAATCCC AGCTCCTTGA GAGGCTGGTA TGGAGGATC ACTTTAGCCC AGGAGCTTGA
GGCTGCAGTG AGGTGTGATC ATGTCACCGC ACTCCATCCT GGGTGACAGC AAGACCGTCT CTCTTTTTTT
TTTTTTTTGA GACGGAGTCT CGCCTATGCT GGAGTGCAAT GGCGCGATCT TGGCTCACTG CAACCTCTGC
CTCCCAGTTT CAAGTGATTC TCCTGCCTCA GCCTCCTGAG CAGCTGGGAT TACAGGTGTG CGCCACCATG
CCCAGCTAAT TATTTTGTAT TTTAAGTAGA GACGGGTTCT CACCATACTG GCCAGGCTGG TCTTCAACTC
CTGACCTCTT GTTCGCCCAT CTAGGTCTCC CAAAGTGCTG GGATTACAGG TGTGAGCCAC CCCACTTGGC
CCCGAGCGAG ACCCTCTCTC TAAAAAAAAA TAAATAAATA AATCATAAAC CTGTGGATTA TTGTAGCATT
GTTTCTCATC TGTCAAAAAT ATTTCATGAC TATGCATAGT TTGAAAAGGC AAGTTTGTCC CTGGGCAATT
TTCAAAATAT TTCTTTAATG TGTTTTCACA ATACTGTTTA CCTAATAAAT CTTAAGTTTT TAAAAGCAAA
ATTAAGCCAG TAATTTGAGT CCAATTCCAA TCTCTTATGA GTCATTGCTT AAATTTCAAA AGGGTTTTAT
TTTTTTTTTA GGTTTGTTCT GAGTAATGAA TACCCTATTA CTATGACTAC T AGTATCTTCC TTAATTATCC
TACTCATTGT CTCAACATTC TGACAGTTGG ATTGAGCATA TTCGTAAGTA AAATTGTTTT AACTGTATGA
TGTACTTTGA TGTTAAGGTC CGAGTCCCCA CATACCTCGG TAGATGTGTT CTTACAGTTT TGTATTCCCT
TGAAATGTAA CTGTTCTCTA TGTTACAGCC TTTATAACCT TCAGTTACTT GAAATGAACA AATTCATTCA
AATTCCAGCA CTTAAAAGTT TTAAATTACA TTTTGGATAA ATACCAAAGT GTTTTGTTGA TGATGTATGT
ATAAACAAAT TGTAAATATT AAACGTTAGT TGTTACGATT AGACCTATAT AAAACATGAT ATGCAGTCTA
```

```
CTGAATAGCT ATCAGCCTCT AACATGTTTA GTGTCATTTA GAAAATGCTT TCTAAATTGC CAAAAGCTGA
TTGTCTAGGT GATAACAAAT TTACCATTTG GAGGAAGTTG ACTTTCTCAT TTTCATGTCT TCATCAGTCT
TACTTGATGA GATTCATTCT TCTAGTCAGA AGAGAGTTTA GACTGCTCAG TTTACTCATA TTTTGAGTTA
GCTTTTTCAT TTAGAGTTCA CTTGGTTGTG GAATATTCAT TTATAATTTG AATCTACGTT GTGTAATGGG
ACCTAATTTT TTTTTCCTTT GTTTTTGTTG GAGTCTCGTT TTGTCACCCA GGTTGGAGTG CAGTGGCGTG
ATCTTTGCTC ACTGCAACCT CCACCTTCCA GGTTCAGGTG ATTCTCCTGC CTCAGTCTCC CAAGTAGCTG
GGATTACAGG CATGCTTCAC CACGCCTGGC TAATTTTTGT ATTTTTAGTA GAGATGGGGT TTCACCATGT
TGGCCAGGCT GGTCTCAAAA CTCCTGAGCT CAAGTGATCC TCCTGCCTTG GCCTCCATAA GTGCTGGGAT
TACAGGCGTG AGCCGCTGAG CCTGGCCCCA GAGTTTGTTT TGTTTTGTTT TCAAGACAAG ATCTCACTCT
ATTGCCCAGG CTGGAGAGCA GTAGTGCGAT CATAGCTCAC TGCAGCCTGA ACTCCTGGGT TCAAGCTATT
CTCCTGCCTC CATCTTCTAA AGTGCTGTGA TTACAGGTCT GAGCCATGAT GCTTGGCCTG TGTTTTTGTT
TGTTTGTTTT GGGGGACAGG GTCTTGCTTT GTCACCAAAA CTGGAGTGTA GTGGTGCAAA CATAGCTAGC
TCACTGCAGC CTCCATCTCC CACGCTCAAG CAATCCTCTC ACCTCAGCCT TCCAAGTAGC TGAGACCGCA
GGTGCGTGCT ACCATGCGTG GCTAATTTTC TATTTATATA TTTATTTTTT GGTAGACATG AGGTCTTGTC
ATGTTTCCCA GGTGGTCTTT AACTCCTGGG CTCAGACAGT CCTCCCGCCT CAGCCACCCA AGTGTTGGG
ATTACAGGCG TGAGCCACCA TGCGTGGCAT AATTTTTTTT AAGTAAATTA TTTTTTTATC TTGAGTATAG
AAGTGATTCA TGTTCATTGT GGAAAATATG AAACATATAG AAAAACAGAA AAGATTACAA AACATCTAAT
CTGAAATGGT TAAGATTTTG ATGAGAACAG TCTCATCTCA TTTCCGTATA TTCCTGCCAG CCTATCCATC
ATTCTTCGTA CATGTTTATC TACATTAAAA TTGGTGTTAT ATTTTGGAAA CTTTTTGTTT AACTACATTG
TGAACATTTT TCATGTTTTA AAATGTCATT TTAATGATGG CAGATCCTAT TCAATAGATG TACACACACC
TATTTAACTG GTCCACAATT GTTGGATATG TAGGTCGTTT CCTTTCTCTC TTTTTTTTTT TTTTTGGCTA
CTACTTAATA GTTTCTCTGT ATAGAATGTG GTATTTTGAA AGTGTATCAA GCTTTAGATT GGTAGTATTC
TTGCATTTAA TAAAGGGCAG TGGCCTTTGT TGACTGACAT GACAATATTT TTATAAAATT TGTTATTTGC
TTTACAGAAA TTTTGAAAAT TATTGTAGAA ATGTTTTTAC CTCATATGAA CCACCTGACA TTGGAACAGA
CTTTCTTTTC ACAAGTGTTA CCAAAGGTAT AATACTATTA CCTGAAAATA CATGTTATAA GGAATCTAGC
CTCAGTCTTA GATGATTTAT TATTAATTAT GGCTCTCTTT TTCTAATATA TCAAATATAT TCAAAATAAA
AATAAGGAGT AAGTAGATCT CATGTGAGAC TATAATGGTG TTAGTGTGAT CATTAGGCAG TTAAAAACTG
TTACAGGCTG GGCACGGTGG CTCATGCCTG TAATCCCAGC TCTCTGAGAG CTGAGGTGG GCAGATCATC
TGAGGTCAGG AGTTCGAGAC CACCCATGGT CAACATGATG AAACCTCGTC TCTACTAAAA GTACAAAAAA
TTAGCTGGAC ATGGTGGCAG GTGCCTGTAA TCCCAGCTAC TTGGGAGACT GAGACAGGAG AATTGCTTGA
GCCTGGGAGG CGGAGGTTGC ATTGAGTCAA GATCGTGCCA TTGCACTCCA GCCTGGGCAA TAAGAGCGAT
GCTCCGTCTC AAAAAAAAAA AAAAAAAAAA AAGAACTTAT ATTTTCAGAT TGTGTGGTTC CTTTACTAAC
TGAATTTAAA TTATTTGTAG TCAATTTTAA ATGCTCTTGT ATTTTAAAGC CACTGTACTC CAGCCTGGGT
GACAGAGTGA AACCCTTAAT TCAAAAAAAA AAAAAAAAAA AAGAAAAGCT GGAATATTGG CAAAATCAAG
TAACTAAGAG AAAACATTAA ATTCACAGAA TACATTATTA CATTTAGAT ATATATGGTA TATGTTTTCT
CTGAAAAGCA CAAGCATACC TTTTTTGTTT TAAATGGAGG GAACTAAAGA TACTTTGGTG CCAAAATGAA
ACATTATTTG TAATTAATCT CTTATTGAAA TGGGTTTCTA ACTTTAGCTT TGAATCGTAA TCTTTCAAAT
TTCTTGTACT CATAGTCACT TGATGATTCT CTATCTGAAA TATTTCTTAG AATTTGTTCT TGACCACCAG
AAAAAGATTC AACTGTTACA TAGATGAAAA TGGATGTTGA GTGTTAACAG GCCTATGGGA AACAGTATTT
TCTTTAGCTA CATTGTATTG TTGACTGTGT TGCTATTCTT ATAATGTTTA GGTCATTTAA ATTGTTAGAA
```

-continued

```
AGATCCAAGT ATTAAGATCT AGGGTGGCTA ACTTTTCACA GACAAAAAGC TTGTTTGTAA GGTCATTTAC

TATACCCTTA ATTCAGGAAG GTTAGCTTGA ATTGGGTCAA AAGGAAACTG GTTAGAAAAT AAGTGAGTAG

TGAATAGGCG ATTCAGTGCA AATTCCTTCC AGAAAATACC CTTGTAAATG ACTGTATGAA TGTGGATTCT

TCAAGACAGT CAAATTTATT GTGCGAAAGT AATACTTTTA TTTTTTGCAT CTCTAAAACA TGAACTTTGA

GTGATTTTTT AAAAAAATTG ATGCTATTAA ATAGATTCAA ACCATAGAAA TGGAAAATAA ATTTCTGTTT

GGGGCTTTTG GGGGATTAT GTTGTAAAAA TACCTTTTCT CTGTATTTTG TGCTTAATTA GGTACAATTG

TTAAGCTAGA TGATAGCCTG TGGATGTTAC TAGTGCAAAA TCAAATTATC GTATTGTGTT TTCTCTGTAA

AGTTTTGTCT TGTCTTTTCT AGTGATTTCT CTTATTCCTG TTTATTACTT GATTTGTTTT TACAGACTGT

GAAATTATTC GATGACATGA TGTATGAATT AACCAGTCAA GCCAGAGGAC TGTCAAGCCA AAATTTGGAA

ATCCAGACCA CTCTAAGGAA TATTTTACAA GTAAGTCAAA TGTATTAGAA AGCAGGAGAG AGAGGGAGCT

TAAAGAATGT CAAATTTTTT ATACTGATAC TGATTAGCTA TGTATTCCTA TGTAATGGCC AATGTTGGA

ATTAAATTTA TAGAATTAAA GACGTGAATA TAGAAACATG AATTCTGAAT AATAAACTCT TATAAGAAGA

GAAGTCATCA AGCTAGCTGA CCCTACCTGT ATTTTCAAGG ATATGTGTGG AACACCTGCC ATGTGTTTTG

AAGTTTGTGT TAGTATTCTA AATGGCTAGA CAGTTGTTCC AGTATTTGTA GTTCTGATAG ACTAAAGTTC

TGTGAAAAGA GGAAGAGACT GTGTTTTGTT CATTGCTGTA TTTGTAGCAC CCAGCATGCT GACTAATACC

TTTTCAGTGC ACAAAAAATA TATTCTAAGT GAAATTTCCT TCCTTATTCA CAGACAATGG TGCAGCTCTT

AGGAGCTCTC ACAGGATGTG TTCAGCATAT CTGTGCCACA CAGGAATCCA TCATTTGGA AATATTCAG

AGTCTCCCCT CCTCAGTCCT TCATATAATT AAAAGCACAT TTGTGCATTG TAAGGTGAGT AAAGGTCTAA

TTATACTTTG AATGGTATAT AATCAATGTG CATAGGGGCT GAGTAAAATA ATGTTTGTAT AAGATTTTAC

ATTTTAGTCT ATATTATTGA AATAAACTTT TCCATAGAAT AAAGAACATG TAAGTAAATA ATTGTTGCAA

AAAAAGTGGT TTTAAGGAAG TCATTAAAAG TGGCTTTTTG GGGTTTTTA GTTTTATCTT ATTTCCCCTC

TATAAAGAAA GAAGTTTTAA GAATTTGTGT TGAGACAGAC ACAGGGATCC TGAAATAGTT ATGTCATGTT

GCATTGACCA ATATTCAATT ACCATTATGA TTAGATGTCA GAACTTCCTT TTATAAAGGA AAGTTAATCC

TTATTTAGTC CATCTCTACA TGCCAGAGGT AGCCTTGAGG CACAAAAGCT TGCCTAGAAT TTATGGGTCA

CAGACAGTTT TAATATTGCT ATTTGTTGGG CGAATGAAAA TCACTAGTTA ATTAATACCT CTCTTTGCTG

ATAGGATGCT AAAAATGTCA CGCACCTGGC CTAATGTTAC CCTTTTTTAG TTCTGTATTT GCAAGATCAT

GGAAGTCAGA ATAATATTT TATACATGCT TGCATCTCTT GAAGCACACT ATATTTAATG GATGTTCACT

AAACAATGAA TGAATATGTG ATTCAGTAAA TTTATGATCT CTAATAGTAT GAATTAAAGT AAATTTGGCT

CTTGAGCTTT GATTTGTTTT TTCTCTCATT TTTATTTATC CGTAATCAGA ATAGTGAATC TGTGTATTCT

GGGTGTTTAC ACCTAGTTTC AGACCTTCTC CAGGCTCTTT TCAAGGAGGC CTATTCTCTT CAAAAGCAGT

TAATGGAACT GCTGGACATG GTTTGCATGG ACCCTTTAGT AGATGACAAT GATGATATTT TGAATATGGT

AATAGGTGAG TGAAGAAAAC TTTCTGCTTA GTATATGGTG ACTATAAATC ATGTATCAAT TAAAATTGTC

TCTAATGATT CATGTTATTT TCTTACTAAT TATGCATTAA AATTGATTTA AATCTTACCA AATAAATTTT

TAATCTTGAA ATTTGGAATT TGTAAAATTT ATTTTGGGTA CCTTAACCTA GATTTGCGTA TTTAGTTACT

GTAATTTCTC CACAATGATT AACTTATATA ACTTTATAAT CTCTGAGGTT GTCCATATTC AGAGACAATA

ACTTTCACAT TTTTTTAACC ATAACTGATA TTGAGATGCA GTTTATATTT CCTTCCAGAA TACATATAAA

TACGTGCATA TGTGTATGTA AATATGTCTA TTCTCATATA CATATTATAA TGAAATAACT CATTTTACAT

GTGATGCACT TTATACTAGT TTATTTTTAT TTTATTTTAT TTTTTGAGA CAGAGTCTCA CTGTGTAGCC

CAGGCTGGAG TGCAGTGGCA CAATCTCGGC TCACTGCAAC CTCGCCTCCC GGACTCAAGC GATTCTCCTG
```

```
CCTCAGCCTC ATGAGTAGCT GGGATTATAG GCGTCCGCCA CCACACCTGG CTAATTTTTG TATTTTTAGT
AGAGACAGGG TTTCACCGTG TTGGCCAGGC TGGTCTTGAA CTCCTGACCT CAGGTAATCC ACCTGCCTCA
GCCTCCCAAA GTGCTGGGAT TACAGGCATG AGCCACCGTG CCCAGCCAAT ACTAGTTTAT TTTTAAAGAA
TTGCTGGTCG TAACACACTT CATTGATTTT ATCACTCATT AATGGATTAT GAACAAGAGT TTGAAAAACA
ATATAAAGGC AAAGTTTGCA TTCAAAACTT TGGTATAAAG AGAGTAAGTT GGTTTTGTGC AGTGTATCAG
GCACCTGTTG CTCTGCAACA CACCACCTCA AAATCTATTT ATTCACTATT TATTTATTCA TGATTCTGTG
AGTCTGCAGT TTAGGGTGGG ATGTCCTGAG ACAACTTTCT CTGATCCACC TGGGGCACTA GCTCACCCAT
GTGACTTCAG TGACTTCATT CACATCTGGC TGTTGGCAGA GGCAGAAGTA CTTGAGAAAG CCATGTGCAT
CATCCAGCAG GTTCACCCTA TCTCAGATAC CTGATGCCAG TGGTTTCAGG GTTTCTAAGA GTAGCAAAAG
TGTGAGCAGG TCGCTGTGTG CTAGCACTTT TCAAGTTTCT GCTTGCCTTA ATTTTATTAT TGTCCCCCGG
GCCACAGCAG GTCATAGCGT TTAGCCCAGA GTCATTGTAG AAAAGTGTGG ATTCACAAAG GCAGTCATT
GTGGCCATTT TTATAAATAA TCTACCACAG ACTGAGTAAA AGCCTTGCAT GAATACCATG GATATTAATT
TGAATTCTTC CTTTTTAGAT TTTCTTTCCT TAGCAATTTG TTTTGTCATT TTGGATTAGA ATTATATCTG
TAGAATATTT CAGTTATAAT AGGGTACAAC TTTTATTCCA CTGAACATCT TTAGTTTTAT TTAGGTCATC
TGGTAGGTAT AAACTTCAGA AGTTAATATT CAATATTTAT AAAAACCATT AACAAGTGTG ACACTTAAAT
AGTTTAAATA ATTCTTTTGA CACAACTGTT TCCAAGTTGT GTTACGTATT TTAATTCAAT CAAATGTTGA
AATTGTTCAG TAGATAGTTT TAATTATAGG AGAAACTCAC CCCCATGACA TTTGGATGTC TTAAAAGTTC
TGTTATCTTT CTTTGCAGTT ATTCATTCTT TATTGGATAT CTGCTCTGTT ATTTCCAGTA TGGACCATGC
ATTTCATGCC AATACTTGGA AGTTTATAAT TAAGTAAGTT TGTTTGTTAT TTTTTACTTT TTAGAAAATG
TTTTCCATAT TCCCCAATCT TAATTATTCA TGATTCTTTA GATTGCATTT AAAACATTTT GTGTGAATTT
AATGTTCACT GACACTGCTG TCTGATAATC CAGATATTCT ACATGTAGCT CTCAAGCCAA ATTGGACTTC
TTTACCCTGT GGCCTCTAAA ATTAAAAAAA ATGTTCTTCC TAGTTAGCTA GTACTTCAGA ATAATGGGC
CATGGGCCAG ACTAGAACTT AACCACTTTT CTTCTGCTAC TGTTGTTTAA CCAGCTATCA AGTATCCTAT
TTCTAGGATT AGATAAATTG ATAACTATAA TTAAAACTGA ATATAATCTT TTCATTAGGT ACTTTTAAGT
TGTTCACACT TAATTCCATT TGTACAGTAA TTTTAACTTT CTGAAACTGA AGCATTTTAA AGGGTCACCA
GGGATAGTGC CTGTAGCATT CATCAGATTC TTAGGGGTGA GAGGAGATGT GGTTGAGATG TAAAAATGGT
TAAGAATATC TACTTTATAC ACATACATAA AACATTAAAG GTCAGTGTAT TTTCAGGTCT TAGGTACTTT
TCTTGTACTA CCAGGACATT AAGTTGCCAT TCAGTGGTTA AGAGTGTTGC CTGGGAGCTG TATCACATGT
GCTTAAATCC ATTCTTGAAA TCATTTACTC CTTCTGAGCC CTTGGGCTAT TTGGTTAATT CTCTGAACG
TTAGTTTGCT CATCTGAAAA TGGAAATAAT AATAGCAACT TCTTGACAGG GTTATAGTGA GAATTGAGTT
CATCACTGTG AAATGCTTAG AAATGTGCAT GACACATAGT TAATACTCAA GGAATTAGCC ACATCACTAT
CATCATCACT GATTATCTTC CACTCTTACC CTCTTCCAGT TCATTTTCTG CCCAGCAGAA TGATCTTTTA
AAAAGTAAAT CAGATCATGT TACTCTATTG CTTGAAGTCT ATCCCATTTG ATTAAGAATA ACAACCTAAT
CCTCTGTGGA TGCTGCCTCC TTCACCAGCC TGTCTCATGC TGCTCTCCCT ACTCTTAGTT CCTCAAACAT
ACCAAACTCT CCTGTCCCAG AGTCTTTTCG TGGTTTTTCC ATCTGCCTAG GATGCTTCTC TCTCCTATTT
TGTGTACCTT GCTAACTCCT GCTTACTGTC TTTCAGTTCT CAGCTTAAGA GTTATATCTT CATGATAACA
TTCTTTGATA TCCTTACCCT AAGATTAAGT TAGATTGATA TCCTTACCCT AAGAATAAGT TAGATTAGGT
CTCTCTATTG TAGCACCTTA GACTCTGTCA TTTGACAAAT CACAGCCCTA ATTAATTATT CTTAAAATTA
TTTAACATTC TCTCTCATGC TAGACCACAA GTTTCATGCA GGTAAGGCGG AGATTGTGTC CATTTGTTTG
ACCCCTTTGT CTCCAGGGCC TGGTAGAATG CCTCATACAT AGTAAGAATT CAATTAATAT TTTACACAGA
```

```
GAAAAAATTA GCAACTTATT TAAACAAATA TAACTGCTTC AGAGGTAAAC TGGGCACATC TTAGTTATAT
TATGTGATAT ATGATGCTTT TGATTGTTT TTTTAAATGT TCTACAAGGT AGATATTGTT AGAGGTCCTA
AGTTACTTGA TGTGTTACTT GTGGTGATTG TATTCTTTTC TTTTTATTCA TTTAGGCAGA GCCTTAAGCA
CCAGTCCATA ATAAAAAGCC AGTTGAAACA CAAAGATATA ATTACTAGCT TGTGTGAAGA CATTCTTTTC
TCCTTCCATT CTTGTTTACA GTTAGCTGAG CAGATGACAC AGTCAGATGC ACAGGTAAAA TTTGGGCTAA
TAGCATTTTA AACAGCAACT CTTATTTTCT TTGGCAGTTA GTAAATCTCA TTTGAATGTC TGGGTCAGTC
TATTTAAGAG GATTTAATT TATTTCATTT GGGTGTTTTT TTTTGATCTG TGGGATTATT TATATCCCAT
AATTACTTTT CACCCAGAGC ATTGTATTAG ATTCCTAACT GCTGTCATTG CCTCTGGGGT CTGCCTGGCT
CCCTCTTTGC TTGGTAACTG GTTGGTCACA GCATTCTTCT CAGAATCCTT TCATTCTTTT CTGCATGAGA
ACAAAAATTC TTTTGTTCAT ATTTGTATAA GATCTGATAT AGCTGCAATC AATCTTGCAT TTTTTCTTCA
CCAACGCATT GCGACCTTTA GGGATACAAG TATGTTTGTG CATGTATATG TATGTATCAG TCTTTTAAAT
TTGATATAGT CATACATTTG TTTTTATTTT GAAAAGTTAG AGTGTTGAAT TGGTATCCCA TTTATGAAAC
ATTATATTCT AAAAATTTGT AGTACGATTA TTGGGAATTA TAACTCATTT TCCTGTAACA CTGTTATACA
TAGTACCTTT TGCTTTCAGA CTAGCCCTCA ATTTTATTTA ACTATAGTAG TCCTAAATTA TAAGATTAAT
AGTACTCAGG ACCTAACAGT TATATGTCAT TTGTTTTTTT TTTTTTTGAG ATGGCGTCTC ACTCTGTCAC
CCAAGCTGGA GTGCAGTGGT ATGACCTTGG CTCACTGCAG CCTCTGCCTC ACGGGTTCAA GGGATCGTTC
TGCCTTAGCC TCCTGAGTAG CTGGGATTAT AGGCGCCTGC CACCACGCCT GGCTAATTTT TTTAGTAGAG
ACGGGGTTTC GCCATGTTGG CCAGGCTGGT CTCGAACTCC TGACCTCAGG TGGTCCACCC GCCTTGGCCT
CCCAAAGTGC TGGGATTACA GGTGTGAGCC ACCGCGCCCA GCCTATATGT AATAATTTTA ATGGGACCAT
GAATTGAATA TTTCTTCCTT GAATAGCAAT GACATAGCCC CTTCTATTGT ACATCTGCAA GCTGATACAG
GGAATTCCTT TGTACCTGCG CTCTTCCCTG CCAGTCAGCT ATGGGGGTGA AAGTGTAGGG GTTCATCCAA
GTCCTAAAAC TGGTAGCAAC TCCTAGGGCA GGGCTGATCT GGAAGGACAG ACCCTAGGGG AGGGTGGAAC
TTTAAAAAGA AGTTCTGAAG GTAGTAAGAA GGAAATGAGG AGTAGTGTTA GGAAGGGGCT AACTTTTTC
```

```
TTCTTGCTTC TCTTCTTTAT CTCACCTGCC CCTCCCCTTG TATCCCTTCT TCCTTTTTCC CTTTCCTTTT
TTGTCCTCAC TTCATTCGTG CATCCTTTCT GATTCCTCTT ACCTTGCTAA AAGGAGAAGT TTGTTTGGGT
ATCCTATATC AATGGCAGGA AGGTTGTTTT CTTCTTTACC TTTATCCTAT AGATTCATAT TCTCAACACC
AACCTCCTCC TTTTTCAGTT TCCTTCTTGC TTCTCTTGAC ACCACAGAGT TTGCAGCTAG TACTTGGAGA
GGAAAATTAA ACAGAGATAC TTGGACCAAG AGTAAGATGA AGAAAGTCTA AACAACAGTA TAGTCTATAG
TGGCAAGAGA GAGTATGGGG GCTGCTTAGC CAGGGTGGCT GTACATAAAG TATATCTTCA GTTTATATAA
ACTGCTTATA GATGGAAATC AGAAAATTTA AATTCTCTTA ACTGTCCAAG AAAATTCTCA TTTTTTCAAA
TTTGGGACTG ATAAATGTGA CCAGTTCTGC TTACTGTCCA TTGCCTGAAA TGGAGCTTTG AGGTGGACTG
TATAATTTCT TCAATCTTAA CTCCAAATTC TGATCAGCGA CGCCCTCTGC TGTTCACTAT AATATTTAT
TTACCAATCA AAGTAAAGTA TTGAAGTTTT CCTGGCAGTT TTCACTTTGT GTTTTAGTCC ATTTAGGCTG
CTATAACAAA ATCCCTTAAA CTGGGTAAGG GATTATAAAT ATTAGAAATT TATCTCTCAC AGTTCTGGAA
GCTGGGAAGC CCAATATCAA GGCACCAGTA GATTTGGTGT CTAACGAGGG TGTGCCGTCT GCTTCAAAAA
TGGCCCCTTG TTGCTGCATC CTCACTTAGT GCAAGGGGCA AGACAGCTCC CTTCAACCTC TTTTATAAGG
GCACTTATGT CATTCATGAG GGCAGAGCCC TCATGACTTA ATCACTTCCC CAAAGGCCCC ACCTCTTAAT
```

-continued

```
AGTATCACAT TGGGTGTTAG GTGTCTGGGA GGACACCAAT CTTCAAGCCA TATCATCTCA CTTGGAAAAA

AGTCAAAATA AAACCAGTAG ATTTAATTAA TATTACACTA TTTATAGAAG CATGTGATGT ATCATTCCTT

GTATTAATTT CCTGGGGTTG CCGTAACAAG TTACCACAAA CTAGGTGGCT TAAAACAATA GAATTTTATT

CTCTCACATT TCTAGAGGCA GAAGTTCACA GTGTGTCAAT AGGGCCATGT TCTCTGGAAG GCTTTAGGGG

AGAATATATT TCATATCTTT CTCTTAGCTT CTCGGTGTCA CTGCAATCC TTAGCTTACT TTGGCTTTCT

GTGTCTTCAC ATCATCTTTT TATAAGAACA CCAGTGATAG TGATTAAGGG CATACCTTAC TTTAATATGA

CCTCATCTTA ACTAATTATG TCTTCAATAA CCCTATTTCC AAATAAGGCC ACATTCTGAA GTATTGGGAG

TTAGAACTTA AAGCTTTTTG GGAGGGACAC AGTTCAACCC ATAACAACCC CTAAAATCGA TATTTATTCT

CAATTAAGTC TTGAAATTGG TTTCAAAAAG AGAATATTCT ATTAGAGTTT TTAATGTATA GTTTTAACAT

ATAGTTCTTT AGCCCCCAAT TTTTTTTTTT TTTTTTTTTT TTTTTTTTTT TTTTTGAGAC GGAGTCTCGC

TCTGTCGCCC AGGCCGGACT GCGGACTGCA GTGGCGCAAT CTCGGCTCAC TGCAAGCTCC GCTTCCCGGG

TTCACGCCAT TCCCCTGCCT CAGCCTCCCG AGTAGCTGGG ACTACAGGCG CCTGCCACCG CGCCCGGCTA

ATTTTTTTGT ATTTTTAGTA GAGACGGGGT TTCACCTTGT TAGCCAGGAT GGTCTCGATC TCCTGACCTC

ATGATCCACC CGCCTCGGCC TCCCAAAGTG CTGGGATTAC AGGCGTGAGC CACCGCGCCC GGCCTGCCCC

CAATTATTTA GTTTTTCTAT AAACAGGGAA ATTTATTTGT GTGGCCCTTA GAACTAATTT AATTTCCACT

CTAATTCCTA CTTATGTTTA TATAATGCTT TTAGAAATTT GTATTATTCA GAAAATAAAC ATATACTATT

GTATCTGTTG CCTACACTTA GATTTTATTG CCTGCTATAT TTAAATTTTA TTAGTATTTT AATTGTTTTA

TTAAAGAAAG AATGTGCCTG TAATCTCAGC ACTTTTGAGA GGCCAAGGCA GAAGGATTGC TTGAGCCCAG

GAGTTTGAGA CCAGACTGAG CAACACAGGG AGACCCCCAT CTCTACAAAA AATAAAAAAA TTCTCCAGGC

CTCATGGCAC ATACCTGTAG TTCTAGTTAC TTGGGAGACT GGGGTGGGAG GATGCATTGA GCCCAGGAGA

TTGAGGCTGC AGTGAGCCAT GATCAGGCCA CTGTACTCCA GCTTGGACAA CAGAGTGAGA GCTTGTCTAG

ATAGATAGAT AGATAGATAA TCTAAATAGA TAATAGACAG ATTATCTAAA TAGATAATAG ACAGATTATC

TAAATAGATA ATAGACAGAT TATCTAAATA GATAATAGAC AGATTATCTA AATAGATAAT AGACAGATTA

TCTAAATAGA TAATAGACAG ATTATCTATC TAAATAGATA ATAGATTATC TAAATAGATA ATAGATAGAT

AGATTAGATA GATAGATAGA TAGATAGAGC TTGGACAACA GAGTGAGAGC CTGTCTAGAT AGATAGAAAC

AAAGAAAGAA AGAAAGAATG GTGCTCATAT TTTAAAGCAT TGAAAAATGG TCTTCCTTGC TTATATTACC

CACACCTTCT TTGTTGGCAT TAAGATGCAA ACTTTGTTTT AAACAGTTGA GTAAATCAAA GATGGGACTG

TTAAGTTATT TGTGTTATTT ACCTGCTTTT TGAAAATGTA AAAATAAAAC TCTAGGTTTA ATTAGTAGTA

TGCTATTTAG TAATGAAGTA AAGCTAGAGG CTTCGAACAA ATCTTGTGTA ATTTCCTCTT GAATGAGAGA

GAAAATTTAA AGTAAGCAAA CAAATAAGTT GTGTGTCACC ACTCATTCAG TCATTTAACA AGTATTTCCA

GAGTACTTAT TCTGTGCCAG GAAATGTTGT AGGTGCCCTC AACAACTTAG AGTCTAGCCT GAGACACAAG

TAAGTAGGTA ATTATTATAG AATGGTATGA TCTTTGGAGG ACTGGGTATT GGCTGGCTCA TGGGAGTACA

AGATAGGTAC CCAGTGATGA AGTCAGGAAA GGTTTCTTAT GGTGATATGA TGACGTCTAT GCTGATTATA

AGGTCAGTGT AGAATAAACT TTGTGCTTTT AAATTTGCAT AGCACTGTAT TAGAGAGTTC ATCTTCAAAA

TAATCGAAAA GGCTGAGTGT GGTGACCCAT GGCTGTAATC CCAGCACTTT GGGAGGCCGA GGTGGGCAGA

TTGCTTGAGC TAGGAGTTCG AGACCAGGCT GGCCAACATG GTGAAACCCC GTCTCTACTA AAAATACAAA

AATTAGCCAG GAGTGATGGT GCGCACCTGT AATGCCAGCT ACTTGGGAGG CTGAGGCAGG AGGATCACTT

GAACCCAGGA GGTGGAGGTT GAAGTAAGCC GAGGTCATGC CACTGCACTC CAGCCTGGGC AACAGAGTGA

GACTCCATCT CAAAAAAAAA AAAATGATC AAAGAAAGGT GAATTTTCAT CTACCCTATT TCTGCTGAGG
```

```
AAAATGGACT ATTTTCAAAT ATTTTTAATA AGGGTCAAAA TGAGGGATC-3'  (FRAG. NO: _ ) (SEQ. ID NO: 2480)

5'-CCTGAGACAG AGGCAGCAGT GATACCCACC TGAGAGATCC TGTGTTTGAA CAACTGCTTC CCAAAACGGA

AAGTATTTCA AGCCTAAACC TTTGGGTGAA AAGAACTCTT GAAGTCATGA TTGCTTCACA GTTTCTCTCA

GCTCTCACTT TGGTGCTTCT CATTAAAGAG AGTGGAGCCT GGTCTTACAA CACCTCCACG GAAGCTATGA

CTTATGATGA GGCCAGTGCT TATTGTCAGC AAAGGTACAC ACACCTGGTT GCAATTCAAA ACAAAGAAGA

GATTGAGTAC CTAAACTCCA TATTGAGCTA TTCACCAAGT TATTACTGGA TTGGAATCAG AAAAGTCAAC

AATGTGTGGG TCTGGGTAGG AACCCAGAAA CCTCTGACAG AAGAAGCCAA GAACTGGGCT CCAGGTGAAC

CCAACAATAG GCAAAAAGAT GAGGACTGCG TGGAGATCTA CATCAAGAGA GAAAAAGATG TGGGCATGTG

GAATGATGAG AGGTGCAGCA AGAAGAAGCT TGCCCTATGC TACACAGCTG CCTGTACCAA TACATCCTGC

AGTGGCCACG GTGAATGTGT AGAGACCATC AATAATTACA CTTGCAAGTG TGACCCTGGC TTCAGTGGAC

TCAAGTGTGA GCAAATTGTG AACTGTACAG CCCTGGAATC CCCTGAGCAT GGAAGCCTGG TTTGCAGTCA

CCCACTGGGA AACTTCAGCT ACAATTCTTC CTGCTCTATC AGCTGTGATA GGGGTTACCT GCCAAGCAGC

ATGGAGACCA TGCAGTGTAT GTCCTCTGGA GAATGGAGTG CTCCTATTCC AGCCTGCAAT GTGGTTGAGT

GTGATGCTGT GACAAATCCA GCCAATGGGT TCGTGGAATG TTTCCAAAAC CTGGAAGCT TCCCATGGAA

CACAACCTGT ACATTTGACT GTGAAGAAGG ATTTGAACTA ATGGGAGCCC AGAGCCTTCA GTGTACCTCA

TCTGGGAATT GGGACAACGA GAAGCCAACG TGTAAAGCTG TGACATGCAG GGCCGTCCGC CAGCCTCAGA

ATGGCTCTGT GAGGTGCAGC CATTCCCCTG CTGGAGAGTT CACCTTCAAA TCATCCTGCA ACTTCACCTG

TGAGGAAGGC TTCATGTTGC AGGGACCAGC CCAGGTTGAA TGCACCACTC AAGGGCAGTG GACACAGCAA

ATCCCAGTTT GTGAAGCTTT CCAGTGCACA GCCTTGTCCA ACCCCGAGCG AGGCTACATG AATTGTCTTC

CTAGTGCTTC TGGCAGTTTC CGTTATGGGT CCAGCTGTGA GTTCTCCTGT GAGCAGGGTT TTGTGTTGAA

GGGATCCAAA AGGCTCCAAT GTGGCCCCAC AGGGGAGTGG GACAACGAGA AGCCCACATG TGAAGCTGTG

AGATGCGATG CTGTCCACCA GCCCCCGAAG GGTTTGGTGA GGTGTGCTCA TTCCCCTATT GGAGAATTCA

CCTACAAGTC CTCTTGTGCC TTCAGCTGTG AGGAGGGATT TGAATTATAT GGATCAACTC AACTTGAGTG

CACATCTCAG GGACAATGGA CAGAAGAGGT TCCTTCCTGC CAAGTGGTAA AATGTTCAAG CCTGGCAGTT

CCGGGAAAGA TCAACATGAG CTGCAGTGGG GAGCCCGTGT TTGGCACTGT GTGCAAGTTC GCCTGTCCTG

AAGGATGGAC GCTCAATGGC TCTGCAGCTC GGACATGTGG AGCCACAGGA CACTGGTCTG GCCTGCTACC

TACCTGTGAA GCTCCCACTG AGTCCAACAT TCCCTTGGTA GCTGGACTTT CTGCTGCTGG ACTCTCCCTC

CTGACATTAG CACCATTTCT CCTCTGGCTT CGGAAATGCT TACGGAAAGC AAAGAAATTT GTTCCTGCCA

GCAGCTGCCA AAGCCTTGAA TCAGACGGAA GCTACCAAAA GCCTTCTTAC ATCCTTTAAG TTCAAAAGAA

TCAGAAACAG GTGCATCTGG GGAACTAGAG GGATACACTG AAGTTAACAG AGACAGATAA CTCTCCTCGG

GTCTCTGGCC CTTCTTGCCT ACTATGCCAG ATGCCTTTAT GGCTGAAACC GCAACACCCA TCACCACTTC

AATAGATCAA AGTCCAGCAG GCAAGGACGG CCTTCAACTG AAAAGACTCA GTGTTCCCTT TCCTACTCTC

AGGATCAAGA AAGTGTTGGC TAATGAAGGG AAAGGATATT TTCTTCCAAG CAAAGGTGAA GAGACCAAGA

CTCTGAAATC TCAGAATTCC TTTTCTAACT CTCCCTTGCT CGCTGTAAAA TCTTGGCACA GAAACACAAT

ATTTTGTGGC TTTCTTTCTT TTGCCCTTCA CAGTGTTTCG ACAGCTGATT ACACAGTTGC TGTCATAAGA

ATGAATAATA ATTATCCAGA GTTTAGAGGA AAAAAATGAC TAAAAATATT ATAACTTAAA AAAATGACAG

ATGTTGAATG CCCACAGGCA AATGCATGGA GGGTTGTTAA TGGTGCAAAT CCTACTGAAT GCTCTGTGCG

AGGGTTACTA TGCACAATTT AATCACTTTC ATCCCTATGG GATTCAGTGC TTCTTAAAGA GTTCTTAAGG

ATTGTGATAT TTTTACTTGC ATTGAATATA TTATAATCTT CCATACTTCT TCATTCAATA CAAGTGTGGT

AGGGACTTAA AAAACTTGTA AATGCTGTCA ACTATGATAT GGTAAAAGTT ACTTATTCTA GATTACCCCC
```

```
TCATTGTTTA TTAACAAATT ATGTTACATC TGTTTTAAAT TTATTTCAAA AAGGGAAACT ATTGTCCCCT

AGCAAGGCAT GATGTTAACC AGAATAAAGT TCTGAGTGTT TTTACTACAG TTGTTTTTTG AAAACATGGT

AGAATTGGAG AGTAAAAACT GAATGGAAGG TTTGTATATT GTCAGATATT TTTTCAGAAA TATGTGGTTT

CCACGATGAA AAACTTCCAT GAGGCCAAAC GTTTTGAACT AATAAAAGCA TAAATGCAAA CACACAAAGG

TATAATTTTA TGAATGTCTT TGTTGGAAAA GAATACAGAA AGATGGATGT GCTTTGCATT CCTACAAAGA

TGTTTGTCAG ATGTGATATG TAAACATAAT TCTTGTATAT TATGGAAGAT TTTAAATTCA CAATAGAAAC

TCACCATGTA AAAGAGTCAT CTGGTAGATT TTTAACGAAT GAAGATGTCT AATAGTTATT CCCTATTTGT

TTTCTTCTGT ATGTTAGGGT GCTCTGGAAG AGAGGAATGC CTGTGTGAGC AAGCATTTAT GTTTATTTAT

AAGCAGATTT AACAATTCCA AAGGAATCTC CAGTTTTCAG TTGATCACTG GCAATGAAAA ATTCTCAGTC

AGTAATTGCC AAAGCTGCTC TAGCCTTGAG GAGTGTGAGA ATCAAAACTC TCCTACACTT CCATTAACTT

AGCATGTGTT GAAAAAAAAA GTTTCAGAGA AGTTCTGGCT GAACACTGGC AACGACAAAG CCAACAGTCA

AAACAGAGAT GTGATAAGGA TCAGAACAGC AGAGGTTCTT TTAAAGGGGC AGAAAAACTC TGGGAAATAA

GAGAGAACAA CTACTGTGAT CAGGCTATGT ATGGAATACA GTGTTATTTT CTTTGAAATT GTTTAAGTGT

TGTAAATATT TATGTAAACT GCATTAGAAA TTAGCTGTGT GAAATACCAG TGTGGTTTGT GTTTGAGTTT

TATTGAGAAT TTTAAATTAT AACTTAAAAT ATTTTATAAT TTTTAAAGTA TATATTTATT TAAGCTTATG
```
TCAGACCTAT TTGACATAAC ACTATAAAGG TTGACAATAA ATGTGCTTAT GTTT-3' (FRAG. NO: _ ) (SEQ. ID NO: 2479)

5'-CCT TGC CTG CTG G-3' (FRAG. NO: 1739) (SEQ. ID NO: 1752)

5'-GTT GTC CC-3' (FRAG. NO: 1740) (SEQ. ID NO: 1753)

5'-GTT CTT GGC TTC GTC TGT C-3' (FRAG. NO: 1080) (SEQ. ID NO: 1088)

5'-GGC TGG TGG-3' (FRAG. NO: 1083) (SEQ. ID NO: 1092)

5'-CGT TGG CTT CTC GTT GTC CC-3' (FRAG. NO: 1081) (SEQ. ID NO: 1089)

5'-TGT GGG CTT CTC GTT GTC CC-3' (FRAG. NO: 1082) (SEQ. ID NO: 1090)

5'-CCC TTC GGG GGC TGG TGG-3' (FRAG. NO: 1083) (SEQ. ID NO: 1091)

5'-GGC CGT CCT TGC CTG CTG G-3' (FRAG. NO: 1084) (SEQ. ID NO: 1093)

Human P Selectin Fragments

5'-TTT TCT CTT TCG CTT TCT TTT CGT CTC CTG TTC CTC CTT TT TTG CTG TTT TTT CTC CTT CTT CTC TCC TTT CTT TTC-3' (FRAG. NO: 1741) (SEQ. ID NO: 1754)

5'-TCC TTT CTT TTC-3' (FRAG. NO: 1742) (SEQ. ID NO: 1755)]

5'-CTC CTT TT-3' (FRAG. NO: 1743) (SEQ. ID NO: 1756)

5'-TTT TCT CTT TCG CTT TCT TTT CGT CTC CTG TTC CTC CTT TT-3' (FRAG. NO: 1085) (SEQ. ID NO: 1094)

5'-TTG CTG TTT TTT CTC CTT CTT CTC TCC TTT CTT TTC-3' (FRAG. NO: 1086) (SEQ. ID NO: 1095)

Human Endothelial Monocyte Activating Factor

Nucleic Acid & Antisense Oligonucleotide Fragments

5'-TTT TCT CTT TCG CTT TCT TTT CGT CTC CTG TTC CTC CTT TT TTG CTG TTT TTT CTC CTT CTT CTC TCC TTT CTT TTC-3' (FRAG. NO: 1744) (SEQ. ID NO: 1757)

5'-CC TTT CTT TTC (FRAG. NO: 1745) (SEQ. ID NO: 1758)

5'-CTG TTC CTC CTT CT-3' (FRAG. NO: 1746) (SEQ. ID NO: 1759)

5'-TTT TCT CTT TCG CTT TCT TTT CGT CTC CTG TTC CTC CTT TT-3' (FRAG. NO: 1087) (SEQ. ID NO: 1096)

5'-TTG CTG TTT TTT CTC CTT CTT CTC TCC TTT CTT TTC-3' (FRAG. NO: 1088) (SEQ. ID NO: 1097)

Human IL3* Nucleic Acid and Antisense Oligonucleotide Fragments

5'-CTC TGT CTT GTT CTG GTC CTT CGT GGG GCT CTG TGT CGC GTG G GTG CGG CCG TGG CC GGC GGB CCB GGB GTT GGB GCB GGB GCB GGB CGG GCB GGC GGC TCB TGT TTG GBT CGG CBG GBG GCB CTC (FRAG. NO: 1747) (SEQ. ID NO: 1760)]

5'-G GBG GCB CTC-3' (FRAG. NO: 1748) (SEQ. ID NO: 1761)

5'-GT GGG GCT CTG-3' (FRAG. NO: 1749) (SEQ. ID NO: 1762)

HUMIL3AAS1: 5'-CTC CGT CTT GTT CTG GTC CTT CGT GGG GCT CTG-3' (FRAG. NO: 1089) (SEQ. ID NO: 1098)

HUMIL3AAS2: 5'-TGT CGC GTG G GTG CGG CCG TGG CC-3' (FRAG. NO: 1090) (SEQ. ID NO: 1099)

GGC GGB CCB GGB GCT GGB GCB GGB GCB GGB CGG GCB GGC GGC TCB TGT TTG GBT CGG CBG GBG GCB CTC (FRAG. NO: 1091) (SEQ. ID NO: 1100)

Human IL3 Receptor Nucleic Acid and Antisense Oligonucleotide Fragments

5'-TCT GGG GTG TCC TGG CCT TCG TGG TTC CTC TTC CTT CGT TTG CCG TCC GCG GGG GCC CCC GGG CCT GGC TGC GCT CCT GCC CCG CCT CTT TCC CGG GCT CTT GCG CTG GGG GGT GCT CC CGT GTG TTT GCG CCC TC CTC CTG GTC GCG CTT GTC GTT TTG GGG CCG GCT TTG CCC GCC TCC GGC GCC TGG CCC GGC CTT CCT GGG CTG CGT GCG CGT TCT GTT CTT CTT CCT GGC GCA GGA GAC AGG GCA CGG CGA TCA GGA GCA GCG TGA GCC AAA GGA GGA CCA TCG GGA ACG CAG CTC CGG AAC GCA GGA CAG AGG TGC C GC BGG BGB CBG GGC BGG GCG BTC BGG BGC BGC GTG BGC CBB BGG BGG BCC BTC GGG BBC GCB GCT CCG GBB CGC BGG BCB GBG GTG CC-3' (FRAG. NO: 1750) (SEQ. ID NO: 1763)

GBG GTG CC-3' (FRAG. NO: 1751) (SEQ. ID NO: 1764)

5'-GCC CCG C-3' (FRAG. NO: 1752) (SEQ. ID NO: 1765)

5'-TCTGGGGTGTCCTG (FRAG. NO: 1092) (SEQ. ID NO: 1101)

5'-GCCTTCGTGGTTCC (FRAG. NO: 1093) (SEQ. ID NO: 1102)

5'-TCTTCCTTCGTTTGC (FRAG. NO: 1094) (SEQ. ID NO: 1103)

5'-CGTCCGCGGGGCCCCCGGGCCT (FRAG. NO: 1095) (SEQ. ID NO: 1105)

5'-GGC TGC GCT CCT GCC CCG C (FRAG. NO: 1096) (SEQ. ID NO: 1104)

5'-CTCTTTCCCGGGCTCTT (FRAG. NO: 1097) (SEQ. ID NO: 1106)

5'-GCGCTGGGGGTGCTCC (FRAG. NO: 1098) (SEQ. ID NO: 1107)

5'-CGTGTGTTTGCGCCCTCCTCCTGGTCGC (FRAG. NO: 1099) (SEQ. ID NO: 1108)

5'-GCTTGTCGTTTTGC (FRAG. NO: 1100) (SEQ. ID NO: 1109)

5'-GGCCGGCTTTGCCCGCCTCCC (FRAG. NO: 1101) (SEQ. ID NO: 1110)

5'-GGCGCCTGGCCCGGCC (FRAG. NO: 1102) (SEQ. ID NO: 1111)

5'-TTCCTGGGCTGCGTGCGC (FRAG. NO: 1103) (SEQ. ID NO: 1112)

5'-GTTCTGTTCTTCTTCCTGGC (FRAG. NO: 1104) (SEQ. ID NO: 1113)

5'-GCB GGB GBC BGG GCB GGG CGB TCB GGB GCB GCG TGB GCC BBB GGB GGB CCB TCG GGB BCG CBG CTC CGG BBC GCB GGB 5' CBG BGG TGC C (FRAG. NO: 1105) (SEQ. ID NO: 1114)

Human IL-4 Nucleic Acid and Antisense Oligonucleotide Fragments

5'-CTC TGG TTG GCT TCC TTC GCC GGC BCB TGC TBG CBG GBB GBB CBG BGG GGG BBG CBG TTG GGB GGT GBG BCC CBT TBB TBG GTG TCG B-3' (FRAG. NO: 1753) (SEQ. ID NO: 1766)

5'-GCC GGC BCB-3' (FRAG. NO: 1754) (SEQ. ID NO: 1767)

5'-T TCC TTC-3' (FRAG. NO: 1755) (SEQ. ID NO: 1768)

5'-CTC TGG TTG GCT TCC TTC-3' (FRAG. NO: 1106) (SEQ. ID NO: 1115)

5'-GCCGGCBCBTGCTBGCBGGBBGBBCBGBGGGGGBBGCBGTTGGGBGGTGBGBCCCBTTBBTBGGTGTCGB-3' (FRAG. NO: 1107) (SEQ. ID NO: 1116)

Human IL-4 Receptor Nucleic Acid and Antisense Oligonucleotide Fragment

5'-TCT GCC CTG TCC GCC GGC TCT TCG GTG GCT CGG CCC CGC TCC TTG TCT TGC CGC GGG TTG GTT CCT GGG CCT GGT TCT TGC GGG CGT TTC GGT CTG CTG GCT GGT CTG GGC CCG CGG TGC GGC GGG TGG CTT GCT GTT CTG CCT GGG CTC TCC CCT CTC CTC CTT TTC TCC CTT CCT CTG TCT TGC CTC CTT CCT CTG GGT CCT CTT GGC CTG GGC GCT CTT CCC CTC GGG CGG CTG CGG GCG CTC GTG CTG CCT GGT CCG CTC CCT GGG GGT GCT CCT TCC CTT TCC CCG CTC GTG GGG TTT GCG GGG CTG GGC TGC CCT GGG GGG TCT GGG CCT TTT GGG GTC GGC TGG CTG CTG CTT CGG GCC GCC TGG GCT TCC CTG TGC CCC TTT CCT CTG CTG GGT CCC CCT CCC GTT CCA AGC TGC ACC GCA CAG ACC GGC GCT ACA GGA CAG AGC CAG GCA AGC ACC CAT GGG GAT CCA GGC CCA GCT GTT CCB BGC TGC BCC GCB CBG BCC GGC GCT BCB GGB CBG BGC CBG GCB BGC BCC CBT GGG GBT CCB GGC CCB GCT G-3' (FRAG. NO: 1756) (SEQ. ID NG: 1769)

5'-TCTGCGC-3' (FRAG. NO: 1757) (SEQ. ID NO: 1770)

5'-CCT GCT CCT GGG G (FRAG. NO: 1758) (SEQ. ID NO: 1771)

5'-TCTGCGCGCCCCTCCTCC (FRAG. NO: 1108) (SEQ. ID NO: 1117)

5'-CGCCCGGCTTCTCT (FRAG. NO: 1109) (SEQ. ID NO: 1118)

5'-CGTGTGGGCTTCGG (FRAG. NO: 1110) (SEQ. ID NO: 1119)

5'-CCCCGCGCCTCCGTTGTTCTC (FRAG. NO: 1111) (SEQ. ID NO: 1120)

5'-TGCTCGCTGGGCTTG (FRAG. NO: 1112) (SEQ. ID NO: 1121)

5'-GGTTTCCTGGGGCCCTGGGTTTC (FRAG. NO: 1113) (SEQ. ID NO: 1122)

5'-TCTGCCGGGTCGTTTTC (FRAG. NO:1114) (SEQ. ID NO: 1123)

5'-GGGTGCTGGCTGCG (FRAG. NO: 1115) (SEQ. ID NO: 1124)

5'-CTTGGTGCTGGGGCTCC (FRAG. NO: 1116) (SEQ. ID NO: 1125)

5'-GGCGGCTGCGGGCTGGGTTGGG (FRAG. NO: 1117) (SEQ. ID NO: 1126)

5'-CTTGGCTGGTTCCTGGCCTCGGG (FRAG. NO: 1118) (SEQ. ID NO: 1127)

5'-CCTCCTCCTCCTCCTCGCTCCCTTTTTCTTCCTCT (FRAG. NO: 1119) (SEQ. ID NO: 1128)

5'-TCCCTGCTGCTCTC (FRAG. NO: 1120) (SEQ. ID NO: 1129)

5'-TGCCCTCCCTTCCCTCCTGG (FRAG. NO: 1121) (SEQ. ID NO: 1130)

5'-GGTGCCTCCTTGGCCCCTGC (FRAG. NO: 1122) (SEQ. ID NO: 1131)

5'-GGCTGCTCCTTGCCCC (FRAG. NO: 1123) (SEQ. ID NO: 1132)

5'-CTCTGGGTCGGGCTGGC (FRAG. NO: 1124) (SEQ. ID NO: 1133)

5'-GGGGCGTCTCTGTGC (FRAG. NO: 1125) (SEQ. ID NO: 1134)

5'-CTGGCCTGGGTGCC (FRAG. NO: 1126) (SEQ. ID NO: 1135)

5'-GCCTCTCCTGGGGGGTGGCTCCCTGTCC (FRAG. NO: 1127) (SEQ. ID NO: 1136)

5'-CCTTTTCCCCCGGCTCC (FRAG. NO: 1128) (SEQ. ID NO: 1137)

5'-GTGGGGGCTTTGGC (FRAG. NO: 1129) (SEQ. ID NO: 1138)

5'-GGG GGT CTG TGG CCT GCT CCT GGG G (FRAG. NO: 1130) (SEQ. ID NO: 1139)

5'-AGGGGTCTGGGGCCCTC (FRAG. NO: 1131) (SEQ. ID NO: 1140)

5'-TTTTGGGGTCTGCCTTG (FRAG. NO: 1132) (SEQ. ID NO: 1141)

5'-GCCTGGCTGCCTTCC (FRAG. NO: 1133) (SEQ. ID NO: 1142)

5'-GGGGCCTGCCGTGGGGC (FRAG. NO: 1134) (SEQ. ID NO: 1143)

5'-TGTCCTCTGTTGCTCCCCTT (FRAG. NO: 1135) (SEQ. ID NO: 1144)

5'-TGCCTGCTGTCTGG (FRAG. NO: 1136) (SEQ. ID NO: 1145)

5'-GGTTCCCGCCTTCCCT (FRAG. NO: 1137) (SEQ. ID NO: 1146)

5'-GTT CCC AGA GCT TGC CAC CTG CAG CAG GAC CAG GCA GCT CAC AGG GAA CAG GAG CCC AGA GCA AAG CCA CCC CAT TGG GAG ATG CCA AGG CAC CAG GCT G (FRAG. NO: 1138) (SEQ. ID NO: 1147)

5'-GTT CCC BGB GCT TGC CBC CTG CBG CBG GBC CBG GCB GCT CBC BGG GBB CBG GBG CCC BGB GCB BBG CCB CCC CBT TGG GBG BTG CCB BGG CBC CBG GCT G-3' (FRAG. NO: 1139) (SEQ. ID NO: 1148)

Human IL5* Nucleic Acid and Antisense Oligonucleotide Fragments

5'-TCCCTGTTTC CCCCCTTTCG TTCTGCGTTT GCCTTTGGCG TTTTTTGTTT GTTTTCTCTC TCCGTCTTTC TTCTCCCCT GTGGGBBTTT CTGTGGGGBT GGCBTBCBCG TBGGCBGCTC CBBGBGCTBG CBBBCTCBBB TGCBGBBGCB TCCTCBTGGC TCTGBBBCGG TGGGAATTTC TGTGGGGBTG GCATACACGT AGGCAGCTCC AAGAGCTAGC AAACCCAAAT GCAGAAGCATC CTCATGGCTC TGAAACG-3' (FRAG. NO: 1759) (SEQ. ID NO: 1772)

5'-GCC CCG GG-3' (FRAG. NO: 1760) (SEQ. ID NO: 1773)

5'-G GGT TTC T-3' (FRAG. NO: 1761) (SEQ. ID NO: 1774)

5'-GTG GGG BTG GC-3' (FRAG. NO: 1762) (SEQ. ID NO: 1775)

5'-CCB BGB GCT BGC-3' (FRAG. NO: 1763) (SEQ. ID NO: 1776)

5'-TCC CTG TTT CCC CCC TTT-3' (FRAG. NO: 1140) (SEQ. ID NO: 1149)

5'-CGT TCT GCG TTT GCC TTT GGC-3' (FRAG. NO: 1141) (SEQ. ID NO: 1150)

5'-GTT TTT TGT TTG TTT TCT-3' (FRAG. NO: 1142) (SEQ. ID NO: 1151)

5'-CTC TCC GTC TTT CTT CTC C-3' (FRAG. NO: 1143) (SEQ. ID NO: 1152)

5'-CCT CCT GCC TGT GTC CCT GCT CCC C-3' (FRAG. NO: 1144) (SEQ. ID NO: 1153)

5'-GAG GGT TTC TGG CTT CCT CTC T-3' (FRAG. NO: 1145) (SEQ. ID NO: 1154)

5'-TGT CTC TCT GTC CTT TTG TT-3' (FRAG. NO: 1146) (SEQ. ID NO: 1155)

5'-TGT TGT GCG GCC TGG TGC TGC CCT GCC CCG GG-3' (FRAG. NO: 1147) (SEQ. ID NO: 1156)

5'-GTG GGA ATT TCT GTG GGG BTG GCA TAC ACG TAG GCA GCT CCA AGA GCT AGC AAA CTC AAA TGC AGA AGC ATC CTC ATG GCT CTG AAA CG-3' (FRAG. NO: 1764) (SEQ. ID NO: 1777)

5'-GTG GGB BTT TCT GTG GGG BTG GCB TBC BCG TBG GCB GCT CCB BGB GCT BGC BBB CTC BBB TGC BGB BGC BTC CTC BTG GCT CTG BBB GC-3' (FRAG. NO: 1148) (SEQ. ID NO: 1157)

Human IL-5 Receptor Nucleic Acid and Antisense Oligonucleotide Fragments

5'-CTCAGTGGCC CCCAAAAGGA TGAGTAATAC ATGCGCCACG ATGATCATAT CCTTTTTACT ATGAGGCCGT GTCTGTCGTG TCTTTCCTTT GCTCTTGGTG TGTCTTTGCT GTGCCCTGCC TCTCTGCCCG TGTCTGTCGT

-continued

GTCTTTCCTT TGCTCTTGGT GTGTCTTTGC TGTGCCCTGC CTCTCTGCC CGTGTCTGTC GTGTCTTTCC

TTTGCTCTTG GTGTGTCTTT GCTGTGCCCT GCCTCTCTGC-3' (FRAG. NO: 1765) (SEQ. ID NO: 1778)

5'-CCG TGT C-3' (FRAG. NO: 1766) (SEQ. ID NO: 1779)

5'-GCCCTGCC-3' (FRAG. NO: 1767) (SEQ. ID NO: 1780)

5'-CCG TGT CTG TCG TGT CT-3' (FRAG. NO: 1149) (SEQ. ID NO: 1158)

5'-TTCCTTTGCTCTTG-3' (FRAG. NO: 1150) (SEQ. ID NO: 1159)

5'-GTGTGTCTTTGCTCT-3' (FRAG. NO: 1151) (SEQ. ID NO: 1160)

5'-GCCCTGCCTCTCTCC-3' (FRAG. NO: 1152) (SEQ. ID NO: 1161)

5'-CT CBGTGGCCCC CBBBBGGBTG BGTBBTBCBT GCGCCBCGBT GBTCBTBTCC TTTTTBCTBT GBGG (FRAG. NO:

1768) (SEQ. ID NO: 1781)

Human IL-6 Receptor Fragments

5'-GGGGGTGGCT TCCTGCCGCG TCTCTGGGCC GTCCCGTCCC TCGGCCCCGC GCCGCGTCTCG GCTCCTCTCC

CTCTGGCCCG GCTCGGGGCG GGGCGGGGCG GTGGGCGGGC GGCGCTGCCC TGCGCGCGGC GCTGGCCCCT

GCTGGCCGTC GGCTGCGCGC TGCTGGCTGC CCTGCTGGCC GCGCCGGGGC CTGTCCGCCT CTGCGGGCGC

TGTCTCCTGG CTTGTCTTCC GGCTCTTCTG CTGGGGTGGG GCTGGGCGGC CGGCCCGGTG CTGGGGCTCC

TCGGGGGGG GGGCTCTTCC GGGCTGTCTC CCTCCGGGGC GGGGGTTTCT GGCCGTGGGG GTCTTGCCTG

GCCTCCGGGC TCCTGCTTGT CTTGCCTTCC TTCTCTGGTC GGTTGTGGCT CGGGGCTCCG TGGGTCCCTG

GCGCCCGTTT GTGCTTTGTC TTTTCCCCTG GCGTCCCTGT GCCCCTCTCC TCTCCTTCCT CTGCTTCTCG

CTCTCCTTTG TGGGGCCCTC CCTGCTGCTC TTGGTTTTGG GCTTTTTTTC TCTTCCTCCT TTTTCGTGCG

TGGGCCTCCG CACGCCTCTT GCCACCTCCT GCGCAGGGCA GCGCCTTGG GGCCAGCGCC GCTCCCGGCG

CGGCCAGCAG GGCAGCCAGC AGCGCGCAGC CGACGGCCAG CATGCTTCCT CCTCGGCTAC CACTCCATGG

TCCCGCAGAG GCGGACAGGC GCBCGCCTC TTGCCBCCTC CTGCGCBGGG CBGCGCCTTG GGGCCBGCGC

CGCTCCCGGC GCGGCCBGCB GGGCBGCCBG CBGCGCGCBG CCGBCGGCCB GCBTGCTTCC TCCTCGGCTB

CCBCTCCBTG GTCCCGCBGB GGCGGBCBGG C-3' (FRAG. NO: 1769) (SEQ. ID NO: 1782)

5'-CCCGGCGC-3' (FRAG. NO: 1184) (SEQ. ID NO: 1193)

5'-GGCCBGCBGG-3' (FRAG. NO: 1186) (SEQ. ID NO: 1195)

5'-GCBGCCBGCBGCG-3' (FRAG. NO: 1770) (SEQ. ID NO: 1783)

5'-C GCBGCCBGCGGCC-3' (FRAG. NO: 1771) (SEQ. ID NO: 1784)

5'-GGGGGTGGCTTCCTGCC-3' (FRAG. NO: 1153) (SEQ. ID NO: 1162)

5'-GCGTCTCTGGGCCGTCCC-3' (FRAG. NO: 1154) (SEQ. ID NO: 1163)

5'-GTCCCTCGGCCCCGCGCCGCGCTCGGCTCCTCTCCC-3' (FRAG. NO: 1155) (SEQ. ID NO: 1164)

5'-TCTGGCCCGGCTC-3' (FRAG. NO: 1156) (SEQ. ID NO: 1165)

5'-GGGGCGGGCGGGCGGTGGGCGGGC-3' (FRAG. NO: 1157) (SEQ. ID NO: 1166)

5'-GGCGCTGCCCTGCGC-3' (FRAG. NO: 1158) (SEQ. ID NO: 1167)

5'-GCGGCGCTGGCCCC-3' (FRAG. NO: 1159) (SEQ. ID NO: 1168)

5'-TGCTGGCCGTCGGCTGCGCGCTGCTGGCTGCCCT-3' (FRAG. NO: 1160) (SEQ. ID NO: 1169)

5'-GCTGGCCGCGCCGGG-3' (FRAG. NO: 1161) (SEQ. ID NO: 1170)

5'-GCCTGTCCGCCTCTGCGGG-3' (FRAG. NO: 1162) (SEQ. ID NO: 1171)

5'-CGCTGTCTCCTGGC-3' (FRAG. NO: 1163) (SEQ. ID NO: 1172)

5'-TTGTCTTCCGGCTCT-3' (FRAG. NO: 1164) (SEQ. ID NO: 1173)

5'-TCTGCTGGGGTGGG-3' (FRAG. NO: 1165) (SEQ. ID NO: 1174)

5'-GCTGGGCGGCCGGCCCGGT-3' (FRAG. NO: 1166) (SEQ. ID NO: 1175)

5'-GCTGGGGCTCCTCGGGGGG-3' (FRAG. NO: 1167) (SEQ. ID NO: 1176)

5'-GGGGGCTCTTCCGG-3' (FRAG. NO: 1168) (SEQ. ID NO: 1177)

5'-GCTGTCTCCCTCCGGG-3' (FRAG. NO: 1169) (SEQ. ID NO: 1178)

5'-GCGGGGTTTCTGGCC-3' (FRAG. NO: 1170) (SEQ. ID NO: 1179)

5'-GTGGGGTCTTGCC-3' (FRAG. NO: 1171) (SEQ. ID NO: 1180)

5'-TGGCCTCCGGGCTCC-3' (FRAG. NO: 1172) (SEQ. ID NO: 1181)

5'-TGCTTGTCTTGCCTTCCTTC-3' (FRAG. NO: 1173) (SEQ. ID NO: 1182)

5'-TCTGGTCGGTTGTGGCTCG-3' (FRAG. NO: 1174) (SEQ. ID NO: 1183)

5'-GGGCTCCGTGGGTCCCTGGC-3' (FRAG. NO: 1175) (SEQ. ID NO: 1184)

5'-GCCCGTTTGTGTTTTGTC-3' (FRAG. NO: 1176) (SEQ. ID NO: 1185)

5'-TTTTCCCCTGGCGT-3' (FRAG. NO: 1177) (SEQ. ID NO: 1186)

5'-CCCTGTGCCCCTCTCCTCTCCTTCCTCTGCTTCTC-3' (FRAG. NO: 1178) (SEQ. ID NO: 1187)

5'-GCTCTCCTTTGTGGG-3' (FRAG. NO: 1179) (SEQ. ID NO: 1188)

5'-GCCCTCCCTGCTGCT-3' (FRAG. NO: 1180) (SEQ. ID NO: 1189)

5'-CTTGGTTTTGGGCT-3' (FRAG. NO: 1181) (SEQ. ID NO: 1190)

5'-TTTTTTCTCTTCCTCCTTTTC-3' (FRAG. NO: 1182) (SEQ. ID NO: 1191)

5'-GTGCGTGGGCCTCC-3' (FRAG. NO: 1183) (SEQ. ID NO: 1192)

5'-GCACGCCTCT TGCCACCTCC TGCGCAGGGC AGCGCCTTGG GGCCAGCGCC GCTCCCGGCG CGGCCAGCAG GGCAGCCAGC AGCGCGCAGC CGACGGCCAG CATGCTTCCT CCTCGGCTAC CACTCCATGG TCCCGCAGAG GCGGACAGGC-3' (FRAG. NO: 1185) (SEQ. ID NO: 1194)

5'-GCBCGCCTCT TGCCBCCTCC TGCGCBGGGC BGCGCCTTGG GGCCBGCGCC GCTCCCGGCG CGGCCBGCBG GGCBGCCBG CBGCGCGCBG CCGBCGGCCB GCBTGCTTCC TCCTCGGCTB CCBCTCCBTG GTCCCGCBGB GGCGGBCBGG C-3' (FRAG. NO: 1187) (SEQ. ID NO: 1196)

Human IL-6 Nucleic Acid and Antisense Oligonucleotide Fragments

5'-GGGGGTGGCF TCCTGCCGCG TCTCTGGGCC GTCCCGTCCC TCGGCCCCGC GCCGCGCTCG GCTCCTCTCC CTCTGGCCCG GCTCGGGGCG GGGCGGGGCG GTGGGCGGGC GGCGCTGCCC TGCGCGCGGC GCTGGCCCCT GCTGGCCGTC GGCTGCGCGC TGCTGGCTGC CCTGCTGGCC GCGCCGGGGC CTGTCCGCCT CTGCGGGCGC TGTCTCCTGG CTTGTCTTCC GGCTCTTCTG CTGGGGTGGG GCTGGGCGGC CGGCCCGGTC TGGGGCTCC TCGGGGGGGG GGGCTCTTCC GGGCTGTCTC CCTCCGGGC GGGGGTTTCT GGCCGTGGGG GTCTTGCCTG GCCTCCGGGC TCCTGCTTGT CTTGCCTTCC TTCTCTGGTC GGTTGTGGCT CGGGGCTCCG TGGGTCCCTG GCGCCCGTTT GTGTTTTGTC TTTTCCCCTG GCGTCCCTGT GCCCCTCTCC TCTCCTTCCT CTGCTTCTCG CTCTCCTTTG TGGGCCCTC CCTGCTGCTC TTGGTTTTGG GCTTTTTTTC TCTTCCTCCT TTTTCGTGCG TGGGCCTCC GCACGCCTCT TGCCACCTCC TGCGCAGGGC AGCGCCTTGG GGCCAGCGCC GCTCCCGGCG CGGCCAGCAG GGCAGCCAGC AGCGCGCAGC CGACGGCCAG CATGCTTCCT CCTCGGCTAC CACTCCATGG TCCCGCAGAG GCGGACAGGC GBCGCCTC TTGCCBCCTC CTGCGCBGGG CBGCGCCTTG GGGCCBGCGC CGCTCCCGGC GCGGCCBGCB GGGCBGCCBG CBGCGCGCBG CCGBCGGCCB GCBTGCTTCC TCCTCGGCTB CCBCTCCBTG GTCCCGCBGB GGCGGBCBGG C-3' (FRAG. NO: 1772) (SEQ. ID NO: 1785)

-continued

5'-GGGGCBGG-3' (FRAG. NO: 1773) (SEQ. ID NO: 1786)

5'-GBBGGCBG CBGGC-3' (FRAG. NO: 1774) (SEQ. ID NO: 1787)

5'-CCBGGBGCBG CCCC-3' (FRAG. NO: 1775) (SEQ. ID NO: 1788)

5'-BGGG BGBBGGCBBC-3' (FRAG. NO: 1776) (SEQ. ID NO: 1789)

5'-GCT TCT CTT TCG TTC CCG GTG GGC TCG-3' (FRAG. NO: 1188) (SEQ. ID NO: 1197)

5'-GTG GCT GTC TGT GTG GGG CGG CT-3' (FRAG. NO: 1189) (SEQ. ID NO: 1198)

5'-GTG CCT CTT TGC TGC TTT C-3' (FRAG. NO: 1190) (SEQ. ID NO: 1199)

5'-GAT TCT TTG CCT TTT TCT GC-3' (FRAG. NO: 1191) (SEQ. ID NO: 1200)

5'CTCCTGGGGG TBCTGGGGCB GGGBBGGCBG CBGGCBBCBC CBGGGBGCBGC CCCBGGGBGB BGGCBBCTGG BCCGBBGGCG CTTGTGGBGB BGGBGTTCBT BGCTGGGCTC CTGGBGGGGB GBTBGBGC-3' (FRAG. NO: 1777) (SEQ. ID NO: 1790)

Human Monocyte-derived Neutrophil Chemotactic Factor

Nucleic Acid and Antisense Oligonucleotide Fragments

5'-GGGGTGGBBB GGTTTGGBGT BTGTCTTTBT GCBCTGBCBT CTBBGTTCTT TBGCBCTCCT TGGCBBBBCT GCBCCTTCBC BCBGBGCTGC BGBBBTCBGG BBGGCTGCCB BGBGBGCCBC GGCCBGCTTG GBBGTCBTGT TTBCBCBCBG TGBGBTGGTT CCTTCCGGGC TTGTGTGCTC TGCTGTCTCT TGGTTCCTTC CGGTGGTTTC TTCCTGGCTC TTGTCCTTTC TCTTGG CCCT TGGC-3' (FRAG. NO: 1778) (SEQ. ID NO: 1791)

5'-GGBGT BTG-3' (FRAG. NO: 1779) (SEQ. ID NO: 1792)

5'-GCBCTGBCBT CT-3' (FRAG. NO: 1780) (SEQ. ID NO: 1793)

5'-CCG GTG G-3' (FRAG. NO: 1781) (SEQ. ID NO: 1794)

5'-GG CCC TTG GC-3' (FRAG. NO: 1782) (SEQ. ID NO: 1795)

5'-GCT TGT GTG CTC TGC TGT CTC T-3' (FRAG. NO: 1192) (SEQ. ID NO: 1201)

5'-TGG TTC CTT CCG GTG GTT TCT TCC TGG CTC TTG TCC T-3' (FRAG. NO: 1193) (SEQ. ID NO: 1202)

5'-TTC TCT TGG CCC CTG GC-3' (FRAG. NO: 1194) (SEQ. ID NO: 1203)

5'-GGGGTGGBBB GGTTTGGBGT BTGTCTTTBT GCBCTGBCBT CTBBGTTCTT TBGCBCTCCT TGGCBBBBCT GCBCCTTCBC BCBGBGC-3' (FRAG. NO: 1783) (SEQ. ID NO: 1796)

Human Neutrophil Elastase (Medullasin) Nucleic Acid and Antisense Oligonucleotide Fragments 5'-GGGCTCCCGC CGCGBGBGGT TBTGGGCTCC CBGGBCCBCC CGCBCCGCGC GGBCGTTTBC BTTCGCCBCG CBGTGCGCGG CCGBCBTGBC GBBGTTGGGC GCBBTCBGGG TGGCGCCGCB GBBGTGGCCT CCGCGCBGCT GCBGGGBCBC CBTGBBGGGC CBCGCGTGGG GCCGCGCTCG CCGGCCCCCC BCBBTCTCCG BGGCCBGCGC GGTGCCCCCC BGCBGCBBGG CCGGCBGGBC BCBGGCGBGG BGBCBCGCGB GTCGGCGGCC GBGGGTCBTG GTGGGGCTGG GGCTCCGGGG TCTCTGCCCC TCCGTGCTGG TGGGGCTGGG GCTCCGGGG TCTCTGCCCC TCCGTGCCGC GTGGGGCCGC GCTCGCCGGC CCCCCCTGC CGGGTGGGCT CCCGCCGCGC GCCGGCCTGC CGGCCCCTCG TGGGTCCTGC TGGCCGGGTC CGGGTCCCGG GGGTGGGGCG CGBGTCGGCG GCCGBGGGTC-3' (FRAG. NO: 1784) (SEQ. ID NO: 1797)

5'-GG TGG GGC-3' (FRAG. NO: 1785) (SEQ. ID NO: 1798)

5'-G GGG CCG-3' (FRAG. NO: 1786) (SEQ. ID NO: 1799)

5'-GGC CGG GTC CGG G-3' (FRAG. NO: 1787) (SEQ. ID NO: 1800)

5'-TGG TGG GGC TGG GGC TCC GGG GTC TCT GCC CCT CCG TGC-3' (FRAG. NO: 1195) (SEQ. ID NO: 1204)

5'-CGC GTG GGG CCG CGC TCG CCG GCC CCC C-3' (FRAG. NO: 1196) (SEQ. ID NO: 1205)

-continued

5'-CCT GCC GGG TGG GCT CCC GCC GCG-3' (FRAG. NO: 1197) (SEQ. ID NO: 1206)

5'-CGC CGG CCT GCC GGC CCC TC-3' (FRAG. NO: 1198) (SEQ. ID NO: 1207)

5'-GTG GGT CCT GCT GGC CGG GTC CGG GTC CCG GGG GTG GGG-3' (FRAG. NO: 1199) (SEQ. ID NO: 1208)

5'-CGC BBG TCG GCG GCC BBG GGT C-3' (FRAG. NO: 1200) (SEQ. ID NO: 1209)

5'-GGGCTCCCGC CGCGBGBGGT TBTGGGCTCC CBGGBCCBCC CGCBCCGCGC GGBCGTTTBC BTTCGCCBCG
CBGTGCGCGG CCGBCBTGBC GBBGTTGGGC GCBBTCBGGG TGGCGCCGCB GBBGTGGCCT CCGCGCBGCT
GCBGGGBCBC CBTGBBGGGC CBCGCGTGGG GCCGCGCTCG CCGGCCCCCC BCBBTCTCCG BGGGCCBGCGC
GGTGCCCCCC BGCBGCBBGG CCGGCBGGBC BCBGGCGBGG BGBCBCGCGB GTCGGCGGCC GBGGGTCBTG
GTGGGGCTGG GGCTCCGGGG TCTCTGCCCC TCCGTGC-3' (FRAG. NO: 1788) (SEQ. ID NO: 1801)

Human Neutrophil Oxidase Factor Nucleic Acid and Antisense Oligonucleotide Fragments 5'-CGGGBGTGGG GGTCCTGGBC GGCBCTGBBG GCBTCCBGGG CTCCCTTCCB GTCCTTCTTG TCCGCTGCCB
GCBCCCCTTC BTTCCBGBGG CTGBTGGCCT CCBCCBGGGB CBTGBTTGGG TBGBBBCTBG GBGGCCGGCC
TCCBCCBGGG BCBTGGTCCT TCTTGTCCGC TGCCTCTCTG GGGTTTTCGG TCTGGGTGGG CTTTCCTCCT
GGGGCTGCTG CTGGGCTCTT CTTTTTGTTT CTGGCCTGGT GCTCTCTCGT GCCCTTTCCC TTGGGTGTCT
TGTTTTTGTG GCCTCCBCCB GGGBCBTG-3' (FRAG. NO: 1789) (SEQ. ID NO: 1802)

5'-CGGGBGTGGG GG-3' (FRAG. NO: 1790) (SEQ. ID NO: 1803)

5'-GCCBGCBCCCC-3' (FRAG. NO: 1791) (SEQ. ID NO: 1804)

5'-C CBC CBG-3' (FRAG. NO: 1792) (SEQ. ID NO: 1805)

5'-GGC CTC CBC CBG GGB CBT G-3' (FRAG. NO: 1201) (SEQ. ID NO: 1210)

5'-GTC CTT CTT GTC CGC TGC C-3' (FRAG. NO: 1202) (SEQ. ID NO: 1211)

5'-TCT CTG GGG TTT TCG GTC TGG GTG G-3' (FRAG. NO: 1203) (SEQ. ID NO: 1212)

5'-GCT TTC CTC CTG GGG CTG CTG CTG-3' (FRAG. NO: 1204) (SEQ. ID NO: 1213)

5'-GGC TCT TCT TTT TGT TTC TGG CCT GGT G-3' (FRAG. NO: 1205) (SEQ. ID NO: 1214)

5'-CTC TCT CGT GCC CTT TCC-3' (FRAG. NO: 1206) (SEQ. ID NO: 1215)

5'-CTT GGG TGT CTT GTT TTT GT-3' (FRAG. NO: 1207) (SEQ. ID NO: 1216)

5'-GGC CTC CBC CBG GGB CBT G-3' (FRAG. NO: 1208) (SEQ. ID NO: 1217)

5'-CGGGBGTGGG GGTCCTGGBC GGCBCTGBBG GCBTCCBGGG CTCCCTTCCB GTCCTTCTTG TCCGCTGCCB
GCBCCCCTTC BTTCCBGBGG CTGBTGGCCT CCBCCBGGGB CBTGBTTGGG TBGBBBCTBG GBGGCC-3' (FRAG.
NO: 1793) (SEQ. ID NO: 1806)

Human Cathepsin G Nucleic Acid and Antisense Oligonucleotide Fragments

5'-CCCTCCBCBT CTGCTCTGBC CTGCTGGBCT CTGGBTCTGB BGBTBCGCCB TGTGGGGGCG GGBGTGGGGC

5'-CTGCAGTGGT AAAAAGATTC TATATCTGCT GTTTGATGAA TGCAGCACCC ACTAGCCACA TAGTGCTCGT
GAGCACTTGC AATCCGGCTA GGGTGATTTC AATTAACCTA AAAGAGAACA GCCACAGGGA GCATGTGGCT
GCCATATTGG ATGGTGCTGC TTTGAGAACA AAATGAGAGA AATGAAGCCT CTATTTACCT TGGTTGGCGG
AACACATTGA AGGGACTCTG TATTGATACC AGGCTTCAAA CTTTGGGAAG TGTACTGGCC AACTTAAACA
CATCCACAGG AGAATGAAGA GGTTTGGGAA GGGACCAGAA ACCAGGCATT GAGGACAATG AGAAGAGTTT
TTCAAAAGTG GAATTACTGC AAAAAGTGGA AAAATAGCCT TTGGATGAA GTTACTGATG AGACAATTTC
CATCGGTGTG AAAGCCATCT TTCCAACAGA GATCTGCAAC ATGAGAATGT ACTGTCTCCT AGGGTAGCGA
TGGCCTCTTG TATTAGTCCG CTCAGGCTAC CAGATTTATC GTTTAAACTG CCCATAAACA GACCAGGCAG
TTTAAACAAC AGAAATTTAT TTCCTCGCAG TCCTGGAGGC AGGAAGTCTG CGATCAAGGT GGAAGCAGGG

-continued

TTGGCTTCTT CTCAGGTGTC TGTCCTTGGC TGGTAGATGA CCGCCGCCTC CCTGGGTCCT CACATGGTCT

TTCCTCTGTG TGTGTCTGTC CCAATCTCTT CTTATAAGGA TGCAAGTCTT ATGGATCAGA GCACACCCCA

ATGACCGTGT TTAACTTGAA TCACCTCTTT AAAGTTTCTC TCTCCAAATA CAATCACCTC CTGAGGCACT

GTTAGGGCTT CGACACAGGA ATTCTTTTCC TAGGGGATTC AGTTCAGTCC AAAACGCCTA CCAGTGGAGA

CTTGCAACAT GGCGGCCTGC TGGTCCCTCG CCAGGAATAT CACAGGCGAC TGTTCCCTGT TGCATGGAAT

AGAAGGCTAT TCCAGAGTAC TGTCTCTATT TATCAGATCT GGGATACTGG GAGAAGGGCA AAATAAAGTC

CAAGTAGAAA AAAAAACTAT GAAAGTTTTA GAGAGTAACC ATAATTTCAG CCCGATGTGA AACGATCCTA

GATTTCAGCT GAAATAGTGA TGTGGGAAGT GAGGGGGCCG GGATTCAAGG CAGAGGGAAC AGCGTAACTG

AAGGCATGGA AGGAGGGAAG TGTAGGCTGT GTTTGAAGAG TGGCAGCTGC TTCCACATTT CTAAAACACA

GGATGTGATT TTGCGGTGTG TTGAGACAAG GCAGAAAACT TGTTTGGAAA AATAACTTGA ATTCCCTGCA

CATTTAAAAT CTCTCAGCAG AAGAAAACCC CACTCAGAAC CCCACTGTTC ATTCCTTGGC TTGTATTTGG

SCACAGCTGG CATAGCCCCA GACTGAGTAA GCTCTTCAGA CACCTCATTT CATGAGTAGC CCCAAAGATC

AATCATGGGC CAATTTCTTG GAAGAGAAGA CTCTCCGGTG TTTTGCAGTT ATTTGTTCTG CTTTCGCGAG

ATGTTCTCAA ATCCTTGCAG CTACAAGCCA TGAGTCTGAA GTGTTTGTGT TCCCTCCTTA CAGGTGGTAA

CTTTCTCACA GGCCTTGGCC ACAGATCTGA TCATTACAAT TGCGTCAGCA GTGGAGGGCA ATGTCTCTAT

TCTGCCTGCC CGATCTTTAC CAAAATTCAA GGCACCTGTT ACAGAGGGAA GGCCAAGTGC TGCAAGTGAG

CTGAGAGTGA CCAGAAGAAA TGACGCAGAA GTGAAATGAA CTTTTTATAA GCATTCTTTT AATAAAGGAA

AATTGCTTTT GAAGTATACC TCCTTTGGGC CAAAATGAAT CTTGTGTCTC AATTGGAAGA GGTAAAGAAG

TAGGGGGTTA GGGTGCATGG GTTGGAACGT GAGACAGGTC GAACCACAAA GCCTGCCTGG AAAAGGGGAG

TGACGTCCTA GGCTTCAGTG ATGTCACCTC CACTTTGTTT GATCCACAAA CCAACAGGTG ACTGATTTTG-3'

(FRAG. NO: _ ) (SEQ. ID NO: 2474)

5'-GCTCAGCCTC CAAAGGAGCC AGCCTCTCCC CAGTTCCTGA AATCCTGAGT GTTGCCTGCC AGTCGCCATG

AGAACTTCCT ACCTTCTGCT GTTTACTCTC TGCTTACTTT TGTCTGAGAT GGCCTCAGGT GGTAACTTTC

TCACAGGCCT TGGCCACAGA TCTGATCATT ACAATTGCGT CAGCAGTGGA GGGCAATGTC TCTATTCTGC

CTGCCCGATC TTTACCAAAA TTCAAGGCAC TGTTACAGA GGGAAGGCCA AGTGCTGCAA GTGAGCTGGG

AGTGACCAGA GAAATGACG CAGAAGTGAA ATGAACTTTT TATAAGCATT CTTTTAATAA AGGAAAATTG

CTTTTGAAGT AT-3' (FRAG. NO: _ ) (SEQ. ID NO: 2472)

5'-CCGGGGC-3' (FRAG. NO: 1800) (SEQ. ID NO: 1813)

5'-GG GCCTGCBGGG CC-3' (FRAG. NO: 1801) (SEQ. ID NO: 1814)

5'-GGCBGCB BGG-3' (FRAG. NO: 1802) (SEQ. ID NO: 1815)

5'-GGG TCC TCB TGG CTG GGG-3' (FRAG. NO: 1212) (SEQ. ID NO: 1221)

5'-GCC TGG GCC TGC BGG GCC-3' (FRAG. NO: 1213) (SEQ. ID NO: 1222)

5'-GCT CTT GCC TGG BGT GGC TC-3' (FRAG. NO: 1214) (SEQ. ID NO: 1223)

5'-GCC CBG BGT CTT CCC TGG T-3' (FRAG. NO: 1215) (SEQ. ID NO: 1224)

5'-CCGGGGCTGC BGCBBCCTCB TCBGCTCTTG CCTGGBGTGG CTCBGCCTGG GCCTGCBGGG CCBCCBGGBG

BBTGGCBGCB BGGBTGGCGB GGGTCCTCBT GGCTGGGGTC BCBGBTCCTC TBGCTBGGCB GGGTGBCCBG

BGBGGGC-3' (FRAG. NO: 1803) (SEQ. ID NO: 1816)

Human Defensin 2 Nucleic Acid and Antisense Oligonucleotide Fragments

5'-ATCCTTTAAG TCAATGGACT TTGCATCAGT CACACCATCT TTTGTTACTT TGGACTTCCC CAGCTATGTT

```
CAATAATTAC TGTTCTTCCC TTGGGCCCCA TTGTAATGGC TACAGCCTCG ACAAAAAGTC TACACTTTGA
AGCATTAAGG CTCGGACATC AGCACCAAAT TTTACATCTT TACCATCACT TCAAGTGAGG TGAGGAGCCA
GTAGCCTGGA CACTGGTCTC ATCTGGTGAA AGACTGTGGG TAATGGAAGC ATTTCTGTGG GGTGCTGGCA
GGACATGTGC ATGGCGAGGC AGGTCATCAG CAGCAAGTGA GAGCTGCCTC TTACTTTCTA AAGGTGACAT
AGCAAATATA CAAAAAAAAA TAAATAAATT ATTAATTTAG GTAGAGCACA TAAAGGCTTT ATTTCATATT
CCATTTCTCT GTATGCTTTC TTCACCAGGA AGAAATAGTT TTAGTGTCAG GAATGAATGA GTCTGCCCCT
CAATTCCAGC CTGCTCAACA CACAAGGAAA CAAAGCCCTG ACAATCAGAG TGACTCCCTG GTGACTAAGC
TCCCAGTCCT GGATGCATAT TTGTTTAGCA GTTCTGACAG CATTTGACCC AGCCCTCTCT CTGCATATCC
CATCAGAACC TTCTTTTTTT TTTTTTTCTT TGAGACTGAG TCTTGCTCTG TCGGAAGCGA CTCCTGTGCC
TCAGCCTCCC AAATACCTGG AATTATAGGC GTAAGCCATC ATGCCTGGCT AATTTTTGTA TTTTTCATGG
AGATGGGGTT TTGCCATGTT GGTCAAATTG GTCTCACACT CCTGACCTCA TGTGATCCAC CTGCCTCAGC
CTCCCAAACT GCTCGGATGA CAGGTGTAAG CCACCATGCT AGGCTCAGAA ATTTCCTTTT ATAAAAATGT
CATTAAGGAT CTTCGCTGCA CAATATCGTT ACCAGCCTCC TTTAAATCCA CTTCTGGCCT GCCAGGAATC
5'-CTGCAGTGGT AAAAAGATTC TATATCTGCT GTTTGATGAA TGCAGCACCC ACTAGCCACA TAGTGCTCGT
GAGCACTTGC AATCCGGCTA GGGTGATTTC AATTAACCTA AAAGAGAACA GCCACAGGGA GCATGTGGCT
GCCATATTGG ATGGTGCTGC TTTGAGAACA AAATGAGAGA AATGAAGCCT CTATTTACCT TGGTTGGCGG
AACACATTGA AGGGACTCTG TATTGATACC AGGCTTCAAA CTTTGGGAAG TGTACTGGCC AACTTAAACA
CATCCACAGG AGAATGAAGA GGTTTGGGAA GGGACCAGAA ACCAGGCATT GAGGACAATG AGAAGAGTTT
TTCAAAAGTG GAATTACTGC AAAAAGTGGA AAAATAGCCT TTGGATGGAA GTTACTGATG AGACAATTTC
CATCGGTGTG AAAGCCATCT TTCCAACAGA GATCTGCAAC ATGAGAATGT ACTGTCTCCT AGGGTAGCGA
TGGCCTCTTG TATTAGTCCG CTCAGGCTAC CAGATTTATC GTTTAAACTG CCCATAAACA GACCAGGCAG
TTTAAACAAC AGAAATTTAT TTCCTCGCAG TCCTGGAGGC AGGAAGTCTG CGATCAAGGT GGAAGCAGGG
TTGGCTTCTT CTCAGGTGTC TGTCCTTGGC TGGTAGATGA CCGCCGCCTC CCTGGGTCCT CACATGGTCT
TTCCTCTGTG TGTGTCTGTC CCAATCTCTT CTTATAAGGA TGCAAGTCTT ATGGATCAGA GCACACCCCA
ATGACCGTGT TTAACTTGAA TCACCTCTTT AAAGTTTCTC TCTCCAAATA CAATCACCTC CTGAGGCACT
GTTAGGGCTT CGACACAGGA ATTCTTTTCC TAGGGGATTC AGTTCAGTCC AAAACGCCTA CCAGTGGAGA
CTTGCAACAT GGCGGCCTGC TGGTCCCTCG CCAGGAATAT CACAGGCGAC TGTTCCCTGT TGCATGGAAT
AGAAGGCTAT TCCAGAGTAC TGTCTCTATT TATCAGATCT GGGATACTGG AGAAGGGCA AAATAAAGTC
CAAGTAGAAA AAAAAACTAT GAAAGTTTTA GAGAGTAACC ATAATTTCAG CCCGATGTGA AACGATCCTA
GATTTCAGCT GAAATAGTGA TGTGGGAAGT GAGGGGCCG GGATTCAAGG CAGAGGGAAC AGCGTAACTG
AAGGCATGGA AGGAGGGAAG TGTAGGCTGT GTTTGAAGAG TGGCAGCTGC TTCCACATTT CTAAAACACA
GGATGTGATT TTGCGGTGTG TTGAGACAAG GCAGAAAACT TGTTTGGAAA ATAACTTGA ATTCCCTGCA
CATTTAAAAT CTCTCAGCAG AAGAAAACCC CACTCAGAAC CCCACTGTTC ATTCCTTGGC TTGTATTTGG
SCACAGCTGG CATAGCCCCA GACTGAGTAA GCTCTTCAGA CACCTCATTT CATGAGTAGC CCCAAAGATC
AATCATGGGC CAATTTCTTG GAAGAGAAGA CTCTCCGGTG TTTTGCAGTT ATTTGTTCTG CTTTCGCGAG
ATGTTCTCAA ATCCTTGCAG CTACAAGCCA TGAGTCTGAA GTGTTTGTGT TCCCTCCTTA CAGGTGGTAA
CTTTCTCACA GGCCTTGGCC ACAGATCTGA TCATTACAAT TGCGTCAGCA GTGGAGGGCA ATGTCTCTAT
TCTGCCTGCC CGATCTTTAC CAAAATTCAA GGCACCTGTT ACAGAGGGAA GGCCAAGTGC TGCAAGTGAG
CTGAGAGTGA CCAGAAGAAA TGACGCAGAA GTGAAATGAA CTTTTTATAA GCATTCTTTT AATAAAGGAA
AATTGCTTTT GAAGTATACC TCCTTTGGGC CAAAATGAAT CTTGTGTCTC AATTGGAAGA GGTAAAGAAG
```

TAGGGGGTTA GGGTGCATGG GTTGGAACGT GAGACAGGTC GAACCACAAA GCCTGCCTGG AAAAGGGGAG

TGACGTCCTA GGCTTCAGTG ATGTCACCTC CACTTTGTTT GATCCACAAA CCAACAGGTG ACTGATTTTG-3'

(FRAG. NO: _ ) (SEQ. ID NO: 2474)

5'-GCTCAGCCTC CAAAGGAGCC AGCCTCTCCC CAGTTCCTGA ATCCTGAGT GTTGCCTGCC AGTCGCCATG

AGAACTTCCT ACCTTCTGCT GTTTACTCTC TGCTTACTTT TGTCTGAGAT GGCCTCAGGT GGTAACTTTC

TCACAGGCCT TGGCCACAGA TCTGATCATT ACAATTGCGT CAGCAGTGGA GGGCAATGTC TCTATTCTGC

CTGCCCGATC TTTACCAAAA TTCAAGGCAC CTGTTACAGA GGGAAGGCCA AGTGCTGCAA GTGAGCTGGG

AGTGACCAGA AGAAATGACG CAGAAGTGAA ATGAACTTTT TATAAGCATT CTTTTAATAA GGAAAATTG

CTTTTGAAGT AT-3' (FRAG. NO: _ ) (SEQ. ID NO: 2472)

5'-CCGGGGC-3' (FRAG. NO: 1800) (SEQ. ID NO: 1813)

5'-GG GCCTGCBGGG CC-3' (FRAG. NO: 1801) (SEQ. ID NO: 1814)

5'-GGCBGCB BGG-3' (FRAG. NO: 1802) (SEQ. ID NO: 1815)

5'-GGG TCC TCB TGG CTG GGG-3' (FRAG. NO: 1212) (SEQ. ID NO: 1221)

5'-GCC TGG GCC TGC BGG GCC-3' (FRAG. NO: 1213) (SEQ. ID NO: 1222)

5'-GCT CTT GCC TGG BGT GGC TC-3' (FRAG. NO: 1214) (SEQ. ID NO: 1223)

5'-GCC CBG BGT CTT CCC TGG T-3' (FRAG. NO: 1215) (SEQ. ID NO: 1224)

5'-CCGGGGCTGC BGCBBCCTCB TCBGCTCTTG CCTGGBGTGG CTCBGCCTGG GCCTGCBGGG CCBCCBGGBG

BBTGGCBGCB BGGBTGGCGB GGGTCCTCBT GGCTGGGGTC BCBGBTCCTC TBGCTBGGCB GGGTGBCCBG

BGBGGGC-3' (FRAG. NO: 1803) (SEQ. ID NO: 1816)

Human Defensin 2 Nucleic Acid and Antisense Oligonucleotide Fragments

5'-ATCCTTTAAG TCAATGGACT TTGCATCAGT CACACCATCT TTTGTTACTT TGGACTTCCC CAGCTATGTT

CAATAATTAC TGTTCTTCCC TTGGGCCCCA TTGTAATGGC TACAGCCTCG ACAAAAAGTC TACACTTTGA

AGCATTAAGG CTCGGACATC AGCACCAAAT TTTACATCTT TACCATCACT TCAAGTGAGG TGAGGAGCCA

GTAGCCTGGA CACTGGTCTC ATCTGGTGAA AGACTGTGGG TAATGAAGC ATTTCTGTGG GGTGCTGGCA

GGACATGTGC ATGGCGAGGC AGGTCATCAG CAGCAAGTGA GAGCTGCCTC TTACTTTCTA AAGGTGACAT

AGCAAATATA CAAAAAAAAA TAAATAAATT ATTAATTTAG GTAGAGCACA TAAAGGCTTT ATTTCATATT

CCATTTCTCT GTATGCTTTC TTCACCAGGA AGAAATAGTT TTAGTGTCAG GAATGAATGA GTCTGCCCCT

CAATTCCAGC CTGCTCAACA CACAAGGAAA CAAAGCCCTG ACAATCAGAG TGACTCCCTG GTGACTAAGC

TCCCAGTCCT GGATGCATAT TTGTTTAGCA GTTCTGACAG CATTTGACCC AGCCCTCTCT CTGCATATCC

CATCAGAACC TTCTTTTTTT TTTTTTTCTT TGAGACTGAG TCTTGCTCTG TCGGAAGCGA CTCCTGTGCC

TCAGCCTCCC AAATACCTGG AATTATAGGC GTAAGCCATC ATGCCTGGCT AATTTTTGTA TTTTTCATGG

AGATGGGGTT TTGCCATGTT GGTCAAATTG GTCTCACACT CCTGACCTCA TGTGATCCAC CTGCCTCAGC

CTCCCAAACT GCTCGGATGA CAGGTGTAAG CCACCATGCT AGGCTCAGAA ATTTCCTTTT ATAAAAATGT

CATTAAGGAT CTTCGCTGCA CAATATCGTT ACCAGCTTCC TTTAAATCCA CTTCTGGCCT GCCAGGAATC

AGGTTCTTCA GAACCTGACA TTTTAAATGA AGAGGTCAGG CAGTTCATGA GGAAAGCCTC ATTGTCCCCA

TGTCTCTGTC ACTGCTGCAC CCCTGAGACA TCACAGACAT GGACACTGGG GCCTGCTTGT TTCTCAAACT

GCCCTTAGAT CGAAAGAGGG AGGAACCAGG ATGAATGCCA CTCATTTTCC CAAGAAAGGC CCTCTCCTGA

GTGCCCGGGA TGGGGCTCTG TCCATTGCCT GGGGCCGCCA ATTGCTACTC TGGGTTACGG AGGAAGGACA

GGGTCCTGAG AGACACCAGA GACCTCACAC AGCCCTGAAA ACATGGGGCT CCTTCATAAG TGTTTCCCAT

-continued

```
CACCAACAGG GAGACCACGT GGAGGCCTTG CAGCCCCACT CGGTGCTTCT CCACCAAATC CCAAGGGCAG
TGACGCTGAC GTCTGTGGAA AGCAGAGAAA GCCCTGGCTC CCAAAGCCCT GAAGTCCCTG TGGAGCTGAC
ATTCCCTGAG TGACGGTGTG AATGGAAGGA ACTCAAGTGC GGGTGGTAGG CCACCTCCTG GCCCAGGCCT
GGGTGAACTC TGAGGGGACA CATGTAGTCA CAATCCCATC CTCCCATTCT CCTTCTCAGA GGAAGGAAGT
GGGCATCCAT CTGCCTCATC TCTCTCCCGT GGGGAAGATG GGGAGTTTCA GGGAACTTT CACATAAATT
TCACCAGCTC AGATCTCCTG TGAGGATGGG GCCCACCATG CTCCCGGTGC TGCCAGAGGC CCTGAGCCCC
TCCCAGGGTC CCTGGGTTTG AGCCAGCCCT GTATCATCCC CAGGAGCTGA ATGTCAGAGC AATGGATAGA
ATTAGATGGA AAGAGCTCTC AATTTGACCT GAGACTGTCC CCAGATACTC AGGAAAAACA GGACGTCGCA
CAGAGTGGGC AGCAGGTGAG TGGCAGGTTA TAGGTCCTGA GTTTGAGTTT GTTCTCACGT GAGACAGACC
CAGCCCCTCA CTCCATTCAC ACACTGGGTT TTAAATGGTG CAAGATAGGA GCAATTTTCT GGTCCCAAGA
GCAGGAGGAA GGGATTTTCT GGGGTTTCCT GAGTCCAGAT TTGCATAAGA TCTCCTGAGT GTGCATTGTT
CTTTGAGGAC CATTCTCTGA CTCACCAGGT AAGTGGCTGA ATTCTAACCT CTGTAATGAG CATTGCACCC
AATACCAGTT CTGAACTCTA CCTGGTGACC AGGGACCAGG ACCTTTATAA GGTGGAAGGC TTGATGTCCT
CCCCAGACTC AGCTCCTGGT GAAGCTCCCA GCCATCAGCC ATGAGGGTCT TGTATCTCCT CTTCTCGTTC
CTCTTCATAT TCCTGATGCC TCTTCCAGGT GAGATGGGCC AGGGAAATAG GAGGGTTGGC CAAATGGAAG
AATGGCGTAG AAGTTCTCTG TCTCCTCTCA TTCCCCTCCA CCTATCTCTC CCTCATCCCT CTCTCTCCTT
CCTCTCTCTG TGTGTCCCCT CCATCCTTTT CTCCTGCTTC TCTCTCTTCT TCCCTCTCTC TCTTTTTTCT
GTCTTTCTTT TTCCTCTCTC CCTAGAGCAT GTCTTTCTTT CTTTCTCTTT CCTTTCTTCT ACCCACACTT
TTAGACTGAA TGCCCTATTT AATTGAACAA AGCATTGCTT CCTTCAATAG AAAAGGAGTT TGAGAACCCA
ATGGACACCT CACTCGTTCT TCTAAGCCAA TATGAAGGAG CCCAGTAGCT TGTAAATATC ATCTCTTCAC
TGCTTTCCAT GCTACAACTG CTGAGACTAT GGTTGAAACC TGTTAGGTGA CTTTTTAAAT AAAAGGCAGA
AATTTTGATT TTATCTAAAG AAAGTAGTAT AGAATGTCAT TTTCTAAATT TTTATATTTA AAGGGTAGAT
ACTGCAACCT AGAGAATTCC AGATAATCTT AAGGCCCAGC CTATACTGTG AGAACTACTG CAGCAAGACA
CTCTGCCTCC AGGACTTTTC TGATCAGAGG CCCTGAGAAC AGTCCCTGCC ACTAGGCCAC TGCAGGTTCA
CAGGACAGGG TACAGCCCAT TGAAACCTAC TTTTAAACCT GGATGCCTAA CCTTCATTTT CTCCTTGATA
TTATGAAAAT AAAATAAAAA CCATGAAAGG ATAAAAGAGG GAGAGTGGAA GGGAAGGATG GAGAAAGGGA
AAAAGAAAAT TTGAGAGTAA ATCCTAAAAC AATTAATCTA ATAGATATCA TCTTGTGAAA TCCTCATTTT
ACCAATCTTA TTTATGAGTC CTGGGTTTTG TGAGAACAAT GGGGTTCTGA GAGGCACCAG AGACCTCATG
TTTTCCAAAA CCTAGAACAG TATAATGAAG GAAGGCGGGG AGGCAGGGAG GCAGGGAGGC AGGGAGGCAG
GGAGGCGGGC AGGTGGGGAG GGAGGGACGG AAGGAGGGAG GGAGGGAGGG AGGGAGGGAG GGAGGGATAA
AAAAAGAAGA ATGAGGTTGA AACCAGGACT TAGATATTAG AAACAAGCCA TTACAAAATT TATTTCTATG
GTTAATTGTG GTTTTCAACT GTAAGTTACT TGGTGTTAAT TTCCTATTAA ACAATTTCAG TAAGTTGCAT
CTTTTTATCC CATCTCAGGT CAAATACTTA ACAGACTAAA TGATTTGAAA AAGCAAAAGT TTACTGGCTT
GTGTGTGTTA AAATGGAGGT ATGGTGGCTT TGATATTATC TTCTTGTGGT GGAGCTGAAT TCACAAGAGA
TCGTTGCTGA GCTCCTACCA GACCCCACCT GGAGGCCCCA GTCACTCAGG AGAGATCAGG GTCTTTCACA
ATCAGGTTCT ACAAAAATAA ACATCCCCCC AACCACAGCA GTGCCAGTTT CCATGTCAGA AACTTAGATC
CAAATGACTC ACTCGCGTCT CATTATCATG ATGGAAAAGC CCAGGCTTGA GAAAGAAGCC CGCTGCGGAT
TTACTCAAGG CGATACTGAC ACAGGGTTTG TGTTTTTCCA ACATGAGTTT TGAGTTCTTA CACGCTGTTT
GCTCTTTTTG TGTGTTTTTT CCCTGTTAGG TGTTTTTGGT GGTATAGGCG ATCCTGTTAC CTGCCTTAAG
AGTGGAGCCA TATGTCATCC AGTCTTTTGC CCTAGAAGGT ATAAACAAAT TGGCACCTGT GGTCTCCCTG
```

-continued

```
GAACAAAATG CTGCAAAAAG CCATGAGGAG GCCAAGAAGC TGCTGTGGCT GATGCGGATT CAGAAAGGGC
TCCCTCATCA GAGACGTGCG ACATGTAAAC CAAATTAAAC TATGGTGTCC AAAGATACGC AATCTTTATC
CTAGTAATTG TGGTCATTGG GTGATGTTGG TTTGGGCAGG CCATCTCTAA TATCCTTGAA ACACCTTTTT
CTGCTCTCCA GGAAGGGGTC AGGGCTGCCA CAGCGGGCT TGGAGTGCTT TCCAGGGTCA CAGGCATCTG
TATTCTTTGG ATTCCTTGAC CTTCCCCATT TATTCCCGGC ATTTTCCTAA AACGTGTGCT TTGCTCCTCC
TGCATCCTCC CCTTGCATGC CCTCACCTAC CCCACATCTT CCCTAAAAAA AGCAAGCCCA ACTCAAAGAC
CAGTTCCCTC ATGGAATCAT AGTGGATCTG CCAAGGGAGG GGATGCCCAG TCCTCTGTTC TTCACAAGAC
TCCCTTCTTC TGGCTAAGGT TTCTTATGCA ATTAT GAATTCACAT TTCTCACCTT TGATGTATT AAGAAAGTAT
GGAGAAATAT ATCCTCTATC AAATTTTCAT GCCTTCAATA ATTTCTAATT CATCAGTCAG TGTTTTTCCA
TCCTTTACTG TGATGATGCC CTTTCTTCCA AACTTTTTCA TTGCATCAGA GATGATGTTA CCAATTTCTT
TGTCTCCATT TGCAGAAATT GTAGCAACCT GTGCAATTTC TTCAGGTTTG GTCACAGGTT TAGACTGCTT
TTTAAGTTCA GCAATTACAG CATCAACAGC TAACATCACA CCTCTCTTGA TTTCCACTGG ATTAGCACCT
TTGCTAACCT TCTGGAAGGC TTATTTGGAA ATAGAGCATA CCAGTACAGC AGCAGTGATA GTGCCATCCC
CCAGTCTCTC CATTTGTGTT ATTGGCAACA TCTTGGACAA GTTTAGCTCC AATGCTTTTA TATTTATCCT
TTAAGTCAAT TGACTTTGCA TCAGTCACAC CATCTTTTGT TACTTTGGGA CTTCCCCAGC TATGTTCAAT
AATTACTGTT CTTCCCTTTG GCCCCATTGT AATGGCTACA GCATCGACAA AAGTCTACA CTTTGAAGCA
TTAAGGCTCA GACATCAGCA CCAAATTTTA CATCTTTACC ATCACTTCAA GTGAGGTGAG GAGCCAGTAG
CCTGGACACT GGTCTCATCT GGTGAAAGAC TGTGGGTAAT GGAAGCATTT CTGTGGGGTG GTGGCAGGAC
ATGTGCATGG TGAGGCAGGT CATCAGCAGC AAGTGAGAGC TGCCTCTTAC TTTCTAAAGG TGACATAGCA
AGTATACAAA AAAAAATAAA ATATTAATTT AGGCAGAGCA CATAAAGGCT TTATTTCATA TTCCATTTCT
CTGTATGCTT TCTTCACCAG GAAGAAATAG TTTTAGTGTC AGGAATGAAT GAGTCTGCCC CTCAATTCCA
GCCTGCTCAG CACACAAGGA AACAAAGCCC TGACAATCAG AGTGACTCCC TGGTGACTAA GCTCCAGTCC
TGGATGCATA TTTGTTTAGC AGTTCTGACA GCATCTGACC CAGCCCTCTC TTTGCATACC CCACCAGAAC
CTTCTTTTTT TTTTTTTTTC TTTGAGACTG AGTCTTGCTC TGTCGGAAGC GATTCCCGTG CCTCAGCCTC
CCAAATACCT GGAATTATAG GCGTAAGCCA TCATGCCTGG CTAATTTTTG TATTTTTCAT GGAGATGGGG
TTTTGCCATG TTGGTCAAAT TGGTCTCACA CTCCTGACCT CATGTGATCC ACCTGCCTCA GCCTCCCAAA
GTGCTGGGAT GACAGGTGTA AGCCACCATG CTAGGCTCAG AAATTTCCTT TTATAAAAAT GTCATTAAGG
ATCTTGGCTG CACAATATCG TTACCAGCTT CCTTTAAATC CACCTCTGGC CTGCCAGGAA TCAGGGTTCT
TCAGAACCTG ACATTTTAAA TGAAGAGGTC AGGCAGGTCA TGAGGAAAGC CTCATTGTCC CCATGTCTCT
GTCACTGCTG CACCCCTGAG ACATCACAGA CATGGACACT GGGGCCTGCT TGTTTCTCAA ACTGCCCTTA
GATCGAAAGA GGGAGGAACC AGGATGAATG CCACTCATTT TCCCAAGAAA GGCCCTCTCC TGAGTGCCCG
GGATGGGGCT CTGTCCATTG CCTGGGGCCG CCAATTGCTA CTCTGGGTTA CGGAAGAAGG ACAGGGTCCT
GAGAGACACC AGAGACCTCA CACAGCCCTG AAAACATGGG GCTCCTTCAT AAGTGTTTCC CATCACCAAC
AGGGAGACCA CGTGGAGGCC TTGCAGCCCT ACTCGGTGCT TCTCCACCAA ATCCCAAGGG CAGTGACGCT
GACGTCTGTG GAAAGCAGAG AAAGCCCTGG CTCCCAAAGC CCTGAAGTCC TGTGGAGCTG ACATTCCCTG
AGTGACGGTG TGAATGGAAG GAACTCAAGT GCGGGTGGTA GGCCACCTCC TGGCCCAGGC CTGGGTGAAC
TCTGAGGGGA CACATGTAGT CACAATCCCA TCCTCCCATT CTCCTTCTCA GAGGAAGGAA GTGGGCATCC
ATCTGCCTCA TCTCTCTCCC GTGGGGAAGA TGGGGAGTTT CAGGGAACT TTCACATAAA TTTCACCAGC
TCAGATCTCC TGTGAGGATG GGGCCCACCA TGCTCCCGGT GCTGCCAGAG GCCCTGAGCC CCTCCAGGGT
```

```
CCCTGGGTTT GAGCCAGCCC TGTATCATCC CCAGGAGCTG AATGTCCGAA CAATGGATAG AATTAGATGG
AAAGAGCTCT CAATTTGGCC TGAGACTGTC CCCAGATACT CAGGAAAAAC AGGACGTCGC ACAGAGTGGG
CAGCAGGTGA GTGGCAGGTT ATAGGTCCTG AGTTTGAGTT TGTTCTCACG TGAGACAGAC CCAGCCCCTC
ACTCCATTCA CACACTGGGT TTTAAATGGT GCAAGATAGG AGGAATTTTC TGGTCCCAAG AGCAGGAGGA
AGGGATTTTC TGGGGTTTCC TGAGTCCAGA TTTGCATAAG ATCTCCTGAG TGTGCATTGT TCTTTGAGGA
CCATTCTCTG ACTCACCAGG TAAGTGGCTG AATTCTAACC TCTGTAATGA GCATTGCACC CAATACCAGT
TCTGAACTCT ACCTGGTGAC CAGGGACCAG GACCTTTATA AGGTGGAAGG CTTGATGTCC TCCCCAGACT
CAGCTCCTGG TGAAGCTCCC AGCCATCAGC CATGAGGGTC TTGTATCTCC TCTTCTCGTT CCTCTTCATA
TTCCTGATGC CTCTTCCAGG TGAGATGGGC CAGGGAAATA GGAGGGTTGG CCAAATGGAA GAATGGCGTA
GAAGTTCTCT GTCTCCTCTC ATTCCCCTCC ACCTATCTCT CCCTCATCCC TCTCTCTCCT TCCTCTCTCT
GTGTGTCCCC TCCATCCTTT TCTCCTGCTT CTCTCTCTTC TTCCCTCTCT CTCTTTTTTT CTGTCTTTCT
TTTTCCTCTC TCCCTAGAGC ATGTCTTTCT TTCTTTCTCT TTCCTTTCTT CTACCCACAC TTTTAGACTG
AGTAGACTGA ATGCCCTATT TAATTGAACC AAGCATTGCT TCCTTCAATA GAAAAGGAGT TTGAGAACCC
AATGGACAAC TCACTCGTTC TTCTAAGCCA ATATGAAGGA GCCCAGTAGT TTGTAAATAT CATCTCTTCA
CTGCTTTCCA TGCTACAACT GCTGAGACTA TGGTTGAAAC CTGTTAGGTG ACTTTTTAAA TAAAAGGCAG
AAATTTTGAT TTTATCTAAA GAAAGTAGTA TAGAATGTCA TTTTCTAAAT TTTTATATTT AAAGAGTAGA
TACTGCAACC TAGAGAATTC CAGATAATCT TAAGGCCCAG CCTATACTGT GAGAACTACT GCAGCAGACA
CTCTGCCCCC AGGACTTTTC TGATCAGAGG CCCTGAGAAC AGTCCCTGCC ACTAGGCCAC TGCAGGTTCA
CAGGACAGGG ACAGCCCATT GAAACCAACT TTTAAACCTG GATGCCTAAC CTTCATTTTC TCCTTGATAT
TATGAAAATA AATAAAAAC CATGAAAGGA TAAAAGAGGG AGAGTGGAAG GAAGGATGG AGAAAGGGAA
AAAGAAAATT TGAGAGTAAA TCCTAAAACA ATTAATCTAA TAGATATCAT CTTGTGAAAT CCTCATTTTA
CCAATCTTAT TTATGAGTCC TGGGTTTTGT GAGAACAATG GGGTTCTGAG AGGCACCAGA GACCTCATAT
TTTCCAAAAC CTAGAACAGT ATAATGAAGG AAGGAGGGAA GGAGGGAGGG AGGGAGGGAA GGAGGGAAGG
AGGGAGGGAG GGAGGGAAAC AAAAAGAAGA ATGAGGTTGA AACCAGGACT TAGATATTAG AAACAAGCCA
TTACAAAATT TATTTCTATG GTTAATTGTG GTTTTCAACT GTAAGTTACT TGGTGTTAAT TTCCTATTAA
ACAATTTCAG TAAGTTGCAT CTTTTTTATC CCATCTCAGA TCAAATACTT AACAGACTAA ATGATTTGAA
AAAGCAAAAG TTTACGGGCT TGTGTGTGTT AAAATGGAGG TATGGTGGCT TTGATATTAT CTTCTTGTGG
TGGAGCTGAA TTCACAAGAG ATCGTTGCTG AGCTCCTGCC AGACCCCACC TGGAGGCCCC AGTCACTCAG
GAGAGATCAG GGTCTTTCAC AATCAGGTTC TACAAAAATA AACATCCCCC AAACCACAGC AGTGCCAGTT
TCCATGTCAG AAACTTAGAT CCAAATGACT GACTCGCGTC TCATTATCAT GATGGAAAAG CCCAGGCTTG
AGAAAGAAGC CCGCTGCGGA TTTACTCAAG GCGATACTGA CACAGGGTTT GTGTTTTTCC AACATGAGTT
TTGAGTTCTT ACACGCTGTT TGCTCTTTTT GTGTGTTTTT TCCCTGTTAG GTGTTTTTGG TGGTATAGGC
GATCCTGTTA CCTGCCTTAA GAGTGGAGCC ATATGTCATC CAGTCTTTTG CCCTAGAAGG TATAAACAAA
TTGGCACCTG TGGTCTCCCT GGAACAAAAT GCTGCAAAAA GCCATGAGGA GGCCAAGAAG CTGCTGTGGC
TGATGCGGAT TCAGAAAGGG CTCCCTCATC AGAGACGTGC GACATGTAAA CCAAATTAAA CTATGGTGTC
CAAAGATACG CAATCTTTAT CCTAGTAATT GTGGTCATTG GGTGATGTTG GTTTGGGCAG GCCATCTCTA
ATATCCTTGA AACACCTTTT TCTGCTCTCC AGGAAGGGGT CAGGGCTGCC ACAGCGGGGC TTGGAGTGC-3'
```
(FRAG. NO: _ ) (SEQ. ID NO: 3011)

```
5'-GAATTCACAT TTCTCACCTT TTGATGTATT AAGAAAGTAT GGAGAAATAT ATCCTCTATC AAATTTTCAT
GCCTTCAATA ATTTCTAATT CATCAGTCAG TGTTTTTCCA TCCTTTACTG TGATGATGCC CTTTCTTCCA
```

```
AACTTTTTCA TTGCATCAGA GATGATGTTA CCAATTTCTT TGTCTCCATT TGCAGAAATT GTAGCAACCT
GTGCAATTTC TTCAGGTTTG GTCACAGGTT TAGACTGCTT TTTAAGTTCA GCAATTACAG CATCAACAGC
TAACATCACA CCTCTCTTGA TTTCCACTGG ATTAGCACCT TTGCTAACCT TCTGGAAGGC TTATTTGGAA
ATAGAGCATA CCAGTACAGC AGCAGTGATA GTGCCATCCC CCAGTCTCTC CATTTGTGTT ATTGGCAACA
TCTTGGACAA GTTTAGCTCC AATGCTTTTA TATTTATCCT TTAAGTCAAT TGACTTTGCA TCAGTCACAC
CATCTTTTGT TACTTTGGGA CTTCCCCAGC TATGTTCAAT AATTACTGTT CTTCCCTTTG GCCCCATTGT
AATGGCTACA GCATCGACAA AAAGTCTACA CTTTGAAGCA TTAAGGCTCA GACATCAGCA CCAAATTTTA
CATCTTTACC ATCACTTCAA GTGAGGTGAG GAGCCAGTAG CCTGGACACT GGTCTCATCT GGTGAAAGAC
TGTGGGTAAT GGAAGCATTT CTGTGGGGTG GTGGCAGGAC ATGTGCATGG TGAGGCAGGT CATCAGCAGC
AAGTGAGAGC TGCCTCTTAC TTTCTAAAGG TGACATAGCA AGTATACAAA AAAAAATAAA ATATTAATTT
AGGCAGAGCA CATAAAGGCT TTATTTCATA TTCCATTTCT CTGTATGCTT TCTTCACCAG GAAGAAATAG
TTTTAGTGTC AGGAATGAAT GAGTCTGCCC CTCAATTCCA GCCTGCTCAG CACACAAGGA AACAAAGCCC
TGACAATCAG AGTGACTCCC TGGTGACTAA GCTCCAGTCC TGGATGCATA TTTGTTTAGC AGTTCTGACA
GCATCTGACC CAGCCCTCTC TTTGCATACC CCACCAGAAC CTTCTTTTTT TTTTTTTTTC TTTGAGACTG
AGTCTTGCTC TGTCGGAAGC GATTCCCGTG CCTCAGCCTC CCAAATACCT GGAATTATAG GCGTAAGCCA
TCATGCCTGG CTAATTTTTG TATTTTTCAT GGAGATGGGG TTTTGCCATG TTGGTCAAAT TGGTCTCACA
CTCCTGACCT CATGTGATCC ACCTGCCTCA GCCTCCCAAA GTGCTGGGAT GACAGGTGTA AGCCACCATG
CTAGGCTCAG AAATTTCCTT TTATAAAAAT GTCATTAAGG ATCTTGGCTG CACAATATCG TTACCAGCTT
CCTTTAAATC CACCTCTGGC CTGCCAGGAA TCAGGGTTCT TCAGAACCTG ACATTTTAAA TGAAGAGGTC
AGGCAGGTCA TGAGGAAAGC CTCATTGTCC CCATGTCTCT GTCACTGCTG CACCCCTGAG ACATCACAGA
CATGGACACT GGGGCCTGCT TGTTTCTCAA ACTGCCCTTA GATCGAAAGA GGGAGGAACC AGGATGAATG
CCACTCATTT TCCCAAGAAA GGCCCTCTCC TGAGTGCCCG GGATGGGGCT CTGTCCATTG CCTGGGGCCG
CCAATTGCTA CTCTGGGTTA CGGAAGAAGG ACAGGGTCCT GAGAGACACC AGAGACCTCA CACAGCCCTG
AAAACATGGG GCTCCTTCAT AAGTGTTTCC CATCACCAAC AGGGAGACCA CGTGGAGGCC TTGCAGCCCT
ACTCGGTGCT TCTCCACCAA ATCCCAAGGG CAGTGACGCT GACGTCTGTG GAAAGCAGAG AAAGCCCTGG
CTCCCAAAGC CCTGAAGTCC TGTGGAGCTG ACATTCCCTG AGTGACGGTG TGAATGGAAG GAACTCAAGT
GCGGGTGGTA GGCCACCTCC TGGCCCAGGC CTGGGTGAAC TCTGAGGGGA CACATGTAGT CACAATCCCA
TCCTCCCATT CTCCTTCTCA GAGGAAGGAA GTGGGCATCC ATCTGCCTCA TCTCTCTCCC GTGGGGAAGA
TGGGGAGTTT CAGGGGAACT TTCACATAAA TTTCACCAGC TCAGATCTCC TGTGAGGATG GGGCCCACCA
TGCTCCCGGT GCTGCCAGAG GCCCTGAGCC CCTCCAGGGT CCCTGGGTTT GAGCCAGCCC TGTATCATCC
CCAGGAGCTG AATGTCCGAA CAATGGATAG AATTAGATGG AAAGAGCTCT CAATTTGGCC TGAGACTGTC
CCCAGATACT CAGGAAAAAC AGGACGTCGC ACAGAGTGGG CAGCAGGTGA GTGGCAGGTT ATAGGTCCTG
AGTTTGAGTT TGTTCTCACG TGAGACAGAC CCAGCCCCTC ACTCCATTCA CACACTGGGT TTTAAATGGT
GCAAGATAGG AGGAATTTTC TGGTCCCAAG AGCAGGAGGA AGGGATTTTC TGGGGTTTCC TGAGTCCAGA
TTTGCATAAG ATCTCCTGAG TGTGCATTGT TCTTTGAGGA CCATTCTCTG ACTCACCAGG TAAGTGGCTG
AATTCTAACC TCTGTAATGA GCATTGCACC CAATACCAGT TCTGAACTCT ACCTGGTGAC CAGGGACCAG
GACCTTTATA AGGTGGAAGG CTTGATGTCC TCCCCAGACT CAGCTCCTGG TGAAGCTCCC AGCCATCAGC
CATGAGGGTC TTGTATCTCC TCTTCTCGTT CCTCTTCATA TTCCTGATGC CTCTTCCAGG TGAGATGGGC
CAGGGAAATA GGAGGGTTGG CCAAATGGAA GAATGGCGTA GAAGTTCTCT GTCTCCTCTC ATTCCCCTCC
```

-continued

```
ACCTATCTCT CCCTCATCCC TCTCTCTCCT TCCTCTCTCT GTGTGTCCCC TCCATCCTTT TCTCCTGCTT
CTCTCTCTTC TTCCCTCTCT CTCTTTTTTT CTGTCTTTCT TTTTCCTCTC TCCCTAGAGC ATGTCTTTCT
TTCTTTCTCT TTCCTTTCTT CTACCCACAC TTTTAGACTG AGTAGACTGA ATGCCCTATT TAATTGAACC
AAGCATTGCT TCCTTCAATA GAAAAGGAGT TTGAGAACCC AATGGACAAC TCACTCGTTC TTCTAAGCCA
ATATGAAGGA GCCCAGTAGT TTGTAAATAT CATCTCTTCA CTGCTTTCCA TGCTACAACT GCTGAGACTA
TGGTTGAAAC CTGTTAGGTG ACTTTTTAAA TAAAAGGCAG AAATTTTGAT TTTATCTAAA GAAAGTAGTA
TAGAATGTCA TTTTCTAAAT TTTTATATTT AAAGAGTAGA TACTGCAACC TAGAGAATTC CAGATAATCT
TAAGGCCCAG CCTATACTGT GAGAACTACT GCAGCAGACA CTCTGCCCCC AGGACTTTTC TGATCAGAGG
CCCTGAGAAC AGTCCCTGCC ACTAGGCCAC TGCAGGTTCA CAGGACAGGG ACAGCCCATT GAAACCAACT
TTTAAACCTG GATGCCTAAC CTTCATTTTC TCCTTGATAT TATGAAAATA AAATAAAAAC CATGAAAGGA
TAAAAGAGGG AGAGTGGAAG GGAAGGATGG AGAAAGGGAA AAAGAAAATT TGAGAGTAAA TCCTAAAACA
ATTAATCTAA TAGATATCAT CTTGTGAAAT CCTCATTTTA CCAATCTTAT TTATGAGTCC TGGGTTTTGT
GAGAACAATG GGGTTCTGAG AGGCACCAGA GACCTCATAT TTTCCAAAAC CTAGAACAGT ATAATGAAGG
AAGGAGGGAA GGAGGGAGGG AGGGAGGGAA GGAGGGAAGG AGGGAGGGAG GGAGGGAAAC AAAAAGAAGA
ATGAGGTTGA AACCAGGACT TAGATATTAG AAACAAGCCA TTACAAAATT TATTTCTATG GTTAATTGTG
GTTTTCAACT GTAAGTTACT TGGTGTTAAT TTCCTATTAA ACAATTTCAG TAAGTTGCAT CTTTTTTATC
CCATCTCAGA TCAAATACTT AACAGACTAA ATGATTTGAA AAAGCAAAAG TTTACTGGCT TGTGTGTGTT
AAAATGGAGG TATGGTGGCT TTGATATTAT CTTCTTGTGG TGGAGCTGAA TTCACAAGAG ATCGTTGCTG
AGCTCCTGCC AGACCCCACC TGGAGGCCCC AGTCACTCAG GAGAGATCAG GGTCTTTCAC AATCAGGTTC
TACAAAAATA AACATCCCCC AAACCACAGC AGTGCCAGTT TCCATGTCAG AAACTTAGAT CCAAATGACT
GACTCGCGTC TCATTATCAT GATGGAAAAG CCCAGGCTTG AGAAAGAAGC CCGCTGCGGA TTTACTCAAG
GCGATACTGA CACAGGGTTT GTGTTTTTCC AACATGAGTT TTGAGTTCTT ACACGCTGTT TGCTCTTTTT
GTGTGTTTTT TCCCTGTTAG GTGTTTTTGG TGGTATAGGC GATCCTGTTA CCTGCCTTAA GAGTGGAGCC
ATATGTCATC CAGTCTTTTG CCCTAGAAGG TATAAACAAA TTGGCACCTG TGGTCTCCCT GGAACAAAAT
GCTGCAAAAA GCCATGAGGA GGCCAAGAAG CTGCTGTGGC TGATGCGGAT TCAGAAAGGG CTCCCTCATC
AGAGACGTGC GACATGTAAA CCAAATTAAA CTATGGTGTC CAAAGATACG CAATCTTTAT CCTAGTAATT
GTGGTCATTG GGTGATGTTG GTTTGGGCAG GCCATCTCTA ATATCCTTGA ACACCTTTT TCTGCTCTCC
AGGAAGGGGT CAGGGCTGCC ACAGCGGGGC TTGGAGTGC-3' (FRAG. NO: _ ) (SEQ. ID NO: 2476)
5'-ATCCTTTAAG TCAATGGACT TTGCATCAGT CACACCATCT TTTGTTACTT TGGACTTCCC CAGCTATGTT
CAATAATTAC TGTTCTTCCC TTGGGCCCCA TTGTAATGGC TACAGCCTCG ACAAAAAGTC TACACTTTGA
AGCATTAAGG CTCGGACATC AGCACCAAAT TTTACATCTT TACCATCACT TCAAGTGAGG TGAGGAGCCA
GTAGCCTGGA CACTGGTCTC ATCTGGTGAA AGACTGTGGG TAATGGAAGC ATTTCTGTGG GGTGCTGGCA
GGACATGTGC ATGGCGAGGC AGGTCATCAG CAGCAAGTGA GAGCTGCCTC TTACTTTCTA AAGGTGACAT
AGCAAATATA CAAAAAAAAA TAAATAAATT ATTAATTTAG GTAGAGCACA TAAAGGCTTT ATTTCATATT
CCATTTCTCT GTATGCTTTC TTCACCAGGA AGAAATAGTT TTAGTGTCAG GAATGAATGA GTCTGCCCCT
CAATTCCAGC CTGCTCAACA CACAAGGAAA CAAAGCCCTG ACAATCAGAG TGACTCCCTG GTGACTAAGC
TCCCAGTCCT GGATGCATAT TTGTTTAGCA GTTCTGACAG CATTTGACCC AGCCCTCTCT CTGCATATCC
CATCAGAACC TTCTTTTTTT TTTTTTTCTT TGAGACTGAG TCTTGCTCTG TCGGAAGCGA CTCCTGTGCC
TCAGCCTCCC AAATACCTGG AATTATAGGC GTAAGCCATC ATGCCTGGCT AATTTTTGTA TTTTTCATGG
AGATGGGGTT TTGCCATGTT GGTCAAATTG GTCTCACACT CCTGACCTCA TGTGATCCAC CTGCCTCAGC
```

```
CTCCCAAACT GCTGGGATGA CAGGTGTAAG CCACCATGCT AGGCTCAGAA ATTTCCTTTT ATAAAAATGT
CATTAAGGAT CTTGGCTGCA CAATATCGTT ACCAGCTTCC TTTAAATCCA CTTCTGGCCT GCCAGGAATC
AGGTTCTTCA GAACCTGACA TTTTAAATGA AGAGGTCAGG CAGTTCATGA GGAAAGCCTC ATTGTCCCCA
TGTCTCTGTC ACTGCTGCAC CCCTGAGACA TCACAGACAT GGACACTGGG GCCTGCTTGT TTCTCAAACT
GCCCTTAGAT CGAAAGAGGG AGGAACCAGG ATGAATGCCA CTCATTTTCC CAAGAAAGGC CCTCTCCTGA
GTGCCCGGGA TGGGGCTCTG TCCATTGCCT GGGGCCGCCA ATTGCTACTC TGGGTTACGG AGGAAGGACA
GGGTCCTGAG AGACACCAGA GACCTCACAC AGCCCTGAAA ACATGGGGCT CCTTCATAAG TGTTTCCCAT
CACCAACAGG GAGACCACGT GGAGGCCTTG CAGCCCCACT CGGTGCTTCT CCACCAAATC CCAAGGGCAG
TGACGCTGAC GTCTGTGGAA AGCAGAGAAA GCCCTGGCTC CCAAAGCCCT GAAGTCCCTG TGGAGCTGAC
ATTCCCTGAG TGACGGTGTG AATGGAAGGA ACTCAAGTGC GGGTGGTAGG CCACCTCCTG GCCCAGGCCT
GGGTGAACTC TGAGGGGACA CATGTAGTCA CAATCCCATC CTCCCATTCT CCTTCTCAGA GGAAGGAAGT
GGGCATCCAT CTGCCTCATC TCTCTCCCGT GGGGAAGATG GGGAGTTTCA GGGAACTTT CACATAAATT
TCACCAGCTC AGATCTCCTG TGAGGATGGG GCCCACCATG CTCCCGGTGC TGCCAGAGGC CCTGAGCCCC
TCCCAGGGTC CCTGGGTTTG AGCCAGCCCT GTATCATCCC CAGGAGCTGA ATGTCAGAGC AATGGATAGA
ATTAGATGGA AAGAGCTCTC AATTTGACCT GAGACTGTCC CCAGATACTC AGGAAAAACA GGACGTCGCA
CAGAGTGGGC AGCAGGTGAG TGGCAGGTTA TAGGTCCTGA GTTTGAGTTT GTTCTCACGT GAGACAGACC
CAGCCCCTCA CTCCATTCAC ACACTGGGTT TTAAATGGTG CAAGATAGGA GCAATTTTCT GGTCCCAAGA
GCAGGAGGAA GGGATTTTCT GGGGTTTCCT GAGTCCAGAT TTGCATAAGA TCTCCTGAGT GTGCATTGTT
CTTTGAGGAC CATTCTCTGA CTCACCAGGT AAGTGGCTGA ATTCTAACCT CTGTAATGAG CATTGCACCC
AATACCAGTT CTGAACTCTA CCTGGTGACC AGGGACCAGG ACCTTTATAA GGTGGAAGGC TTGATGTCCT
CCCCAGACTC AGCTCCTGGT GAAGCTCCCA GCCATCAGCC ATGAGGGTCT TGTATCTCCT CTTCTCGTTC
CTCTTCATAT TCCTGATGCC TCTTCCAGGT GAGATGGGCC AGGGAAATAG GAGGGTTGGC CAAATGGAAG
AATGGCGTAG AAGTTCTCTG TCTCCTCTCA TTCCCCTCCA CCTATCTCTC CCTCATCCCT CTCTCTCCTT
CCTCTCTCTG TGTGTCCCCT CCATCCTTTT CTCCTGCTTC TCTCTCTTCT TCCCTCTCTC TCTTTTTTCT
GTCTTTCTTT TTCCTCTCTC CCTAGAGCAT GTCTTTCTTT CTTTCTCTTT CCTTTCTTCT ACCCACACTT
TTAGACTGAA TGCCCTATTT AATTGAACAA AGCATTGCTT CCTTCAATAG AAAAGGAGTT TGAGAACCCA
ATGGACACCT CACTCGTTCT TCTAAGCCAA TATGAAGGAG CCCAGTAGCT TGTAAATATC ATCTCTTCAC
TGCTTTCCAT GCTACAACTG CTGAGACTAT GGTTGAAACC TGTTAGGTGA CTTTTTAAAT AAAAGGCAGA
AATTTTGATT TTATCTAAAG AAAGTAGTAT AGAATGTCAT TTTCTAAATT TTTATATTTA AAGGGTAGAT
ACTGCAACCT AGAGAATTCC AGATAATCTT AAGGCCCAGC CTATACTGTG AGAACTACTG CAGCAAGACA
CTCTGCCTCC AGGACTTTTC TGATCAGAGG CCCTGAGAAC AGTCCCTGCC ACTAGGCCAC TGCAGGTTCA
CAGGACAGGG TACAGCCCAT TGAAACCTAC TTTTAAACCT GGATGCCTAA CCTTCATTTT CTCCTTGATA
TTATGAAAAT AAAATAAAAA CCATGAAAGG ATAAAGAGG GAGAGTGGAA GGGAAGGATG GAGAAAGGGA
AAAAGAAAAT TGAGAGTAA ATCCTAAAAC AATTAATCTA ATAGATATCA TCTTGTGAAA TCCTCATTTT
ACCAATCTTA TTTATGAGTC CTGGGTTTTG TGAGAACAAT GGGGTTCTGA GAGGCACCAG AGACCTCATG
TTTTCCAAAA CCTAGAACAG TATAATGAAG GAAGGCGGGG AGGCAGGGAG GCAGGGAGGC AGGGAGGCAG
GGAGGCGGGC AGGTGGGGAG GGAGGGACGG AAGGAGGGAG GGAGGGAGGG AGGGAGGGAG GGAGGGATAA
AAAAAGAAGA ATGAGGTTGA AACCAGGACT TAGATATTAG AAACAAGCCA TTACAAAATT TATTTCTATG
GTTAATTGTG GTTTTCAACT GTAAGTTACT TGGTGTTAAT TTCCTATTAA ACAATTTCAG TAAGTTGCAT
```

```
CTTTTTATCC CATCTCAGGT CAAATACTTA ACAGACTAAA TGATTTGAAA AAGCAAAAGT TTACTGGCTT

GTGTGTGTTA AAATGGAGGT ATGGTGGCTT TGATATTATC TTCTTGTGGT GGAGCTGAAT TCACAAGAGA

TCGTTGCTGA GCTCCTACCA GACCCCACCT GGAGGCCCCA GTCACTCAGG AGAGATCAGG GTCTTTCACA

ATCAGGTTCT ACAAAAATAA ACATCCCCCC AACCACAGCA GTGCCAGTTT CCATGTCAGA AACTTAGATC

CAAATGACTG ACTCGCGTCT CATTATCATG ATGGAAAAGC CCAGGCTTGA GAAAGAAGCC CGCTGCGGAT

TTACTCAAGG CGATACTGAC ACAGGGTTTG TGTTTTTCCA ACATGAGTTT TGAGTTCTTA CACGCTGTTT

GCTCTTTTTG TGTGTTTTTT CCCTGTTAGG TGTTTTTGGT GGTATAGGCG ATCCTGTTAC CTGCCTTAAG

AGTGGAGCCA TATGTCATCC AGTCTTTTGC CCTAGAAGGT ATAAACAAAT TGGCACCTGT GGTCTCCCTG

GAACAAAATG CTGCAAAAAG CCATGAGGAG GCCAAGAAGC TGCTGTGGCT GATGCGGATT CAGAAAGGGC

TCCCTCATCA GAGACGTGCG ACATGTAAAC CAAATTAAAC TATGGTGTCC AAAGATACGC AATCTTTATC

CTAGTAATTG TGGTCATTGG GTGATGTTGG TTTGGGCAGG CCATCTCTAA TATCCTTGAA ACACCTTTTT

CTGCTCTCCA GGAAGGGGTC AGGGCTGCCA CAGCGGGGCT TGGAGTGCTT TCCAGGGTCA CAGGCATCTG

TATTCTTTGG ATTCCTTGAC CTTCCCCATT TATTCCCGGC ATTTTCCTAA AACGTGTGCT TTGCTCCTCC

TGCATCCTCC CCTTGCATGC CCTCACCTAC CCCACATCTT CCCTAAAAAA AGCAAGCCCA ACTCAAAGAC

CAGTTCCCTC ATGGAATCAT AGTGGATCTG CCAAGGGAGG GGATGCCCAG TCCTCTGTTC TTCACAAGAC

TCCCTTCTTC TGGCTAAGGT TTCTTATGCA ATTAT GAATTCCCTG TAAGCCCTGT TACAGGGGCT GCACCCCAGA

TACAACCTGA CCTGTGTCCA AGGCGGGCAA CTCAACCCTT AGATATTGAA TGGGTCCCAT GGCACCAATG

CTTAAACACC AGCAGCCCTC ACAACCACAG ATCGTGTTTT AAGGATGAGG AGGTAGTTCT CTGGATGCAC

AGGCTTCAAT CCAAATGGGC TCATGACGCC GCAGCACACA CCCAGTCTGC AGCCTGAAGA GTTGGAGCAT

TGCATTCACA GAAAGCATCC AGACATGATC ATGGGCTCAG GGATACACCT GTTCTCCGAT GTGTACCAGT

GAAGGATGGA AACTCCTATG CCTCCCAGAA AGCACCACTC AAGCTTTTGC TGAATGCTTC TCTGAAGGCC

CACAAGGCTG AGAGGCTGTG CAACACCAGC AGTAAAGTGA ATGCCCAGAC TCCCACCTCC TTTCTTGGGT

GGCCATCTGG AAAGGCCACT CCCACCCTGA TGGCTAATGC CTCAGACCAG TTCTTGGCCC AGATGATCCT

AGACAATTGT TTAAGCTTAA ACTGTTCATT GGCCAAGCAA ACAGGTGATA GTACCTCTGG GAACCACAT

GCCGCGTGTA CATCCAGATC TCAGGAGAAC CCAAAAATGT CTGTTCCACA TAGCAACAGA AGCCCAGGTA

GCACTCAGTC TCACCTGGGT GTTCTCCAAC ATCCCAGCTC AGCCAAATGG CTTTCATTAG TTTTTATGGT

TAGACCCCAG GTCCTCGGGA CACTGCTTTA GAAACACATT CCAAATCCTC CTCTGTGTGC AGGTGGCATT

CCTATCCCAA TCTCTTTGCA GGGCGTATAC TGTGATACGC AGCCAGGCTG TCCCAGAGGC CTTAAATATT

CCCTTGGTGC AGGTAGTTCA GCTTAGCCAC AGCCAATGCA TCACAGGGTC AACTGTGTTA GGAGCCATTG

AGAATCCATA GTTGGTTGCT GCCTGGGCCT GGCCAGGGCT GACCAAGGTA GATGAGAGGT TCCTCTGTGG

AGTTCTACTT TAACCTCACC TTCCCACCAA ATTTCTCAAC TGTCCTTGCC ACCACAATTA TTTAATGGAC

CCAACAGAAA GTAACCCCGG AAATTAGGAC ACCTCATCCC AAAAGACCTT TAAATAGGGG AAGTCCACTT

GTGCACGGCT GCTCCTTGCT ATAGAAGACC TGGGACAGAG GACTGCTGTC TGCCCTCTCT GGTCACCCTG

CCTAGCTAGA GGATCTGTAA GTACTACAAA ACTTAAACTT TACACTGAGT TTTCATCATT GAAGCTATGC

CTCCAATCTG ACCTCTGACT GTGGGGCCGC CCCAGAGGGA CCCAGCGGGT GAATCCCTGC TAGGAACGTC

TGTCCGGACC TCTGGTGACT GCTGGGGACG ATGGCTTCCA GCTAACTTAA TAGAGAAACT CAAGCAGTTT

CCTTCTAAAT ACACATGTCA CATGTCCTGG TTGACATGTC CAGTAAGAAG ACTATCACAG GTCTTTGGAA

CATTCTTTTG AGAGAAACCT ATTTAGGTCC TTGGTCTGTT TTTCAATCAG GTTGTTTGAT TTTTGCTATT

GAGTTGTTGG AATTCCTTAT GTATTCAGAT ATTTGCCCCT TCTGCCATGT AGGTTTTGCA AATATTTTCT

CTCATTTTCT GGGTTATCTT TTCACTCGGT TGATTGTTTC CTTTGCTGTG CAGATGCTTT AGCGTTAAAT
```

-continued

```
GAAGCCACAC TTGTCTATTT TCCCTTTTAT TGCCTGTGCC TTTGGTGTCA TAGCCAAGAA ATCATTACCT
ACATCAATGT CAAAAGCTTT ATCCTTCTAT ACACTTCTAG TAGTTTATGG TTTCAGTTGT TACATTTAGG
TTTTCAATTC ATTCTGAGTT GATGTTCCTA CATGGTGTGA GATAAAGATT TAAATACATA CATATATAAA
ATCATGAGGT AGTGTACACT ATAAATATAC AATTGTTAAT TGTTACTCAA GTCTAAGTAG AGGTGGAAAT
AATAAACTTT CTTTTTTTTA CTTAAACCAC TCTGTGTCAC TGAGCTGATT TCACCTTTAG CCTGATAAAA
TCATTGTCCT CTCCACCCTG ATTCCTACAG GAGACTACTC ACCCCATAAC CTCAAAAACC TCTTCATGAG
GATGGTAAGT CACCTGAATC CTGAAGTGAA TTACTCGCTA TTCCATTGGA ACTCATATAG GACACCAGAA
TCTAGACCTC CAGAGAACAG CAGGACCCAT CTTCAGAAAA TAAGAAGCAT TTGTTCCCTG AGCCTGTTGA
ATCAAAGTGC AATTTCTATT CTTTTTGGAA TGTTAAAAAG TGAATCATAA TATTTAAGCA GGTGAACCCA
CGAGTAACAT AGCAGGGTCT TTCTTGTCAT TATTAGCTCC AACCTAGCAC AGACATTAAA GGTACAGATG
TATACTAGCA TGAAACTGGG AGAACAGGAG CATTCGAGCA ACCTTGAGAC CAATGGGCCT CTCTTATAAA
ATGCACACCT CCTCTCACTG AGATTGAGGA AGGTTTCTTG TCTCCGAGCC TTCTCCCAGT AGAGCTATAA
ATCCAGGCTG GCTCCTCCCT CCCCACACAG CTGCTCCTGC TCTCCCTCCT CCAGGTGACC CCAGCCATGA
GGACCCTCGC CATCCTTGCT GCCATTCTCC TGGTGGCCCT GCAGGCCCAG GCTGAGCCAC TCCAGGCAAG
AGCTGATGAG GTTGCTGCAG CCCCGGAGCA GATTGCAGCG GACATCCCAG AAGTGGTTGT TTCCCTTGCA
TGGGACGAAA GCTTGGCTCC AAAGCATCCA GGTGAGAGAG GCAGGCATGC AGAGCTGCTA AGTCTAGAGG
GAAGGACGGG AGAGAGGTTC CAGAGTTGGG TCTCAGCAGT CTATGTCACT GAGGTGGCTT CACTTAGAAT
CTCTGGGCAT TGATTTTCTC ATCTAGAAAT TGAACAGAGA GCCAAATAAA CCTGAGAAAC TTTATTTCTC
CAAAGACTTG ATTCCAAGAA ACATCTGTGA AATTCACTAA GTTTAAGATA TGAAGAGACA GACTAGTTAT
TTCTGGATCT AAACAAGTAG ACTTAGTTGT AAAGAGAACA TTTTACTCTA TCTACAGAAG AGCTTTTAAA
AACTGCAGCC AAGCCTGAGG GTAAGTTCAG GTGTGTGTGT GATGGGGCAG GAATGCAAAA ATGAGAGCAA
AGGAGAATGA GTCTCAAATT CTGTGTGACA AGCACTGCTC TGCGTGTTTA TTCCTATCGA CTGAGGTTGT
TCGTGCTACC GGCTGCAATG CAGCCAGCAT CACCTGTCAG CTAGCATGTG ACTTCCCCGA GATTCTTTTT
CTTACCCACT GCTAACTCCA TACTCAATTT CTCATGCTCT CCCTGTCCCA GGCTCAAGGA AAAACATGGA
CTGCTATTGC AGAATACCAG CGTGCATTGC AGGAGAACGT CGCTATGGAA CCTGCATCTA CCAGGGAAGA
CTCTGGGCAT TCTGCTGCTG AGCTTGCAGA AAAAGAAAAA TGAGCTCAAA ATTTGCTTTG AGAGCTACAG
GGAATTGCTA TTACTCCTGT ACCTTCTGCT CAATTTCCTT TCCTCATCTC AAATAAATGC CTTGTTACAA
GATTTCTGTG TTTCCACCTC TTTAATGTGT GATATGTGTC TGTGTCAAGA CACTTGGGAT ACACGTACCA
AAACGCAAAA TCAAATTTTT GAACAATATA-3' (FRAG. NO: _ ) (SEQ. ID NO: 3012)
```

Human Defensin 3 Nucleic Acid and Antisense Oligonucleotide Fragments

```
5'-CGCTGCBBTC TGCTCCGGGG CTGCBGCBBC CTCBTCBGCTC TTGCCTGGBTG GCTCBGCCTGG GCCTGCBGGG
CCBCCBGGBGB BTGGCBGCBBG GBTGGCGBGGG TCCTCBTGGC TGGGGTCBCCT GGBGGBGGGB GBGCBGGGGG
TCCTCBTGGC TGGGGTCCCT CTCTCCCGTC CT CCTACCTTGC TATAGAAGAC CTGGGACAGA GGACTGCTGT
CTGCCCTCTC TGGTCACCCT GCCTAGCTAG AGGATCTGTG ACCCCAGCCA TGAGGACCCT CGCCATCCTT
GCTGCCATTC TCCTGGTGGC CCTGCAGGCC CAGGCTGAGC CACTCCAGGC AAGAGCTGAT GAGGTTGCTG
CAGCCCCGGA GCAGATTGCA GCGGACATCC AGAAGTGGT TGTTTCCCTT GCATGGGACG AAAGCTTGGC
TCCAAAGCAT CCAGGCTCAA GGAAAAACAT GGACTGCTAT TGCAGAATAC CAGCGTGCAT TGCAGGAGAA
CGTCGCTATG GAACCTGCAT CTACCAGGGA AGACTCTGGG CATTCTGCTG CTGAGCTTGC AGAAAAAGAA
AAATGAGCTC AAAATTTGCT TTGAGAGCTA CAGGGAATTG CTATTACTCC TGTACCTTCT GCTCAATTTC CTTT-3'
```

-continued (FRAG. NO: 1804) (SEQ. ID NO: 3013)

5'-CCTACCTTGC TATAGAAGAC CTGGGACAGA GGACTGCTGT CTGCCCTCTC TGGTCACCCT GCCTAGCTAG
AGGATCTGTG ACCCCAGCCA TGAGGACCCT CGCCATCCTT GCTGCCATTC TCCTGGTGGC CCTGCAGGCC
CAGGCTGAGC CACTCCAGGC AAGAGCTGAT GAGGTTGCTG CAGCCCCGGA GCAGATTGCA GCGGACATCC
CAGAAGTGGT TGTTTCCCTT GCATGGGACG AAAGCTTGGC TCCAAAGCAT CCAGGCTCAA GGAAAAACAT
GGACTGCTAT TGCAGAATAC CAGCGTGCAT TGCAGGAGAA CGTCGCTATG GAACCTGCAT CTACCAGGGA
AGACTCTGGG CATTCTGCTG CTGAGCTTGC AGAAAAAGAA AAATGAGCTC AAAATTTGCT TTGAGAGCTA
CAGGGAATTG CTATTACTCC TGTACCTTCT GCTCAATTTC CTTT-3' (FRAG. NO: _ ) (SEQ. ID NO: 2478)
5'-GAATTCCCTG TAAGCCCTGT TACAGGGGCT GCACCCCAGA TACAACCTGA CCTGTGTCCA AGGCGGGCAA
CTCAACCCTT AGATATTGAA TGGGTCCCAT GGCACCAATG CTTAAACACC AGCAGCCCTC ACAACCACAG
ATCGTGTTTT AAGGATGAGG AGGTAGTTCT CTGGATGCAC AGGCTTCAAT CCAAATGGGC TCATGACGCC
GCAGCACACA CCCAGTCTGC AGCCTGAAGA GTTGGAGCAT TGCATTCACA GAAAGCATCC AGACATGATC
ATGGGCTCAG GGATACACCT GTTCTCCGAT GTGTACCAGT GAAGGATGGA AACTCCTATG CCTCCCAGAA
AGCACCACTC AAGCTTTTGC TGAATGCTTC TCTGAAGGCC CACAAGGCTG AGAGGCTGTG CAACACCAGC
AGTAAAGTGA ATGCCCAGAC TCCCACCTCC TTTCTTGGGT GGCCATCTGG AAAGGCCACT CCCACCCTGA
TGGCTAATGC CTCAGACCAG TTCTTGGCCC AGATGATCCT AGACAATTGT TTAAGCTTAA ACTGTTCATT
GGCCAAGCAA ACAGGTGATA GTACCTCTGG GAACCACAT GCCGCGTGTA CATCCAGATC TCAGGAGAAC
CCAAAAATGT CTGTTCCACA TAGCAACAGA AGCCCAGGTA GCACTCAGTC TCACCTGGGT GTTCTCCAAC
ATCCCAGCTC AGCCAAATGG CTTTCATTAG TTTTTATGGT TAGACCCCAG GTCCTCGGGA CACTGCTTTA
GAAACACATT CCAAATCCTC CTCTGTGTGC AGGTGGCATT CCTATCCCAA TCTCTTTGCA GGGCGTATAC
TGTGATACGC AGCCAGGCTG TCCCAGAGGC CTTAAATATT CCCTTGGTGC AGGTAGTTCA GCTTAGCCAC
AGCCAATGCA TCACAGGGTC AACTGTGTTA GGAGCCATTG AGAATCCATA GTTGGTTGCT GCCTGGGCCT
GGCCAGGGCT GACCAAGGTA GATGAGAGGT TCCTCTGTGG AGTTCTACTT TAACCTCACC TTCCCACCAA
ATTTCTCAAC TGTCCTTGCC ACCACAATTA TTTAATGGAC CCAACAGAAA GTAACCCCGG AAATTAGGAC
ACCTCATCCC AAAAGACCTT TAAATAGGGG AAGTCCACTT GTGCACGGCT GCTCCTTGCT ATAGAAGACC
TGGGACAGAG GACTGCTGTC TGCCCTCTCT GGTCACCCTG CCTAGCTAGA GGATCTGTAA GTACTACAAA
ACTTAAACTT TACACTGAGT TTTCATCATT GAAGCTATGC CTCCAATCTG ACCTCTGACT GTGGGGCCGC
CCCAGAGGGA CCCAGCGGGT GAATCCCTGC TAGGAACGTC TGTCCGGACC TCTGGTGACT GCTGGGGACG
ATGGCTTCCA GCTAACTTAA TAGAGAAACT CAAGCAGTTT CCTTCTAAAT ACACATGTCA CATGTCCTGG
TTGACATGTC CAGTAAGAAG ACTATCACAG GTCTTTGGAA CATTCTTTTG AGAGAAACCT ATTTAGGTCC
TTGGTCTGTT TTTCAATCAG GTTGTTTGAT TTTTGCTATT GAGTTGTTGG AATTCCTTAT GTATTCAGAT
ATTTGCCCCT TCTGCCATGT AGGTTTTGCA AATATTTTCT CTCATTTTCT GGGTTATCTT TTCACTCGGT
TGATTGTTTC CTTTGCTGTG CAGATGCTTT AGCGTTAAAT GAAGCCACAC TTGTCTATTT TCCCTTTTAT
TGCCTGTGCC TTTGGTGTCA TAGCCAAGAA ATCATTACCT ACATCAATGT CAAAAGCTTT ATCCTTCTAT
ACACTTCTAG TAGTTTATGG TTTCAGTTGT TACATTTAGG TTTTCAATTC ATTCTGAGTT GATGTTCCTA
CATGGTGTGA GATAAAGATT TAAATACATA CATATATAAA ATCATGAGGT AGTGTACACT ATAAATATAC
AATTGTTAAT TGTTACTCAA GTCTAAGTAG AGGTGGAAAT AATAAACTTT CTTTTTTTA CTTAAACCAC
TCTGTGTCAC TGAGCTGATT TCACCTTTAG CCTGATAAAA TCATTGTCCT CTCCACCCTG ATTCCTACAG
GAGACTACTC ACCCCATAAC CTCAAAAACC TCTTCATGAG GATGGTAAGT CACCTGAATC CTGAAGTGAA
TTACTCGCTA TTCCATTGGA ACTCATATAG GACACCAGAA TCTAGACCTC CAGAGAACAG CAGGACCCAT

CTTCAGAAAA TAAGAAGCAT TTGTTCCCTG AGCCTGTTGA ATCAAAGTGC AATTTCTATT CTTTTTGGAA

TGTTAAAAAG TGAATCATAA TATTTAAGCA GGTGAACCCA CGAGTAACAT AGCAGGGTCT TTCTTGTCAT

TATTAGCTCC AACCTAGCAC AGACATTAAA GGTACAGATG TATACTAGCA TGAAACTGGG AGAACAGGAG

CATTCGAGCA ACCTTGAGAC CAATGGGCCT CTCTTATAAA ATGCACACCT CCTCTCACTG AGATTGAGGA

AGGTTTCTTG TCTCCGAGCC TTCTCCCAGT AGAGCTATAA ATCCAGGCTG GCTCCTCCCT CCCCACACAG

CTGCTCCTGC TCTCCCTCCT CCAGGTGACC CCAGCCATGA GGACCCTCGC ATCCTTGCT GCCATTCTCC

TGGTGGCCCT GCAGGCCCAG GCTGAGCCAC TCCAGGCAAG AGCTGATGAG GTTGCTGCAG CCCCGGAGCA

GATTGCAGCG GACATCCCAG AAGTGGTTGT TTCCCTTGCA TGGGACGAAA GCTTGGCTCC AAAGCATCCA

GGTGAGAGAG GCAGGCATGC AGAGCTGCTA AGTCTAGAGG GAAGGACGGG AGAGAGGTTC CAGAGTTGGG

TCTCAGCAGT CTATGTCACT GAGGTGGCTT CACTTAGAAT CTCTGGGCAT TGATTTCTC ATCTAGAAAT

TGAACAGAGA GCCAAATAAA CCTGAGAAAC TTTATTTCTC CAAAGACTTG ATTCCAAGAA ACATCTGTGA

AATTCACTAA GTTTAAGATA TGAAGAGACA GACTAGTTAT TTCTGGATCT AAACAAGTAG ACTTAGTTGT

AAAGAGAACA TTTTACTCTA TCTACAGAAG AGCTTTTAAA AACTGCAGCC AAGCCTGAGG GTAAGTTCAG

GTGTGTGTGT GATGGGCAG GAATGCAAAA ATGAGAGCAA AGGAGAATGA GTCTCAAATT CTGTGTGACA

AGCACTGCTC TGCGTGTTTA TTCCTATCGA CTGAGGTTGT TCGTGCTACC GGCTGCAATG CAGCCAGCAT

CACCTGTCAG CTAGCATGTG ACTTCCCCGA GATTCTTTTT CTTACCCACT GCTAACTCCA TACTCAATTT

CTCATGCTCT CCCTGTCCCA GGCTCAAGGA AAAACATGGA CTGCTATTGC AGAATACCAG CGTGCATTGC

AGGAGAACGT CGCTATGGAA CCTGCATCTA CCAGGGAAGA CTCTGGGCAT TCTGCTGCTG AGCTTGCAGA

AAAAGAAAAA TGAGCTCAAA ATTTGCTTTG AGAGCTACAG GGAATTGCTA TTACTCCTGT ACCTTCTGCT

CAATTTCCTT TCCTCATCTC AAATAAATGC CTTGTTACAA GATTTCTGTG TTTCCACCTC TTTAATGTGT

GATATGTGTC TGTGTCAAGA CACTTGGGAT ACACGTACCA AAACGCAAAA TCAAATTTTT GAACAATATA-3'

(FRAG. NO: _ ) (SEQ. ID NO: 2477)

5'-GGCBGCBBGG-3' (FRAG. NO: 1805) (SEQ. ID NO: 1818)

5'-GG CTG GGG-3' (FRAG. NO: 1806) (SEQ. ID NO: 1819)

5'-GGGGTCBCC-3' (FRAG. NO: 1807) (SEQ. ID NO: 1820)

5'-GGG TCC TCB TGG CTG GGG TC-3' (FRAG. NO: 1216) (SEQ. ID NO: 1225)

5'-CCT CTC TCC CGT CCT-3' (FRAG. NO: 1217) (SEQ. ID NO: 1226)

5'-CGCTGCBBTC TGCTCCGGGG CTGCBGCBBC CTCBTCBGCT TTGCCTGGBGTG GCTCBGCCTGG GCCTGCBGGG

CCBCCBGGBGB BTGGCBGCBBG GBTGGCGBGGG TCCTCBTGGC TGGGGTCBCCT GGBGGBGGGB GBGCBGG-3'

(FRAG. NO: 1808) (SEQ. ID NO: 1821)

Human Macrophage Inflammatory Protein-1-alpha/RANTES

Receptor Nucleic Acid and Antisense Oligonucleotide Fragments

5'-GTCTTTGTTT CTGGGCTCGT GCCCCBTCCC GGCTTCTCTC TGGTTCCGTC CTCTGTGGTG TTTGGCCCTG

CTTCCTTTG CCTGTTGAGG GGGCAGCAGT TGGGCCCCAA AGGCCCTCTC GTTCACCTTC TGGCACGGAGTT

GCATCCCCATA GTCAAACTCT GTGGTCGTGT CATAGTCCTC TGTGGTGTTT GGAGTTTCCA TCCCGGCTTC

TCTCTGGTTC CAAGGGAGB GGGGGCBGCB GTTGGGCCCC BBBGGCCCTC TCGTTCBCCT TCTGGCBCGG

BGTTGCBTCC CCBTBGTCBB BCTCTGTGGT CGTGTCBTBG TCCTCTGTGG TGTTTGGBGT TTCCBTCCCG

GCTTCTCTCT GGTTCCBBGG GB-3' (FRAG. NO: 1809) (SEQ. ID NO: 1822)

5'-GGGCC CC-3' (FRAG. NO: 1810) (SEQ. ID NO: 1823)

-continued

5'-GGGGGCBGC-3' (FRAG. NO: 1811) (SEQ. ID NO: 1824)

5'-CCCGGCTTC-3' (FRAG. NO: 1812) (SEQ. ID NO: 1825)

5'-GTC TTT GTT TCT GGG CTC GTG CC-3' (FRAG. NO: 1218) (SEQ. ID NO: 1227)

5'-CCB TCC CGG CTT CTC TCT GGT TCC-3' (FRAG. NO: 1219) (SEQ. ID NO: 1228)

5'-GTC CTCTGT GGT GTT TGG-3' (FRAG. NO: 1220) (SEQ. ID NO: 1229)

5'-CCC TGC TTC CTT TTG CCT GTT-3' (FRAG. NO: 1221) (SEQ. ID NO: 1230)

5'-GAGGGGGCAG CAGTTGGGCC CCAAAGGCCC TCTCGTTCAC CTTCTGGCAC GGAGTTGCAT CCCCATAGTC AAACTCTGTG GTCGT-3' (FRAG. NO: 1222) (SEQ. ID NO: 1231)

5'-GTCATAGTCCTCTGTGGTGTTTGGAGTTTCCATCCCGGCTTCTCTCTGGTTCCAAGGGA-3' (FRAG. NO: 1223) (SEQ. ID NO: 1232)

5'-GBGGGGCBG CBGTTGGGCC CCBBBGGCCC TCTCGTTCBC CTTCTGGCBC GGBGTTGCBT CCCCBTBGTC BBBCTCTGTG GTCGTG-3' (FRAG. NO: 1224) (SEQ. ID NO: 1233)

5'-TCBTBGTCCTCTGTGGTGTTTGGBGTTTCCBTCCCGGCTTCTCTCTGGTTCCBBGGGB-3' (FRAG. NO: 1225) (SEQ. ID NO: 1234)

RANTES Antisense Oligonucleotide Fragments

5'-GGGCBCGGGG CBGTGGGCGG GCBBTGTBGG CBBBGCBGCB GGGTGTGGTG TCCGBGGBBT BTGGGGBGGC BGBTGCBGGB GCGCBGBGGG CBGTBGCBBT GBGGBTGBCB GCGBGGCGTG CCGCGGBGBC CTTCBTGGTB CCTGTGGBGB GGCTGTCGGB GGGGGTGTGG TGTCCGCTTG GCGGTTCTTT CGGGTGTTTC TTCTCTGGGT TGGCCTGCTG CTCGTCGTGGT CGCTCCGCTC CCGGGTTCGT CTCGCTCTGT CGCCCCTTCC TTCCTTGTCG TGTTCCTCCC TTCCTTGCCT CT-3' (FRAG. NO: 1813) (SEQ. ID NO: 1826)

5'-GGGTTGGC-3' (FRAG. NO: 1814) (SEQ. ID NO: 1827)

5'-CGGGG CBG-3' (FRAG. NO: 1815) (SEQ. ID NO: 1828)

5'-CCCGGGTTCG-3' (FRAG. NO: 1816) (SEQ. ID NO: 1829)

5'-GGGTGTGGTG-3' (FRAG. NO: 1817) (SEQ. ID NO: 1830)

5'-GGGCBCGGGG CBGTGGGCGG GCBBTGTBGG CBBBGCBGCB GGGTGTGGTG TCCGBGGBBT BTGGGGBGGC BGBTGCBGGB GCGC-3' (FRAG. NO: 1226) (SEQ. ID NO: 1235)

5'-BGBGGGCBGTB GCBBTGBGGB TGBCBGCGBG GCGTGCCGCG GBGBCCTTCB TGGTBCCTGT GGBGBGGCTG TCGGBGG-3' (FRAG. NO: 1227) (SEQ. ID NO: 1236)

5'-GGGTGTGGTGTCCGCTTGGCGGTTCTTTCGGGTGTTTCTTCTCTGGGTTGGCCTGCTGCTCGTCGTGGTC-3' (FRAG. NO: 1228) (SEQ. ID NO: 1237)

5'-GCTCCGCTCCCGGGTTCGTCTCGCTCTGTCGCCCCTTCCTTCCTTGTCGTGTTCCTCCCTTCCTTGCCTCT-3' (FRAG. NO: 1229) (SEQ. ID NO: 1238)

5'-GGGTGTGGTGTCCG-3' (FRAG. NO: 1230) (SEQ. ID NO: 1239)

5'-CTTGGCGGTTCTTTCGGGTG-3' (FRAG. NO: 1231) (SEQ. ID NO: 1240)

5'-TTTCTTCTCTGGGTTGGC-3' (FRAG. NO: 1232) (SEQ. ID NO: 1241)

5'-CTGCTGCTCGTCGTGGTC-3' (FRAG. NO: 1233) (SEQ. ID NO: 1242)

5'-GCTCCGCTCCCGGGTTC-3' (FRAG. NO: 1234) (SEQ. ID NO: 1243)

5'-GTCTCGCTCTGTCGCCC-3' (FRAG. NO: 1235) (SEQ. ID NO: 1244)

5'-CTTCCTTCCTTGTC-3' (FRAG. NO: 1236) (SEQ. ID NO: 1245)

5'-GTGTTCCTCCCTTCCTTGCCTCT-3' (FRAG. NO: 1237) (SEQ. ID NO: 1246)

-continued

5'-GGGCBCGGGG CBGTGGGCGG GCBBTGTBGG CBBBGCBGCB GGGTGTGGTG TCCGBGGBBT BTGGGGBGGC
BGBTGCBGGB GCGCBGBGGG CBGTBGCBBT GBGGBTGBCB GCGBGGCGTG CCGCGGBGBC CTTCBTGGTB
CCTGTGGBGB GGCTGTCGGB GG-3' (FRAG. NO: 1818) (SEQ. ID NO: 1831)

Human Muscarinic Acetylcholine Receptor HM1* Nucleic Acid and Antisense Oligonucleotide Fragments 5'-GCTGCCCGGC GGGGTGTGCG CTTGGCGCTC CCGTGCTCGG TTCTCTGTCT CCCGGTCCCC CTTGCCTGGC
GTCTCGGGCC TTCGTCCTCT TCCTCTTCTT CCTTCCGCTC CGTGGGGGCT GCTTGGTGGG GGCCTGTGCCT
CGGGGTCCCG GGGCTTCTGG CCCTTGCCGT TCATGGTGGC TAGGTGGGGC GTTCBTGGTG GCTBGGTGGG GC-
3' (FRAG. NO: 1819) (SEQ. ID NO: 1832)

5'-GGTGGGGC-3' (FRAG. NO: 1820) (SEQ. ID NO: 1833)

5'-GCCCGGCGGGG-3' (FRAG. NO: 1821) (SEQ. ID NO: 1834)

5'-CGG GGC TTC TGG CCC-3' (FRAG. NO: 1822) (SEQ. ID NO: 1835)

5'-GTT CBT GGT GGC TBG GTG GGG C-3' (FRAG. NO: 1238) (SEQ. ID NO: 1247)

5'-GCT GCC CGG CGG GGT GTG CGC TTG GC-3' (FRAG. NO: 1239) (SEQ. ID NO: 1248)

5'-GCT CCC GTG CTC GGT TCT CTG TCT CCC GGT-3' (FRAG NO: 1240) (SEQ. ID NO: 1249)

5'-CCC CCT TTG CCT GGC GTC TCG G-3' (FRAG. NO: 1241) (SEQ. ID NO: 1250)

5'-GCC TTC GTC CTC TTC CTC TTC TTC CTT CC-3' (FRAG. NO: 1242) (SEQ. ID NO: 1251)

5'-GCT CCG TGG GGG CTG CTT GGT GGG GGC CTG TGC CTC GGG GTC C-3' (FRAG. NO: 1243) (SEQ. ID NO: 1252)

5'-CGG GGC TTC TGG CCC TTG CC-3' (FRAG. NO: 1244) (SEQ. ID NO: 1253)

5'-GTT CAT GGT GGC TAG GTG GGG C-3' (FRAG. NO: 1245) (SEQ. ID NO: 1254)

Human Muscarinic Acetylcholine Receptor HM3* Nucleic Acid and Antisense Oligonucleotide Fragments 5'-GGG GTG GGT BGG CCG TGT CTG GGGGTT GGC CBT GTT GGT TGC CTCT TGG TGG TGC GCC GGG CGCG TCT
TGG CTT TCT TCT CCT TCG GGC CCT CGG GCC GGT GCT TGT GGGCT CCT CCC GGG CGG CCT CCC CGG GCG
GGG GCT TCT TGGCG CTG GCG GGG GGG CCT CCTGCT CTG TGG CTG GGC GTT CCT TGG TGT TCT GGG
TGGTGG CGG GCG TGG TGG CCT CTG TGGGGG CCC GCG GCT GCB GGG GTTG CCT GTC TGC TTC GTCCTT TGC
GCT CCC GGG CCG CCGGG GTG GGT AGG CCG TGT CTG GGGGTT GGC CAT GTT GGT TGC CGGG CCC GCG GCT
GCA GGG G-3' (FRAG. NO: 1823) (SEQ. ID NO: 1836)

5'-CCC GGG CGG-3' (FRAG. NO: 1824) (SEQ. ID NO: 1837)

5'-G GCG GGG GGG CC-3' (FRAG. NO: 1825) (SEQ. ID NO: 1838)

5'-CCC GGG CCG CC-3' (FRAG. NO: 1826) (SEQ. ID NO: 1839)

5'-GG CCG TGT-3' (FRAG. NO: 1827) (SEQ. ID NO: 1840)

5'-GGG GTG GGT BGG CCG TGT CTG GGG-3' (FRAG. NO: 1246) (SEQ. ID NO: 1255)

5'-GTT GGC CBT GTT GGT TGC C-3' (FRAG. NO: 1247) (SEQ. ID NO: 1256)

5'-TCT TGG TGG TGC GCC GGG C-3' (FRAG. NO: 1248) (SEQ. ID NO: 1257)

5'-GCG TCT TGG CTT TCT TCT CCT TCG GGC CCT CGG GCC GGT GCT TGT GG-3' (FRAG. NO: 1249) (SEQ. ID NO: 1258)

5'-GCT CCT CCC GGG CGG CCT CCC CGG GCG GGG GCT TCT TG-3' (FRAG. NO: 1250) (SEQ. ID NO: 1259)

5'-GCG CTG GCG GGG GGG CCT CCT CC-3' (FRAG. NO: 1251) (SEQ. ID NO: 1260)

5'-GCT CTG TGG CTG GGC GTT CCT TGG TGT TCT GGG TGG C-3' (FRAG. NO: 1252) (SEQ. ID NO: 1261)

-continued

5'-TGG CGG GCG TGG TGG CCT CTG TGG TGG-3' (FRAG. NO: 1253) (SEQ. ID NO: 1262)

5'-GGG CCC GCG GCT GCB GGG G-3' (FRAG. NO: 1254) (SEQ. ID NO: 1263)

5'-TTG CCT GTC TGC TTC GTC-3' (FRAG. NO: 1255) (SEQ. ID NO: 1264)

5'-CTT TGC GCT CCC GGG CCG CC-3' (FRAG. NO: 1256) (SEQ. ID NO: 1265)

5'-GGG GTG GGT AGC CCG TGT CTG GGG-3' (FRAG. NO: 1257) (SEQ. ID NO: 1266)

5'-GTT GGC CAT GTT GGT TGC C-3' (FRAG. NO: 1258) (SEQ. ID NO: 1267)

5'-GGG CCC GCG GCT GCA GGG G-3' (FRAG. NO: 1259) (SEQ. ID NO: 1268)

Human Fibronectin* Antisense Oligonucleotide Fragments

5'-CGG TTT CCT TTG CGG TC TTG GCC CGG GCT CCG GGT G CCC GCC CGC CCG CCG GCC GCC GC CCC GCC GGG CTG TCC CCG CCC CGC CCC GGC CCG GGG CGC GGG GG CGG CCC TCC CGC CCC TCT GG GCC GGC GCG GGC GTC GG CCG CTC GCG CCT GGG GTT CCC TCT CCT CCC CCT GTG C GCC TGC CTC TTG CTC TTCTGC GTC CGC TGC CTT CTC CC CTC TCC TCG GCC GTT GCC TGT GC TGT CCG TCC TGT CGC CCT TCC GTG GTG C TGT TGT CTC TTC TGC CCT C GGT GTG CTG GTG CTG GTG GTG GTG CCT CTG CCC GTG CTC GCCCTG CCT GGG CTG GCC TCT TCG GGT GTG GCT TTG GGG CTC TCT TGG TTG CCC TTT CTT CTC GTG GTG CCT CTC CTC CCT GGC TTG GTC GT TGT CTG GGG TGG TGC TCC TCT CCC TTT CCC TGC TGG CCG TTT GT CCT GTT TTC TGT CTT CCT CT TTC CTC CTG TTT CTC CGT TTG GCT TGC TGC TTG CGG GGC TGT CTC C CTT GCC CCT GTG GGC TTT CCC TGG TCC GGT C TT CTC CTT GGG GGT C GCC CTT CTT GGT GGG CTGGCT CGT CTG TCT TTT TCC TTC C TGG GGG TGG CCG TTG TGG GCG GTG TGG TCC GCC T TGC CTC TGC TGG TCT TTC-3' (FRAG. NO: 1828) (SEQ. ID NO: 1841)

5'-GGCCCGGGC-3' (FRAG. NO: 1829) (SEQ. ID NO: 1842)

5'-GCCGGCGCGGGCG-3' (FRAG. NO: 1830) (SEQ. ID NO: 1843)

5'-GCCTGGGCTGGCC-3' (FRAG. NO: 1831) (SEQ. ID NO: 1844)

5'-GGGGG TGGCCG-3' (FRAG. NO: 1832) (SEQ. ID NO: 1845)

5'-GG GGG TGG CCG CTG TGG GCG G-3' (FRAG. NO: 1833) (SEQ. ID NO: 1846)

5'-CGG TTT CCT TTG CGG TC-3' (FRAG. NO: 1260) (SEQ. ID NO: 1269)

5'-TTG GCC CGG GCT CCG GGT G-3' (FRAG. NO: 1261) (SEQ. ID NO: 1270)

5'-CCC GCC CGC CCG CCG GCC GCC GC-3' (FRAG. NO: 1262) (SEQ. ID NO: 1271)

5'-CCC GCC GGG CTG TCC CCG CCC CGC CCC-3' (FRAG. NO: 1263) (SEQ. ID NO: 1272)

5'-GGC CCG GGG CGC GGG GG-3' (FRAG. NO: 1264) (SEQ. ID NO: 1273)

5'-CGG CCC TCC CGC CCC TCT GG-3' (FRAG. NO: 1265) (SEQ. ID NO: 1274)

5'-GCC GGC GCG GGC GTC GG-3' (FRAG. NO: 1266) (SEQ. ID NO: 1275)

5'-CCG CTC GCG CCT GGG GTT CCC TCT CCT CCC CCT GTG C-3' (FRAG. NO: 1267) (SEQ. ID NO: 1276)

5'-GCC TGC CTC TTG CTC TTC-3' (FRAG. NO: 1268) (SEQ. ID NO: 1277)

5'-TGC GTC CGC TGC CTT CTC CC-3' (FRAG. NO: 1269) (SEQ. ID NO: 1278)

5'-CTC TCC TCG GCC GTT GCC TGT GC-3' (FRAG. NO: 1270) (SEQ. ID NO: 1279)

5'-TGT CCG TCC TGT CGC CCT TCC GTG GTG C-3' (FRAG. NO: 1271) (SEQ. ID NO: 1280)

5'-TGT TGT CTC TTC TGC CCT C-3' (FRAG. NO: 1272) (SEQ. ID NO: 1281)

5'-GGT GTG CTG GTG CTG GTG GTG GTG-3' (FRAG. NO: 1273) (SEQ. ID NO: 1282)

5'-CCT CTG CCC GTG CTC GCC-3' (FRAG. NO: 1274) (SEQ. ID NO: 1283)

-continued

5'-CTG CCT GGG CTG GCC TCT TCG GGT-3' (FRAG. NO: 1275) (SEQ. ID NO: 1284)

5'-GTG GCT TTG GGG CTC TCT TGG TTG CCC TTT-3' (FRAG. NO: 1276) (SEQ. ID NO: 1285)

5'-CTT CTC GTG GTG CCT CTC CTC CCT GGC TTG GTC GT-3' (FRAG. NO: 1277) (SEQ. ID NO: 1286)

5'-TGT CTG GGG TGG TGC TCC TCT CCC-3' (FRAG. NO: 1278) (SEQ. ID NO: 1287)

5'-TTT CCC TGC TGG CCG TTT GT-3' (FRAG. NO: 1279) (SEQ. ID NO: 1288)

5'-CCT GTT TTC TGT CTT CCT CT-3' (FRAG. NO: 1280) (SEQ. ID NO: 1289)

5'-TTC CTC CTG TTT CTC CGT-3' (FRAG. NO: 1281) (SEQ. ID NO: 1290)

5'-TTG CT TGC TGC TTG CGG GGC TGT CTC C-3' (FRAG. NO: 1282) (SEQ. ID NO: 1291)

5'-CTT GCC CCT GTG GGC TTT CCC-3' (FRAG. NO: 1283) (SEQ. ID NO: 1292)

5'-TGG TCC GGT CTT CTC CTT GGG GGT C-3' (FRAG. NO: 1284) (SEQ. ID NO: 1293)

5'-GCC CTT CTT GGT GGG CTG-3' (FRAG. NO: 1285) (SEQ. ID NO: 1294)

5'-GCT CGT CTG TCT TTT TCC TTC C-3' (FRAG. NO: 1286) (SEQ. ID NO: 1295)

5'-TGG GGG TGG CCG TTG TGG GCG GTG TGG TCC GCC T-3' (FRAG. NO: 1287) (SEQ. ID NO: 1296)

5'-TGC CTC TGC TGG TCT TTC-3' (FRAG. NO: 1288) (SEQ. ID NO: 1297)

Human Interleukin-1 (IL-1) Nucleic Acid and antisense Oligocnucleotide Fragments

5'-AAGCTTCTAC CCGAGTCTGG TGCTACACTT ACATTGCTTA CATCCAAGTG TGGTTATTTC TGTGGCTCCT

GTTATAACTA TTATAGCACC AGGTCTATGA CCAGGAGAAT TAGACTGGCA TTAAATCAGA ATAAGAGATT

TTGCACCTGC AATAGACCTT ATGACACCTA ACCAACCCCA TTATTTACAA TTAAACAGGA ACAGAGGGAA

TACTTTATCC AACTCACACA AGCTGTTTTC CTCCCAGATC CATGCTTTTT TGCGTTTATT ATTTTTTAGA

GATGGGGGCT TCACTATGTT GCCCACACTG GACTAAAACT CTGGGCCTCA AGTGATTGTC CTGCCTCAGC

CTCCTGAATA GCTGGGACTA CAGGGGCATG CCATCACACC TAGTTCATTT CCTCTATTTA AAATATACAT

GGCTTAAACT CCAACTGGGA ACCCAAAACA TTCATTTGCT AAGAGTCTGG TGTTCTACCA CCTGAACTAG

GCTGGCCACA GGAATTATAA AAGCTGAGAA ATTCTTTAAT AATAGTAACC AGGCAACATC ATTGAAGGCT

CATATGTAAA AATCCATGCC TTCCTTTCTC CCAATCTCCA TTCCCAAACT TAGCCACTGG TTCTGGCTGA

GGCCTTACGC ATACCTCCCG GGGCTTGCAC ACACCTTCTT CTACAGAAGA CACACCTTGG GCATATCCTA

CAGAAGACCA GGCTTCTCTC TGGTCCTTGG TAGAGGGCTA CTTTACTGTA ACAGGGCCAG GGTGGAGAGT

TCTCTCCTGA AGCTCCATCC CCTCTATAGG AAATGTGTTG ACAATATTCA GAAGAGTAAG AGGATCAAGA

CTTCTTTGTG CTCAAATACC ACTGTTCTCT TCTCTACCCT GCCCTAACCA GGAGCTTGTC ACCCCAAACT

CTGAGGTGAT TTATGCCTTA ATCAAGCAAA CTTCCCTCTT CAGAAAAGAT GGCTCATTTT CCCTCAAAAG

TTGCCAGGAG CTGCCAAGTA TTCTGCCAAT TCACCCTGGA GCACAATCAA CAAATTCAGC CAGAACACAA

CTACAGCTAC TATTAGAACT ATTATTATTA ATAAATTCCT CTCCAAATCT AGCCCCTTGA CTTCGGATTT

CACGATTTCT CCCTTCCTCC TAGAAACTTG ATAAGTTTCC CGCGCTTCCC TTTTTCTAAG ACTACATGTT

TGTCATCTTA TAAAGCAAAG GGGTGAATAA ATGAACCAAA TCAATAACTT CTGGAATATC TGCAAACAAC

AATAATATCA GCTATGCCAT CTTTCACTAT TTTAGCCAGT ATCGAGTTGA ATGAACATAG AAAAATACAA

AACTGAATTC TTCCCTGTAA ATTCCCCGTT TTGACGACGC ACTTGTAGCC ACGTAGCCAC GCCTACTTAA

GACAATTACA AAAGGCGAAG AAGACTGACT CAGGCTTAAG CTGCCAGCCA GAGAGGGAGT CATTTCATTG

GCGTTTGAGT CAGCAAAGGT ATTGTCCTCA CATCTCTGGC TATTAAAGTA TTTTCTGTTG TTGTTTTTCT

CTTTGGCTGT TTTCTCTCAC ATTGCCTTCT CTAAAGCTAC AGTCTCTCCT TTCTTTTCTT GTCCCTCCCT

GGTTTGGTAT GTGACCTAGA ATTACAGTCA GATTTCAGAA AATGATTCTC TCATTTTGCT GATAAGGACT

GATTCGTTTT ACTGAGGGAC GGCAGAACTA GTTTCCTATG AGGGCATGGG TGAATACAAC TGAGGCTTCT

-continued

```
CATGGGAGGG AATCTCTACT ATCCAAAATT ATTAGGAGAA AATTGAAAAT TTCCAACTCT GTCTCTCTCT
TACCTCTGTG TAAGGCAAAT ACCTTATTCT TGTGGTGTTT TTGTAACCTC TTCAAACTTT CATTGATTGA
ATGCCTGTTC TGGCAATACA TTAGGTTGGG CACATAAGGA ATACCAACAT AAATAAAACA TTCTAAAAGA
AGTTTACGAT CTAATAAAGG AGACAGGTAC ATAGCAAACT AATTCAAAGG AGCTAGAAGA TGGAGAAAAT
GCTGAATGTG GACTAAGTCA TTCAACAAAG TTTTCAGGAA GCACAAAGAG GAGGGCTCC CCTCACAGAT
ATCTGGATTA GAGGCTGGCT GAGCTGATGG TGGCTGGTGT TCTCTGTTGC AGAAGTCAAG ATGGCCAAAG
TTCCAGACAT GTTTGAAGAC CTGAAGAACT GTTACAGGTA AGGAATAAGA TTTATCTCTT GTGATTTAAT
GAGGGTTTCA AGGCTCACCA GAATCCAGCT AGGCATAACA GTGGCCAGCA TGGGGGCAGG CCGGCAGAGG
TTGTAGAGAT GTGTACTAGT CCTGAAGTCA GAGCAGGTTC AGAGAAGACC CAGAAAAACT AAGCATTCAG
CATGTTAAAC TGAGATTACA TTGGCAGGGA GACCGCCATT TTAGAAAAAT TATTTTTGAG GTCTGCTGAG
CCCTACATGA ATATCAGCAT CAACTTAGAC ACAGCCTCTG TTGAGATCAC ATGCCCTGAT ATAAGAATGG
GTTTTACTGG TCCATTCTCA GGAAAACTTG ATCTCATTCA GGAACAGGAA ATGGCTCCAC AGCAAGCTGG
GCATGTGAAC TCACATATGC AGGCAAATCT CACTCAGATG TAGAAGAAAG GTAAATGAAC ACAAAGATAA
AATTACGGAA CATATTAAAC TAACATGATG TTTCCATTAT CTGTAGTAAA TACTAACACA AACTAGGCTG
TCAAAATTTT GCCTGGATAT TTTACTAAGT ATAAATTATG AAATCTGTTT TAGTGAATAC ATGAAAGTAA
TGTGTAACAT ATAATCTATT TGGTTAAAAT AAAAAGGAAG TGCTTCAAAA CCTTTCTTTT CTCTAAAGGA
GCTTAACATT CTTCCCTGAA CTTCAATTAA AGCTCTTCAA TTTGTTAGCC AAGTCCAATT TTTACAGATA
AAGCACAGGT AAAGCTCAAA GCCTGTCTTG ATGACTACTA ATTCCAGATT AGTAAGATAT GAATTACTCT
ACCTATGTGT ATGTAGAA GTCCTTAAAT TTCAAAGATG ACAGTAATGG CCATGTGTAT GTGTGTGACC
CACAACTATC ATGGTCATTA AAGTACATTG GCCAGAGACC ACATGAAATA ACAACAATTA CATTCTCATC
ATCTTATTTT GACAGTGAAA ATGAAGAAGA CAGTTCCTCC ATTGATCATC TGTCTCTGAA TCAGGTAAGC
AAATGACTGT AATTCTCATG GGACTGCTAT TCTTACACAG TGGTTTCTTC ATCCAAAGAG AACAGCAATG
ACTTGAATCT TAAATACTTT TGTTTTACCC TCACTAGAGA TCCAGAGACC TGTCTTTCAT TATAAGTGAG
ACCAGCTGCC TCTCTAAACT AATAGTTGAT GTGCATTGGC TTCTCCCAGA ACAGAGCAGA ACTATCCCAA
ATCCCTGAGA ACTGGAGTCT CCTGGGGCAG GCTTCATCAG GATGTTAGTT ATGCCATCCT GAGAAAGCCC
CGCAGGCCGC TTCACCAGGT GTCTGTCTCC TAACGTGATG TGTTGTGGTT GTCTTCTCTG ACACCAGCAT
CAGAGGTTAG AGAAAGTCTC CAAACATGAA GCTGAGAGAG AGGAAGCAAG CCAGCTGAAA GTGAGAAGTC
TACAGCCACT CATCAATCTG TGTTATTGTG TTTGGAGACC ACAAATAGAC ACTATAAGTA CTGCCTAGTA
TGTCTTCAGT ACTGGCTTTA AAAGCTGTCC CCAAAGGAGT ATTTCTAAAA TATTTTGAGC ATTGTTAAGC
AGATTTTTAA CCTCCTGAGA GGGAACTAAT TGGAAAGCTA CCACTCACTA CAATCATTGT TAACCTATTT
AGTTACAACA TCTCATTTTT GAGCATGCAA ATAAATGAAA AAGTCTTCCT AAAAAAATCA TCTTTTTATC
CTGGAAGGAG GAAGGAAGGT GAGACAAAAG GGAGAGAGGG AGGAAGCCT AATGAAACAC CAGTTACCTA
AGACCAGAAT GGAGATCCTC CTCACTACCT CTGTTGAATA CAGCACCTAC TGAAAGAACT TTCATTCCCT
GACCATGAAC AGCCTCTCAG CTTCTGTTTT CCTTCCTCAC AGAAATCCTT CTATCATGTA AGCTATGGCC
CACTCCATGA AGGCTGCATG GATCAATCTG TGTCTCTGAG TATCTCTGAA ACCTCTAAAA CATCCAAGCT
TACCTTCAAG GAGAGCATGG TGGTAGTAGC AACCAACGGG AAGGTTCTGA AGAAGAGACG GTTGAGTTTA
AGCCAATCCA TCACTGATGA TGACCTGGAG GCCATCGCCA ATGACTCAGA GGAAGGTAAG GGGTCAAGCA
CAATAATATC TTTCTTTTAC AGTTTTAAGC AAGTAGGGAC AGTAGAATTT AGGGGAAAAT TAAACGTGGA
GTCAGAATAA CAAGAAGACA ACCAAGCATT AGTCTGGTAA CTATACAGAG GAAAATTAAT TTTTATCCTT
```

-continued

```
CTCCAGGAGG GAGAAATGAG CAGTGGCCTG AATCGAGAAT ACTTGCTCAC AGCCATTATT TCTTAGCCAT
ATTGTAAAGG TCGTGTGACT TTTAGCCTTT CAGGAGAAAG CAGTAATAAG ACCACTTACG AGCTATGTTC
CTCTCATACT AACTATGCCT CCTTGGTCAT GTTACATAAT CTTTTCGTGA TTCAGTTTCC TCTACTGTAA
AATGGAGATA ATCAGAATCC CCCACTCATT GGATTGTTGT AAAGATTAAG AGTCTCAGGC TTTACAGACT
GAGCTAGCTG GGCCCTCCTG ACTGTTATAA AGATTAAATG AGTCAACATC CCTAACTTC TGGACTAGAA
TAATGTCTGG TACAAAGTAA GCACCCAATA AATGTTAGCT ATTACTATCA TTATTATTAT TATTTTATTT
TTTTTTTTTG AGATGGAGTC TGGCTCTGTC ACCCAGGCTG GAGTGCAGTG GCACAATCTC GGCTCACTGC
AAGCTCTGCC TCCTGGGTTC ATGCCATTCT CCTGCCTCAG CCTCCCGAGT AAGCTGGGAA TACAGGCACC
CGCCACTGTT CCCGGCTAAT TTTTTGTATT TTTAGTAGAG ACGGAGTTTC ACCGTGGTCT CCATCTCCTC
GTGATCCACC CACCTTGGCC TCCCAAAGTG CCGGGATTAC AGGCGTGAGC CACCGCGCCC GGCCTATTAT
TATTATTATT ACTACTACTA CTACCTATAT GAATACTACC AGCAATACTA ATTTATTAAT GACTGGATTA
TGTCTAAACC TCACAAGAAT CCTACCTTCT CATTTTACAT AAAAGGAAAC TAAGCTCATT GAGATAGGTA
AACTGCCCAA TGGCATACAT CTGTAAGTGG GAGAGCCTCA AATCTAATTC AGTTCTACCT GAGTAAAAAA
ATCATGGTTT CTCCTCCATC CCTTTACTGT ACAAGCCTCC ACATGAACTA TAAACCCAAT ATTCCTGTTT
TTAAGATAAT ACCTAAGCAA TAACGCATGT TCACCTAGAA GGTTTTAAAA TGTAACAAAA TATAAGAAAA
TAAAAATCAC TCATATCGTC AGTGAGAGTT TACTACTGCC AGCACTATGG TATGTTTCCT TAAAATCTTT
GCTATACACA TACCTACATG TGAACAAATA TGTCTAACAT CAAGACCACA CTATTTACAA CTTTATATCC
AGCTTTTCTT ACTTAGCAAT GTATTGAGGA CATTTTAGAG TGCCCGTTTT TCACCATTAT AAGCAATGCA
ACAATGAACA TCTGTATAAA TAAATATTCA TTTCTCTCAC CCTTTATTTC CTTAGAATAT ATTCCTAGAA
GTAGAATTTC CCAGAGCCAT GAGGATTTGT GACGCTATTG ATATGTGCCA CTTTGCACTC TCTGTGACAT
ATATAATTAT TTTTAATGCA TTCATTTTTT TCTCAGAGTG CATTCGTTTG AAAACATAGA CGGGAAATAC
TGGTAGTCTT CCTTGTCAGT TAGAAACACC CAAACAATGA AAAATGAAAA AGTTGCACAA ATAGTCTCTA
AAAACAATGA AACTATTGCC TGAGGAATTG AAGTTTAAAA AGAAGCACAT AAGCAACAAC AAGGATAATC
CTAGAAAACC AGTTCTGCTG ACTGGGTGAT TTCACTTCTC TTTGCTTCCT CATCTGGATT GGAATATTCC
TAATACCCCC TCCAGAACTA TTTTCCCTGT TTGTACTAGA CTGTGTATAT CATCTGTGTT TGTACATAGA
CATTAATCTG CACTTGTGAT CATGGTTTTA GAAATCATCA AGCCTAGGTC ATCACCTTTT AGCTTCCTGA
GCAATGTGAA ATACAACTTT ATGAGGATCA TCAAATACGA ATTCATCCTG AATGACGCCC TCAATCAAAG
TATAATTCGA GCCAATGATC AGTACCTCAC GGCTGCTGCA TTACATAATC TGGATGAAGC AGGTACATTA
AAATGGCACC AGACATTTCT GTCATCCTCC CCTCCTTTCA TTTACTTATT TATTTATTTC AATCTTTCTG
CTTGCAAAAA ACATACCTCT TCAGAGTTCT GGGTTGCACA ATTCTTCCAG AATAGCTTGA AGCACAGCAC
CCCCATAAAA ATCCCAAGCC AGGGCAGAAG GTTCAACTAA ATCTGGAAGT TCCACAAGAG AGAAGTTTCC
TATCTTTGAG AGTAAAGGGT TGTGCACAAA GCTAGCTGAT GTACTACCTC TTTGGTTCTT TCAGACATTC
TTACCCTCAA TTTTAAAACT GAGGAAACTG TCAGACATAT TAAATGATTT ACTCAGATTT ACCCAGAAGC
CAATGAAGAA CAATCACTCT CCTTTAAAAA GTCTGTTGAT CAAACTCACA AGTAACACCA AACCAGGAAG
ATCTTTATTA TCTCTGATAA CATATTTGTG AGGCAAAACC TCCAATAAGC TACAAATATG CTTAAAGGA
TGAAGTTTAG TGTCCAAAAA CTTTTATCAC ACACATCCAA TTTTCATGGC GGACATGTTT TAGTTTCAAC
AGTATACATA TTTTCAAAGG TCCAGAGAGG CAATTTTGCA ATAAACAAGC AAGACTTTTT CTGATTGGAT
GCACTTCAGC TAACATGCTT TCAACTCTAC ATTTACAAAT TATTTTGTGT CTATTTTTC TACTTAATAT
TATTTCTGCA ATTTTCCCAA TATTGACATC GTGTATGTAT TTGCCATTTT TAATATCACT AGACAATTCA
ATCAGGTTGC TACGTTGGTC CCTTGGGTTT ACTCTAAATA GCTTGATTGC AAATATCTTT GTATATATTA
```

```
TTGTTTTTTC TCCTATCTTG TAATTTCTTT GAGCACATCC CAAAGAGGAA TGCCTAGATC AATGGGCACA

AATAATTTGA CAGCTCTTAT TAAACATTAT TCTGTAAGTA AAAACTGAAC TACTTTTCAG TATCACTAGC

AACATATGAG TGTATCAGCT TCCTAAACCC CTCCATGTTA GGTCATTATG AACTTATGAT CTAACAAATT

ACAGGGTCTT ATCCCACTAA TGAAATTATA AGAGATTCAA CACTTATTCA GCCCCGAAGG ATTCATTCAA

CGTAGAAAAT TCTAAGAACA TTAACCAAGT ATTTACCTGC CTAGTGAGTG TGGAAGACAT TGTGAAGGAC

ACAAAGATGT ATAGAATTCC ATTCCTGACT TCCAGGTATT TACACCATAG GTGGGACCT AACTACACAC

ACACACACAC ACACACACAC ACACACACAC ACCATGCACA CACAATCTAC ATCAACACTT GATTTTATAC

AAATACAATG AATTTACTTT CTTTTTGGTT CTTCTCTTCA CCAGTGAAAT TTGACATGGG TGCTTATAAG

TCATCAAAGG ATGATGCTAA AATTACCGTG ATTCTAAGAA TCTCAAAAAC TCAATTGTAT GTGACTGCCC

AAGATGAAGA CCAACCAGTG CTGCTGAAGG TCAGTTGTCC TTTGTCTCCA ACTTACCTTC ATTTACATCT

CATATGTTTG TAAATAAGCC CAATAGGCAG ACACCTCTAA CAAGGTGACA CTGTCCTCTT TCCTTCCTAC

CACAGCCCCC ACCTACCCAC CCCACTCCCA TTGATTCCAG AGGCGTGCCT AGGCAGGATC TATGAGAAAA

TATAACAGAG AGTAAGAGGA AAATTACCTT CTTTCTTTTT CCTTTCCCTG CCTGACCTTA TTCACCTCCC

ATCCCAGAGC ATCCATTTAT TCCATTGATC TTTACTGACA TCTATTATCT GACCTACACA ATACTAGACA

TTAGGACAAT GTGGCCTGCC TCCAAGAAAC TCAAATAAGC CAACTGAGAT CAGAGAGGAT TAATCACCTG

CCAATGGGCA CAAAGCAACA AGCTGGGAGC CAAGTCCCAA AATGGGGCCT GCTGCTTCCA GTTCCCCTCT

CTCTGCATTG ATGTCAGCAT TATCCTTCGT CCCAGTCCTG TCTCCACTAC CACTTTCCCC CTCAAACACA

CACACACACA ACAGCCTTAG ATGTTTTCTC CACTGATAAG TAGGTGACTC AATTTGTAAG TATATAATCC

AAGACCTTCT ATTCCCAAGT AGAATTTATG TGCCTGCCTG TGCTTTTCTA CCTGGATCAA GTGATGTCTA

CAGAGTAGGG CAGTAGCTTC ATTCATGAAC TCATTCAACA AGCATTATTC ACTGAGAGCC TTGTATTTTT

CAGGCATAGT GCCAACAGCA GTGTGGACAG TGGTGCATCA AAGCCTCTAG TCTCATAGAA CTTAGTCTTC

TGGAGGATAT GGAAAACAGA CAACCCAAAC AACCAACAAA AGAGCAAGAT GCTGCAAAAA AAAAAAAAAT

GAATAGGGTG CTAAGATAGA GAAAAGTGGG AGAGTGCTAT TTAGACAAAG TGGTAAAAAC AAAGCCCCTT

GTGAGATGAG AGCTGCCGAC AGAGGGGGCG GGTCATGGTT GTGGGTTTTT GGGTAGGACA TTCAGAGGAG

GGGGCGGGTC GTGGTTGTGG GTTTTTGGGT AGGACATTCA GAGGAGGGGG CGGGTCGTGG TTGTGGGTTT

TTGGGTAGGA CATTCAGAGG AGGGGCGGG TCGTGGTTGT GGGTTTTTGG GTAGGACATT CAGAGGAGGG

GGCGGGTCGT GGTTGTGGGT TTTTGGGACA TTCAGAGGAG TCTGAATGCA CCCAGGCCTA CAACTTCAAG

ATGGTAAAGG ACAGCTCCAA GGATCAGAAG AAGCATTCTT GGAACTGGGG CATTTTGAGA AGGAGGAAAA

ATATGCAGAG ACTAGTGCTT GCAGAGCTTG CATTTGGATT TCATTTGAGG TACAATGAAA ACCCATTAAT

GGGTTTCACA CAGTGCAATG GCCTGACCTC ACTTATATTT CCTAAAATAG AAAACAGATC AGAAGGAAGG

CAATAGAGAA GCAGAAAGTC CAATGAGGAG GTTTCACAGC AGTCATGGGG GTGGGTAAG GAAAAGAAGT

GGAAAGAAAC AGACAGAATT GGGTTATATT TGGAGATAG AACCAACAGA AGGAAGAGGA GAAACAACAT

TTACTGAGAA GGGAAAAAGT AGGAGAGGAA TAGGTTTGGG AAATAAATCC TGCTGACATT GGAAACCCCA

AGGAAGCCTC AAAAGTATAT TTACTTGCTT TAGATTTAAA AGAATAGGAA AGAAGCATCT CAACTTGGAA

TTTGAAATCT ATTTTTCCAT AAAAGTATTG TTAAATTCTA CTCATACTCA CAAGAAAAGT ACATTCTAAA

GAGTATATTG AAAGAGTTTA CTGATATACT TAGGAATTTT GTGTGTATGT GTGTGTGTGT ATGTGTGTGT

GTGTGTTTAA CCTTCAATTG TTGACTTAAA TACTGAGATA AATGTCATCT AAATGCTAAA TTGATTTCCC

AAAGGTATGA TTTGTTCACT TGGAGATCAA AATGTTTAGG GGGCTAGAA TCACTGTAGT GCTCAGATTT

GATGCAAAAT GTCTTAGGCC TATGTTGAAG GCAGGACAGA AACAATGTTT CCCTCCTACC TGCCTGGATA
```

-continued

```
CAGTAAGATA CTAGTGTCAC TGACAATCTT CATAACTAAT TTAGATCTCT CTCCAATCAA CTAAGGAAAT
CAACTCTTAT TAATAGACTG GGCCACACAT CTACTAGGCA TGTAATAAAT GCTTGCTGAA TGAACAAATG
AATGAAGAGC CTATAGCATC ATGTTACAGC CATAGTCCTA AAGTGGTGTT TCTCATGAAG GCCAAATGCT
AAGGGATTGA GCTTCAGTCC TTTTTCTAAC ATCTTGTTCT CTAACAGAAT TCTCTTCTTT TCTTCATAGG
AGATGCCTGA GATACCCAAA ACCATCACAG GTAGTGAGAC CAACCTCCTC TTCTTCTGGG AAACTCACGG
CACTAAGAAC TATTTCACAT CAGTTGCCCA TCCAAACTTG TTTATTGCCA CAAAGCAAGA CTACTGGGTG
TGCTTGGCAG GGGGGCCACC CTCTATCACT GACTTTCAGA TACTGGAAAA CCAGGCGTAG GTCTGGAGTC
TCACTTGTCT CACTTGTGCA GTGTTGACAG TTCATATGTA CCATGTACAT GAAGAAGCTA AATCCTTTAC
TGTTAGTCAT TTGCTGAGCA TGTACTGAGC CTTGTAATTC TAAATGAATG TTTACACTCT TTGTAAGAGT
GGAACCAACA CTAACATATA ATGTTGTTAT TTAAAGAACA CCCTATATTT TGCATAGTAC CAATCATTTT
AATTATTATT CTTCATAACA ATTTTAGGAG GACCAGAGCT ACTGACTATG GCTACCAAAA AGACTCTACC
CATATTACAG ATGGGCAAAT TAAGGCATAA GAAAACTAAG AAATATGCAC AATAGCAGTT GAAACAAGAA
GCCACAGACC TAGGATTTCA TGATTTCATT TCAACTGTTT GCCTTCTGCT TTTAAGTTGC TGATGAACTC
TTAATCAAAT AGCATAAGTT TCTGGGACCT CAGTTTTATC ATTTTCAAAA TGGAGGGAAT AATACCTAAG
CCTTCCTGCC GCAACAGTTT TTTATGCTAA TCAGGGAGGT CATTTTGGTA AAATACTTCT CGAAGCCGAG
CCTCAAGATG AAGGCAAAGC ACGAAATGTT ATTTTTTAAT TATTATTTAT ATATGTATTT ATAAATATAT
TTAAGATAAT TATAATATAC TATATTTATG GGAACCCCTT CATCCTCTGA GTGTGACCAG GCATCCTCCA
CAATAGCAGA CAGTGTTTTC TGGGATAAGT AAGTTTGATT TCATTAATAC AGGGCATTTT GGTCCAAGTT
GTGCTTATCC CATAGCCAGG AAACTCTGCA TTCTAGTACT TGGGAGACCT GTAATCATAT AATAAATGTA
CATTAATTAC CTTGAGCCAG TAATTGGTCC GATCTTTGAC TCTTTTGCCA TTAAACTTAC CTGGGCATTC
TTGTTTCATT CAATTCCACC TGCAATCAAG TCCTACAAGC TAAAATTAGA TGAACTCAAC TTTGACAACC
ATGAGACCAC TGTTATCAAA ACTTTCTTTT CTGGAATGTA ATCAATGTTT CTTCTAGGTT CTAAAAATTG
TGATCAGACC ATAATGTTAC ATTATTATCA ACAATAGTGA TTGATAGAGT GTTATCAGTC ATAACTAAAT
AAAGCTTGCA ACAAAATTCT CTGACACATA GTTATTCATT GCCTTAATCA TTATTTTACT GCATGGTAAT
TAGGGACAAA TGGTAAATGT TTACATAAAT AATTGTATTT AGTGTTACTT TATAAAATCA AACCAAGATT
TTATATTTTT TTCTCCTCTT TGTTAGCTGC CAGTATGCAT AAATGGCATT AAGAATGATA ATATTTCCGG
GTTCACTTAA AGCTCATATT ACACATACAC AAAACATGTG TTCCCATCTT TATACAAACT CACACATACA
GAGCTACATT AAAAACAACT AATAGGCCAG GCACGGTGGC TCAGACCTGT AATCCCAGCA CTTTGGGAGG
ACCAACCTCT TCGAGGCACA AGGCACAACA GGTTGCTCTG GGATTCTCTT CAGCCAATCT TCATTGCTCA
AGTGTCTGAA GCAGCCATGG CAGAAGTACC TGAGCTCGCC AGTGAAATGA TGGCTTATTA CAGTGGCAAT
GAGGATGACT TGTTCTTTGA AGCTGATGGC CCTAAACAGA TGAAGTGCTC CTTCCAGGAC CTGGACCTCT
GCCCTCTGGA TGGCGGCATC CAGCTACGAA TCTCCGACCA CCACTACAGC AAGGGCTTCA GGCAGGCCGC
GTCAGTTGTT GTGGCCATGG ACAAGCTGAG GAAGATGCTG GTTCCCTGCC CACAGACCTT CCAGGAGAAT
GACCTGAGCA CCTTCTTTCC CTTCATCTTT GAAGAAGAAC CTATCTTCTT CGACACATGG GATAACGAGG
CTTATGTGCA CGATGCACCT GTACGATCAC TGAACTGCAC GCTCCGGGAC TCACAGCAAA AAGCTTGGT
GATGTCTGGT CCATATGAAC TGAAAGCTCT CCACCTCCAG GGACAGGATA TGGAGCAACA AGTGGTGTTC
TCCATGTCCT TTGTACAAGG AGAAGAAAGT AATGACAAAA TACCTGTGGC CTTGGGCCTA AAGGAAAAGA
ATCTGTACCT GTCCTGCGTG TTGAAAGATG ATAAGCCCAC TCTACAGCTG GAGAGTGTAG ATCCCAAAAA
TTACCCAAAG AAGAAGATGG AAAAGCGATT TGTCTTCAAC AAGATAGAAA TCAATAACAA GCTGGAATTT
GAGTCTGCCC AGTTCCCCAA CTGGTACATC AGCACCTCTC AAGCAGAAAA CATGCCCGTC TTCCTGGGAG
```

-continued

```
GGACCAAAGG CGGCCAGGAT ATAACTGACT TCACCATGCA ATTTCTGTCT TCCTAAAGAG AGCTGTACCC
AGAGAGTCCT GTGCTGAATG TGGACTCAAT CCCTAGGGCT GGCAGAAAGG AACAGAAAG GTTTTTGAGT
ACGGCTATAG CCTGGACTTT CCTGTTGTCT ACACCAATGC CCAACTGCCT GCCTTAGGGT AGTGCTAAGA
GGATCTCCTG TCCATCAGCC AGGACAGTCA GCTCTCTCCT TTCAGGGCCA ATCCCCAGCC CTTTTGTTGA
GCCAGGCCTC TCTCACCTCT CCTACTCACT TAAAGCCCGC CTGACAGAAA CCACGGCCAC ATTTGGTTCT
AAGAAACCCT CTGTCATTCG CTCCCACATT CTGATGAGCA ACCGCTTCCC TATTTATTTA TTTATTTGTT
TGTTTGTTTT ATTCATTGGT CTAATTTATT CAAAGGGGC AAGAAGTAGC AGTGTCTGTA AAAGAGCCTA
GTTTTTAATA GCTATGGAAT CAATTCAATT TGGACTGGTG TGCTCTCTTT AAATCAAGTC CTTTAATTAA
GACTGAAAAT ATATAAGCTC AGATTATTTA AATGGGAATA TTTATAAATG AGCAAATATC ATACTGTTCA
ATGGTTCTGA AATAAACTTC TCTGAAG AGAAAGAAAG AGAGAGAGAA AGAAAAGAAA GAGGAAGGAA
GGAAGGAAGG AAGAAAGACA GGCTCTGAGG AAGGTGGCAG TTCCTACAAC GGGAGAACCA GTGGTTAATT
TGCAAAGTGG ATCCTGTGGA GGCANNCAGA GGAGTCCCCT AGGCCACCCA GACAGGGCTT TTAGCTATCT
GCAGGCCAGA CACCAAATTT CAGGAGGGCT CAGTGTTAGG AATGGATTAT GCTTATCAA ATTCACAGGA
AACTAACATG TTGAACAGCT TTTAGATTTC CTGTGGAAAA TATAACTTAC TAAAGATGGA GTTCTTGTGA
CTGACTCCTG ATATCAAGAT ACTGGGAGCC AAATTAAAAA TCAGAAGGCT GCTTGGAGAG CAAGTCCATG
AAATGCTCTT TTTCCCACAG TAGAACCTAT TTCCCTCGTG TCTCAAATAC TTGCACAGAG GCTCACTCCC
TTGGATAATG CAGAGCGAGC ACGATACCTG GCACATACTA ATTTGAATAA AATGCTGTCA AATTCCCATT
CACCCATTCA AGCAGCAAAC TCTATCTCAC CTGAATGTAC ATGCCAGGCA CTGTGCTAGA CTTGGCTCAA
AAAGATTTCA GTTTCCTGGA GGAACCAGGA GGGCAAGGTT TCAACTCAGT GCTATAAGAA GTGTTACAGG
CTGGACACGG TGGCTCACGC CTGTAATCCC AACATTTGGG AGGCCGAGGC GGGCAGATCA CAAGGTCAGG
AGATCGAGAC CATCCTGGCT AACATGGTGA AACCCTGTCT CTACTAAAAA TACAAAAAAT TAGCCGGGCG
TTGGCGGCAG GTGCCTGTAG TCCCAGCTGC TGGGGAGGCT GAGGCAGGAG AATGGTGTGA ACCCGGGAGG
CGGAACTTGC AGGGGGCCGA GATCGTGCCA CTGCACTCCA GCCTGGGCGA CAGAGTGAGA CTCTGTCTCA
AAAAAAAAAA AAAAGTGTTA TGATGCAGAC CTGTCAAAGA GGCAAAGGAG GGTGTTCCTA CACTCCAGGC
ACTGTTCATA ACCTGGACTC TCATTCATTC TACAAATGGA GGGCTCCCCT GGGCAGATCC CTGGAGCAGG
CACTTTGCTG GTGTCTCGGT TAAAGAGAAA CTGATAACTC TTGGTATTAC CAAGAGATAG AGTCTCAGAT
GGATATTCTT ACAGAAACAA TATTCCCACT TTTCAGAGTT CACCAAAAAA TCATTTTAGG CAGAGCTCAT
CTGGCATTGA TCTGGTTCAT CCATGAGATT GGCTAGGGTA ACAGCACCTG GTCTTGCAGG GTTGTGTGAG
CTTATCTCCA GGGTTGCCCC AACTCCGTCA GGAGCCTGAA CCCTGCATAC CGTATGTTCT CTGCCCCAGC
CAAGAAAGGT CAATTTTCTC CTCAGAGGCT CCTGCAATTG ACAGAGAGCT CCCGAGGCAG AGAACAGCAC
CCAAGGTAGA GACCCACACC CTCAATACAG ACAGGGAGGG CTATTGGCCC TTCATTGTAC CCATTTATCC
ATCTGTAAGT GGGAAGATTC CTAAACTTAA GTACAAAGAA GTGAATGAAG AAAAGTATGT GCATGTATAA
ATCTGTGTGT CTTCCACTTT GTCCCACATA TACTAAATTT AAACATTCTT CTAACGTGGG AAAATCCAGT
ATTTTAATGT GGACATCAAC TGCACAACGA TTGTCAGGAA AACAATGCAT ATTTGCATGG TGATACATTT
GCAAAATGTG TCATAGTTTG CTACTCCTTG CCCTTCCATG AACCAGAGAA TTATCTCAGT TTATTAGTCC
CCTCCCCTAA GAAGCTTCCA CCAATACTCT TTTCCCCTTT CCTTTAACTT GATTGTGAAA TCAGGTATTC
AACAGAGAAA TTTCTCAGCC TCCTACTTCT GCTTTTGAAA GCTATAAAAA CAGCGAGGGA GAAACTGGCA
GATACCAAAC CTCTTCGAGG CACAAGGCAC AACAGGCTGC TCTGGGATTC TCTTCAGCCA ATCTTCATTG
CTCAAGTATG ACTTTAATCT TCCTTACAAC TAGGTGCTAA GGGAGTCTCT CTGTCTCTCT GCCTCTTTGT
```

-continued

```
GTGTATGCAT ATTCTCTCTC TCTCTCTCTT TCTTTCTCTG TCTCTCCTCT CCTTCCTCTC TGCCTCCTCT
CTCAGCTTTT TGCAAAAATG CCAGGTGTAA TATAATGCTT ATGACTCGGG AAATATTCTG GGAATGGATA
CTGCTTATCT AACAGCTGAC ACCCTAAAGG TTAGTGTCAA AGCCTCTGCT CCAGCTCTCC TAGCCAATAC
ATTGCTAGTT GGGGTTTGGT TTAGCAAATG CTTTTCTCTA GACCCAAAGG ACTTCTCTTT CACACATTCA
TTCATTTACT CAGAGATCAT TTCTTTGCAT GACTGCCATG CACTGGATGC TGAGAGAAAT CACACATGAA
CGTAGCCGTC ATGGGGAAGT CACTCATTTT CTCCTTTTTA CACAGGTGTC TGAAGCAGCC ATGGCAGAAG
TACCTGAGCT CGCCAGTGAA ATGATGGCTT ATTACAGGTC AGTGGAGACG CTGAGACCAG TAACATGAGC
AGGTCTCCTC TTTCAAGAGT AGAGTGTTAT CTGTGCTTGG AGACCAGATT TTTCCCCTAA ATTGCCTCTT
TCAGTGGCAA ACAGGGTGCC AAGTAAATCT GATTTAAAGA CTACTTTCCC ATTACAAGTC CCTCCAGCCT
TGGGACCTGG AGGCTATCCA GATGTGTTGT TGCAAGGGCT TCCTGCAGAG GCAAATGGGG AGAAAAGATT
CCAAGCCCAC AATACAAGGA ATCCCTTTGC AAAGTGTGGC TTGGAGGGAG AGGGAGAGCT CAGATTTTAG
CTGACTCTGC TGGGCTAGAG GTTAGGCCTC AAGATCCAAC AGGGAGCACC AGGGTGCCCA CCTGCCAGGC
CTAGAATCTG CCTTCTGGAC TGTTCTGCGC ATATCACTGT GAAACTTGCC AGGTGTTTCA GGCAGCTTTG
AGAGGCAGGC TGTTTGCAGT TTCTTATGAA CAGTCAAGTC TTGTACACAG GGAAGGAAAA ATAAACCTGT
TTAGAAGACA TAATTGAGAC ATGTCCCTGT TTTTATTACA GTGGCAATGA GGATGACTTG TTCTTTGAAG
CTGATGGCCC TAAACAGATG AAGGTAAGAC TATGGGTTTA ACTCCCAACC CAAGGAAGGG CTCTAACACA
GGGAAAGCTC AAAGAAGGGA GTTCTGGGCC ACTTTGATGC CATGGTATTT TGTTTTAGAA AGACTTTAAC
CTCTTCCAGT GAGACACAGG CTGCACCACT TGCTGACCTG GCCACTTGGT CATCATATCA CCACAGTCAC
TCACTAACGT TGGTGGTGGT GGCCACACTT GGTGGTGACA GGGGAGGAGT AGTGATAATG TTCCCATTTC
ATAGTAGGAA GACAACCAAG TCTTCAACAT AAATTTGATT ATCCTTTTAA GAGATGGATT CAGCCTATGC
CAATCACTTG AGTTAAACTC TGAAACCAAG AGATGATCTT GAGAACTAAC ATATGTCTAC CCCTTTTGAG
TAGAATAGTT TTTTGCTACC TGGGGTGAAG CTTATAACAA CAAGACATAG ATGATATAAA CAAAAAGATG
AATTGAGACT TGAAAGAAAA CCATTCACTT GCTGTTTGAC CTTGACAAGT CATTTTACCC GCTTTGGACC
TCATCTGAAA AATAAAGGGC TGAGCTGGAT GATCTCTGAG ATTCCAGCAT CCTGCAACCT CCAGTTCTGA
AATATTTTCA GTTGTAGCTA AGGGCATTTG GGCAGCAAAT GGTCATTTTT CAGACTCATC CTTACAAAGA
GCCATGTTAT ATTCCTGCTG TCCCTTCTGT TTTATATGAT GCTCAGTAGC CTTCCTAGGT GCCCAGCCAT
CAGCCTAGCT AGGTCAGTTG TGCAGGTTGG AGGCAGCCAC TTTTCTCTGG CTTTATTTTA TTCCAGTTTG
TGATAGCCTC CCCTAGCCTC ATAATCCAGT CCTCAATCTT GTTAAAAACA TATTTCTTTA GAAGTTTTAA
GACTGGCATA ACTTCTTGGC TGCAGCTGTG GGAGGAGCCC ATTGGCTTGT CTGCCTGGCC TTTGCCCCCC
ATTGCCTCTT CCAGCAGCTT GGCTCTGCTC CAGGCAGGAA ATTCTCTCCT GCTCAACTTT CTTTTGTGCA
CTTACAGGTC TCTTTAACTG TCTTTCAAGC CTTTGAACCA TTATCAGCCT TAAGGCAACC TCAGTGAAGC
CTTAATACGG AGCTTCTCTG AATAAGAGGA AAGTGGTAAC ATTTCACAAA AAGTACTCTC ACAGGATTTG
CAGAATGCCT ATGAGACAGT GTTATGAAAA AGGAAAAAAA AGAACAGTGT AGAAAAATTG AATACTTGCT
GAGTGAGCAT AGGTGAATGG AAAATGTTAT GGTCATCTGC ATGAAAAAGC AAATCATAGT GTGACAGCAT
TAGGGATACA AAAAGATATA GAGAAGGTAT ACATGTATGG TGTAGGTGGG GCATGTACAA AAAGATGACA
AGTAGAATCG GGATTTATTC TAAAGAATAG CCTGTAAGGT GTCCAGAAGC CACATTCTAG TCTTGAGTCT
GCCTCTACCT GCTGTGTGCC CTTGAGTACA CCCTTAACCT CCTTGAGCTT CAGAGAGGGA TAATCTTTTT
ATTTTATTTT ATTTTATTTT GTTTTGTTTT GTTTTGTTTT GTTTTATGAG ACAGAGTCTC ACTCTGTTGC
CCAGGCTGGA GTGCAGTGGT ACAATCTTGG CTTACTGCAT CCTCCACCTC CTGAGTTCAA GCGATTCTCC
TTCCTCAGTC TCCTGAATAG CTAGGATTAC AGGTGCACCC CACCACACCC AGCTAATTTT TGTATTTTTA
```

```
GTAGAGAAGG GGTTTCGCCA TGTTGGCCAG GCTGGTTTTG AAGTCCTGAC CTAAATGATT CATCCACCTC
GGCTTCCCAA AGTGCTGGGA TTACAGGCAT GAGCCACCAC GCCTGGCCCA GAGAGGGATG ATCTTTAGAA
GCTCGGGATT CTTTCAAGCC CTTTCCTCCT CTCTGAGCTT TCTACTCTCT GATGTCAAAG CATGGTTCCT
GGCAGGACCA CCTCACCAGG CTCCCTCCCT CGCTCTCTCC GCAGTGCTCC TTCCAGGACC TGGACCTCTG
CCCTCTGGAT GGCGGCATCC AGCTACGAAT CTCCGACCAC CACTACAGCA AGGGCTTCAG GCAGGCCGCG
TCAGTTGTTG TGGCCATGGA CAAGCTGAGG AAGATGCTGG TTCCCTGCCC ACAGACCTTC AGGAGAATG
ACCTGAGCAC CTTCTTTCCC TTCATCTTTG AAGAAGGTAG TTAGCCAAGA GCAGGCAGTA GATCTCCACT
TGTGTCCTCT TGGAAGTCAT CAAGCCCCAG CCAACTCAAT TCCCCCAGAG CCAAAGCCCT TTAAAGGTAG
AAGGCCCAGC GGGGAGACAA AACAAAGAAG CTGGAAACC AAAGCAATCA TCTCTTTAGT GGAAACTATT
CTTAAAGAAG ATCTTGATGG CTACTGACAT TTGCAACTCC CTCACTCTTT CTCAGGGCC TTTCACTTAC
ATTGTCACCA GAGGTTCGTA ACCTCCCTGT GGGCTAGTGT TATGACCATC ACCATTTTAC CTAAGTAGCT
CTGTTGCTCG GCCACAGTGA GCAGTAATAG ACCTGAAGCT GGAACCCATG TCTAATAGTG TCAGGTCCAG
TGTTCTTAGC CACCCCACTC CCAGCTTCAT CCCTACTGGT GTTGTCATCA GACTTTGACC GTATATGCTC
AGGTGTCCTC CAAGAAATCA AATTTTGCCA CCTCGCCTCA CGAGGCCTGC CCTTCTGATT TTATACCTAA
ACAACATGTG CTCCACATTT CAGAACCTAT CTTCTTCGAC ACATGGGATA ACGAGGCTTA TGTGCACGAT
GCACCTGTAC GATCACTGAA CTGCACGCTC CGGGACTCAC AGCAAAAAAG CTTGGTGATG TCTGGTCCAT
ATGAACTGAA AGCTCTCCAC CTCCAGGGAC AGGATATGGA GCAACAAGGT AAATGGAAAC ATCCTGGTTT
CCCTGCCTGG CCTCCTGGCA GCTTGCTAAT TCTCCATGTT TTAAACAAAG TAGAAAGTTA ATTTAAGGCA
AATGATCAAC ACAAGTGAAA AAAAATATTA AAAGGAATA TACAAACTTT GGTCCTAGAA ATGGCACATT
TGATTGCACT GGCCAGTGCA TTTGTTAACA GGAGTGTGAC CCTGAGAAAT TAGACGGCTC AAGCACTCCC
AGGACCATGT CCACCCAAGT CTCTTGGGCA TAGTGCAGTG TCAATTCTTC CACAATATGG GGTCATTTGA
TGGACATGGC CTAACTGCCT GTGGGTTCTC TCTTCCTGTT GTTGAGGCTG AAACAAGAGT GCTGGAGCGA
TAATGTGTCC ATCCCCCTCC CCAGTCTTCC CCCCTTGCCC CAACATCCGT CCCACCCAAT GCCAGGTGGT
TCCTTGTAGG GAAATTTTAC CGCCCAGCAG GAACTTATAT CTCTCCGCTG TAACGGGCAA AAGTTTCAAG
TGCGGTGAAC CCATCATTAG CTGTGGTGAT CTGCCTGGCA TCGTGCCACA GTAGCCAAAG CCTCTGCACA
GGAGTGTGGG CAACTAAGGC TGCTGACTTT GAAGGACAGC CTCACTCAGG GGAAGCTAT TTGCTCTCAG
CCAGGCCAAG AAAATCCTGT TTCTTTGGAA TCGGGTAGTA AGAGTGATCC CAGGGCCTCC AATTGACACT
GCTGTGACTG AGGAAGATCA AAATGAGTGT CTCTCTTTGG AGCCACTTTC CCAGCTCAGC CTCTCCTCTC
CCAGTTTCTT CCCATGGGCT ACTCTCTGTT CCTGAAACAG TTCTGGTGCC TGATTTCTGG CAGAAGTACA
GCTTCACCTC TTTCCTTTCC TTCCACATTG ATCAAGTTGT TCCGCTCCTG TGGATGGGCA CATTGCCAGC
CAGTGACACA ATGGCTTCCT TCCTTCCTTC CTTCAGCATT TAAAATGTAG ACCCTCTTTC ATTCTCCGTT
CCTACTGCTA TGAGGCTCTG AGAAACCCTC AGGCCTTTGA GGGAAACCC TAAATCAACA AAATGACCCT
GCTATTGTCT GTGAGAAGTC AAGTTATCCT GTGTCTTAGG CCAAGGAACC TCACTGTGGG TTCCCACAGA
GGCTACCAAT TACATGTATC CTACTCTCGG GGCTAGGGGT TGGGGTGACC CTGCATGCTG TGTCCCTAAC
CACAAGACCC CCTTCTTTCT TCAGTGGTGT TCTCCATGTC CTTTGTACAA GGAGAAGAAA GTAATGACAA
AATACCTGTG GCCTTGGGCC TCAAGGAAAA GAATCTGTAC CTGTCCTGCG TGTTGAAAGA TGATAAGCCC
ACTCTACAGC TGGAGGTAAG TGAATGCTAT GGAATGAAGC CCTTCTCAGC CTCCTGCTAC CACTTATTCC
CAGACAATTC ACCTTCTCCC CGCCCCCATC CCTAGGAAAA GCTGGGAACA GGTCTATTTG ACAAGTTTTG
CATTAATGTA AATAAATTTA ACATAATTTT TAACTGCGTG CAACCTTCAA TCCTGCTGCA GAAAATTAAA
```

-continued

```
TCATTTTGCC GATGTTATTA TGTCCTACCA TAGTTACAAC CCCAACAGAT TATATATTGT TAGGGCTGCT
CTCATTTGAT AGACACCTTG GGAAATAGAT GACTTAAAGG GTCCCATTAT CACGTCCACT CCACTCCCAA
AATCACCACC ACTATCACCT CCAGCTTTCT CAGCAAAAGC TTCATTTCCA AGTTGATGTC ATTCTAGGAC
CATAAGGAAA AATACAATAA AAAGCCCCTG GAAACTAGGT ACTTCAAGAA GCTCTAGCTT AATTTTCACC
CCCCCAAAAA AAAAAAATTC TCACCTACAT TATGCTCCTC AGCATTTGGC ACTAAGTTTT AGAAAAGAAG
AAGGGCTCTT TTAATAATCA CACAGAAAGT TGGGGGCCCA GTTACAACTC AGGAGTCTGG CTCCTGATCA
TGTGACCTGC TCGTCAGTTT CCTTTCTGGC CAACCCAAAG AACATCTTTC CCATAGGCAT CTTTGTCCCT
TGCCCCACAA AAATTCTTCT TTCTCTTTCG CTGCAGAGTG TAGATCCCAA AAATTACCCA AGAAGAAGA
TGGAAAAGCG ATTTGTCTTC AACAAGATAG AAATCAATAA CAAGCTGGAA TTTGAGTCTG CCCAGTTCCC
CAACTGGTAC ATCAGCACCT CTCAAGCAGA AAACATGCCC GTCTTCCTGG GAGGGACCAA AGGCGGCCAG
GATATAACTG ACTTCACCAT GCAATTTGTG TCTTCCTAAA GAGAGCTGTA CCCAGAGAGT CCTGTGCTGA
ATGTGGACTC AATCCCTAGG GCTGGCAGAA AGGGAACAGA AAGGTTTTTG AGTACGGCTA TAGCCTGGAC
TTTCCTGTTG TCTACACCAA TGCCCAACTG CCTGCCTTAG GGTAGTGCTA AGAGGATCTC CTGTCCATCA
GCCAGGACAG TCAGCTCTCT CCTTTCAGGG CCAATCCCCA GCCCTTTTGT TGAGCCAGGC CTCTCTCACC
TCTCCTACTC ACTTAAAGCC CGCCTGACAG AAACCACGGC CACATTTGGT TCTAAGAAAC CCTCTGTCAT
TCGCTCCCAC ATTCTGATGA GCAACCGCTT CCCTATTTAT TTATTTATTT GTTTGTTTGT TTTGATTCAT
TGGTCTAATT TATTCAAAGG GGGCAAGAAG TAGCAGTGTC TGTAAAAGAG CCTAGTTTTT AATAGCTATG
GAATCAATTC AATTTGGACT GGTGTGCTCT CTTTAAATCA AGTCCTTTAA TTAAGACTGA AAATATATAA
GCTCAGATTA TTTAAATGGG AATATTTATA AATGAGCAAA TATCATACTG TTCAATGGTT CTGAAATAAA
CTTCACTGAA GAAAAAAAAA AAAGGGTCTC TCCTGATCAT TGACTGTCTG GATTGACACT GACAGTAAGC
AAACAGGCTG TGAGAGTTCT TGGGACTAAG CCCACTCCTC ATTGCTGAGT GCTGCAAGTA CCTAGAAATA
TCCTTGGCCA CCGAAGACTA TCCTCCTCAC CCATCCCCTT TATTTCGTTG TTCAACAGAA GGATATTCAG
TGCACATCTG AACAGGATC AGCTGAAGCA CTGCAGGGAG TCAGGACTGG TAGTAACAGC TACCATGATT
TATCTATCAA TGCACCAAAC ATCTGTTGAG CAAGCGCTAT GTACTAGGAG CTGGGAGTAC AGAGATGAGA
ACAGTCACAA GTCCCTCCTC AGATAGGAGA GGCAGCTAGT TATAAGCAGA ACAAGGTAAC ATGACAAGTA
GAGTAAGATA GAAGAACGAA GAGGAGTAGC CAGGAAGGAG GGAGGAGAAC GACATAAGAA TCAAGCCTAA
AGGGATAAAC AGAAGATTTC CACACATGGG CTGGGCCAAT TGGGTGTCGG TTACGCCTGT AATCCCAGCA
CTTTGGGTGG CAGGGGCAGA AGATCGCTT GAGCCCAGGA GTTCAAGACC AGCCTGGGCA ACATAGTGAG
ACTCCCATCT CTACAAAAAA TAAATAAATA AATAAAACAA TCAGCCAGGC ATGCTGGCAT GCACCTGTAG
TCCTAGCTAC TTGGGAAGCT GACACTGGAG GATTGCTTGA GCCCAGAAGT TCAAGACTGC AGTGAGCTTA
TCCGTTGACC TGCAGGTCGA C ACAAACCTTT TCGAGGCAAA AGGCAAAAAA GGCTGCTCTG GGATTCTCTT
CAGCCAATCT TCAATGCTCA AGTGTCTGAA GCAGCCATGG CAGAAGTACC TAAGCTCGCC AGTGAAATGA
TGGCTTATTA CAGTGGCAAT GAGGATGACT TGTTCTTTGA AGCTGATGGC CCTAAACAGA TGAAGTGCTC
CTTCCAGGAC CTGGACCTCT GCCCTCTGGA TGGCGGCATC CAGCTACGAA TCTCCGACCA CCACTACAGC
AAGGGCTTCA GGCAGGCCGC GTCAGTTGTT GTGGCCATGG ACAAGCTGAG GAAGATGCTG GTTCCCTGCC
CACAGACCTT CCAGGAGAAT GACCTGAGCA CCTTCTTTCC CTTCATCTTT GAAGAAGAAC CTATCTTCTT
CGACACATGG GATAACGAGG CTTATGTGCA CGATGCACCT GTACGATCAC TGAACTGCAC GCTCCGGGAC
TCACAGCAAA AAGCTTGGT GATGTCTGGT CCATATGAAC TGAAAGCTCT CCACCTCCAG GGACAGGATA
TGGAGCAACA AGTGGTGTTC TCCATGTCCT TTGTACAAGG AGAAGAAAGT AATGACAAAA TACCTGTGGC
CTTGGGCCTC AAGGAAAAGA ATCTGTACCT GTCCTGCGTG TTGAAAGATG ATAAGCCCAC TCTACAGCTG
```

```
GAGAGTGTAG ATCCCAAAAA TTACCCAAAG AAGAAGATGG AAAAGCGATT TGTCTTCAAC AAGATAGAAA
TCAATAACAA GCTGGAATTT GAGTCTGCCC AGTTCCCCAA CTGGTACATC AGCACCTCTC AAGCAGAAAA
CATGCCCGTC TTCCTGGGAG GGACCAAAGG CGGCCAGGAT ATAACTGACT TCACCATGCA ATTTGTGTCT
TCCTAAAGAG AGCTGTACCC AGAGAGTCCT GTGCTGAATG TGGACTCAAT CCCTAGGGCT GGCAGAAAGG
GAACAGAAAG GTTTTTGAGT ACGGCTATAG CCTGGACTTT CCTGTTGTCT ACACCAATGC CCAACTGCCT
GCCTTAGGGT AGTGCTAAGA GGATCTCCTG TCCATCAGCC AGGACAGTCA GCTCTCTCCT TTCAGGGCCA
ATCCCAGCCC TTTTGTTGAG CCAGGCCTCT CTCACCTCTC CTACTCACTT AAAGCCCGCC TGACAGAAAC
CAGGCCACAT TTTGGTTCTA AGAAACCCTC CTCTGTCATT CGCTCCCACA TTCTGATGAG CAACCGCTTC
CCTATTTATT TATTTATTTG TTTGTTTGTT TTGATTCATT GGTCTAATTT ATTCAAAGGG GCAAGAAGT
AGCAGTGTCT GTAAAAGAGC CTAGTTTTTA ATAGCTATGG AATCAATTCA ATTTGGACTG GTGTGCTCTC
TTTAAATCAA GTCCTTTAAT TAAGACTGAA AATATATAAG CTCAGATTAT TTAAATGGGA ATATTTATAA
ATGAGCAAAT ATCATACTGT TCAATGGTTC TCAAATAAAC TTCACT CTGGCAGGAG TAGCAGCTGC
CCCTTGGCGC GACTGCTGGA GCCGCGAACT AGAGAAACAC AGACACGCCT CATAGAGCAA CGGCGTCTCT
CGGAGCGTGG AGCCCGCCAA GCTCGAGCTG AGCTTTCGCT TGCCGTCCAC CACTGCCCAC ACTGTCGTTT
GCTGCCATCG CAGACCTGCT GCTGACTTCC ATCCCTCTGG ATCCGGCAAG GGCCTGCGAT TTTGACAATG
TCAAGATTTA CCGTATATCC CTGTTTGTTT GGATACACCA GTGACGTCCA CTTCTAGAAG ACAAAGTTAT
ATTACTTAAA CAACCAAAGA TATGAAACTA TCCATGAAGA ACAATATTAT CAATACACAG CAGTCTTTTG
TAACCATGCC CAATGTGATT GTACCAGATA TTGAAAAGGA AATACGAAGG ATGGAAAATG GAGCATGCAG
CTCCTTTTCT GAGGATGATG ACAGTGCCTC TACATCTGAA GAATCAGAGA ATGAAAACCC TCATGCAAGG
GGTTCCTTTA GTTATAAGTC ACTCAGAAAG GGAGGACCAT CACAGAGGGA GCAGTACCTG CCTGGTGCCA
TTGCCATTTT TAATGTGAAC AACAGCGACA ATAAGGACCA GGAACCAGAA GAAAAAAAGA AAAAGAAAAA
AGAAAAGAAG AGCAAGTCAG ATGATAAAAA CGAAAATAAA AACGACCCAA GAAGAAGAT GGAAAAGCGA
ATGGCCAAAG TTCCAGACAT GTTTGAAGAC CTGAAGAACT GTTACAGTGA AAATGAAGAA GACAGTTCCT
CCATTGATCA TCTGTCTCTG AATCAGAAAT CCTTCTATCA TGTAAGCTAT GGCCCACTCC ATGAAGGCTG
CATGGATCAA TCTGTGTCTC TGAGTATCTC TGAAACCTCT AAAACATCCA AGCTTACCTT CAAGGAGAGC
ATGGTGGTAG TAGCAACCAA CGGGAAGGTT CTGAAGAAGA GACGGTTGAG TTTAAGCCAA TCCATCACTG
ATGATGACCT GGAGGCCATC GCCAATGACT CAGAGGAAGA AATCATCAAG CCTAGGTCAG CACCTTTTAG
CTTCCTGAGC AATGTGAAAT ACAACTTTAT GAGGATCATC AAATACGAAT TCATCCTGAA TGACGCCCTC
AATCAAAGTA TAATTCGAGC CAATGATCAG TACCTCACGG CTGCTGCATT ACATAATCTG GATGAAGCAG
TGAAATTTGA CATGGGTGCT TATAAGTCAT CAAAGGATGA TGCTAAAATT ACCGTGATTC TAAGAATCTC
AAAAACTCAA TTGTATGTGA CTGCCCAAGA TGAAGACCAA CCAGTGCTGC TGAAGGAGAT GCCTGAGATA
CCCAAAACCA TCACAGGTAG TGAGACCAAC CTCCTCTTCT TCTGGGAAAC TCACGGCACT AAGAACTATT
TCACATCAGT TGCCCATCCA AACTTGTTTA TTGCCACAAA GCAAGACTAC TGGGTGTGCT TGGCAGGGGG
GCCACCCTCT ATCACTGACT TTCAGATACT GGAAAACCAG GCGTAGGTCT GGAGTCTCAC TTGTCTCACT
TGTGCAGTGT TGACAGTTCA TATGTACCAT GTACATGAAG AAGCTAAATC CTTTACTGTT AGTCATTTGC
TGAGCATGTA CTGAGCCTTG TAATTCTAAA TGAATGTTTA CACTCTTTGT AAGAGTGGAA CCAACACTAA
CATATAATGT TGTTATTTAA AGAACACCCT ATATTTTGCA TAGTACCAAT CATTTTAATT ATTATTCTTC
ATAACAATTT TAGGAGGACC AGAGCTACTG ACTATGGCTA CCAAAAAGAC TCTACCCATA TTACAGATGG
GCAAATTAAG GCATAAGAAA ACTAAGAAAT ATGCACAATA GCAGTTGAAA CAAGAAGCCA CAGACCTAGG
```

```
ATTTCATGAT TTCATTTCAA CTGTTTGCCT TCTGCTTTTA AGTTGCTGAT GAACTCTTAA TCAAATAGCA
TAAGTTTCTG GGACCTCAGT TTTATCATTT TCAAAATGGA GGGAATAATA CCTAAGCCTT CCTGCCGCAA
CAGTTTTTTA TGCTAATCAG GGAGGTCATT TTGGTAAAAT ACTTCTCGAA GCCGAGCCTC AAGATGAAGG
CAAAGCACGA AATGTTATTT TTTAATTATT ATTTATATAT GTATTTATAA ATATATTTAA GATAATTATA
ATATACTATA TTTATGGGAA CCCCTTCATC CTCTGAGTGT GACCAGGCAT CCTCCACAAT AGCAGACAGT
GTTTTCTGGG ATAAGTAAGT TTGATTTCAT TAATACAGGG CATTTTGGTC CAAGTTGTGC TTATCCCATA
GCCAGGAAAC TCTGCATTCT AGTACTTGGG AGACCTGTAA TCATATAATA AATGTACATT AATTACCTTG
AGCCAGTAAT TGGTCCGATC TTTGACTCTT TTGCCATTAA ACTTACCTGG GCATTCTTGT TTCATTCAAT
TCCACCTGCA ATCAAGTCCT ACAAGCTAAA ATTAGATGAA CTCAACTTTG ACAACCATAG ACCACTGTTA
TCAAAACTTT CTTTTCTGGA ATGTAATCAA TGTTTCTTCT AGGTTCTAAA AATTGTGATC AGACCATAAT
GTTACATTAT TATCAACAAT AGTGATTGAT AGAGTGTTAT CAGTCATAAC TAAATAAAGC TTGCAAGTGA
GGGAGTCATT TCATTGGCGT TTGAGTCAGC AAAGAAGTCA AG AGCTGCCAGC CAGAGAGGGA GTCATTTCAT
TGGCGTTTGA GTCAGCAAAG AAGTCAAGAT GGCCAAAGTT CCAGACATGT TTGAAGACCT GAAGAACTGT
TACAGTGAAA ATGAAGAAGA CAGTTCCTCC ATTGATCATC TGTCTCTGAA TCAGAAATCC TTCTATCATG
TAAGCTATGG CCCACTCCAT GAAGGCTGCA TGGATCAATC TGTGTCTCTG AGTATCTCTG AAACCTCTAA
AACATCCAAG CTTACCTTCA AGGAGAGCAT GGTGGTAGTA GCAACCAACG GGAAGGTTCT GAAGAAGAGA
CGGTTGAGTT TAAGCCAATC CATCACTGAT GATGACCTGG AGGCCATCGC CAATGACTCA GAGGAAGAAA
TCATCAAGCC TAGGTCATCA CCTTTTAGCT TCCTGAGCAA TGTGAAATAC AACTTTATGA GGATCATCAA
ATACGAATTC ATCCTGAATG ACGCCCTCAA TCAAAGTATA ATTCGAGCCA ATGATCAGTA CCTCACGGCT
GCTGCATTAC ATAATCTGGA TGAAGCAGTG AAATTTGACA TGGGTGCTTA TAAGTCATCA AAGGATGATG
CTAAAATTAC CGTGATTCTA AGAATCTCAA AAACTCAATT GTATGTGACT GCCCAAGATG AAGACCAACC
AGTGCTGCTG AAGGAGATGC CTGAGATACC CAAAACCATC ACAGGTAGTG AGACCAACCT CCTCTTCTTC
TGGGAAACTC ACGGCACTAA GAACTATTTC ACATCAGTTG CCCATCCAAA CTTGTTTATT GCCACAAAGC
AAGACTACTG GGTGTGCTTG GCAGGGGGGC CACCCTCTAT CACTGACTTT CAGATACTGG AAAACCAGGC
GTAGGTCTGG AGTCTCACTT GTCTCACTTG TGCAGTGTTG ACAGTTCATA TGTACCATGT ACATGAAGAA
GCTAAATCCT TTACTGTTAG TCATTTGCTG AGCATGTACT GAGCCTTGTA ATTCTAAATG AATGTTTACA
CTCTTTGTAA GAGTGGAACC AACACTAACA TATAATGTTG TTATTTAAAG AACACCCTAT ATTTTGCATA
GTACCAATCA TTTTAATTAT TATTCTTCAT AACAATTTTA GGAGGACCAG AGCTACTGAC TATGGCTACC
AAAAAGACTC TACCCATATT ACAGATGGGC AAATTAAGGC ATAAGAAAAC TAAGAAATAT GCACAATAGC
AGTCGAAACA AGAAGCCACA GACCTAGGAT TTCATGATTT CATTTCAACT GTTTGCCTTC TGCTTTTAAG
TTGCTGATGA ACTCTTAATC AAATAGCATA AGTTTCTGGG ACCTCAGTTT TATCATTTTC AAAATGGAGG
GAATAATACC TAAGCCTTCC TGCCGCAACA GTTTTTTATG CTAATCAGGG AGGTCATTTT GGTAAAATAC
TTCTCGAAGC CGAGCCTCAA GATGAAGGCA AGCACGAAA TGTTATTTTT TAATTATTAT TTATATATGT
ATTTATAAAT ATATTTAAGA TAATTATAAT ATACTATATT TATGGGAACC CCTTCATCCT CTGAGTGTGA
CCAGGCATCC TCCACAATAG CAGACAGTGT TTTCTGGGAT AAGTAAGTTT GATTTCATTA ATACAGGGCA
TTTTGGTCCA AGTTGTGCTT ATCCCATAGC CAGGAAACTC TGCATTCTAG TACTTGGGAG ACCTGTAATC
ATATAATAAA TGTACATTAA TTACCTTGAG CCAGTAATTG GTCCGATCTT TGACTCTTTT GCCATTAAAC
TTACCTGGGC ATTCTTGTTT CATTCAATTC CACCTGCAAT CAAGTCCTAC AAGCTAAAAT TAGATGAACT
CAACTTTGAC AACCATGAGA CCACTGTTAT CAAAACTTTC TTTTCTGGAA TGTAATCAAT GTTTCTTCTA
GGTTCTAAAA ATTGTGATCA GACCATAATG TTACATTATT ATCAACAATA GTGATTGATA GAGTGTTATC
```

```
AGTCATAACT AAATAAAGCT TGCAACAAAA TTCTCTG-3'  (FRAG. NO: _ ) (SEQ. ID NO: 2517)

5'-AAGCTTCTAC CCTAGTCTGG TGCTACACTT ACATTGCTTA CATCCAAGTG TGGTTATTTC TGTGGCTCCT

GTTATAACTA TTATAGCACC AGGTCTATGA CCAGGAGAAT TAGACTGGCA TTAAATCAGA ATAAGAGATT

TTGCACCTGC AATAGACCTT ATGACACCTA ACCAACCCCA TTATTTACAA TTAAACAGGA ACAGAGGGAA

TACTTTATCC AACTCACACA AGCTGTTTTC CTCCCAGATC CATGCTTTTT TGCGTTTATT ATTTTTTAGA

GATGGGGGCT TCACTATGTT GCCCACACTG GACTAAAACT CTGGGCCTCA AGTGATTGTC CTGCCTCAGC

CTCCTGAATA GCTGGGACTA CAGGGGCATG CCATCACACC TAGTTCATTT CCTCTATTTA AAATATACAT

GGCTTAAACT CCAACTGGGA ACCCAAAACA TTCATTTGCT AAGAGTCTGG TGTTCTACCA CCTGAACTAG

GCTGGCCACA GGAATTATAA AAGCTGAGAA ATTCTTTAAT AATAGTAACC AGGCAACATC ATTGAAGGCT

CATATGTAAA AATCCATGCC TTCCTTTCTC CCAATCTCCA TTCCCAAACT TAGCCACTGG TTCTGGCTGA

GGCCTTACGC ATACCTCCCG GGGCTTGCAC ACACCTTCTT CTACAGAAGA CACACCTTGG GCATATCCTA

CAGAAGACCA GGCTTCTCTC TGGTCCTTGG TAGAGGGCTA CTTTACTGTA ACAGGGCCAG GGTGGAGAGT

TCTCTCCTGA AGCTCCATCC CCTCTATAGG AAATGTGTTG ACAATATTCA GAAGAGTAAG AGGATCAAGA

CTTCTTTGTG CTCAAATACC ACTGTTCTCT TCTCTACCCT GCCCTAACCA GGAGCTTGTC ACCCCAAACT

CTGAGGTGAT TTATGCCTTA ATCAAGCAAA CTTCCCTCTT CAGAAAAGAT GGCTCATTTT CCCTCAAAAG

TTGCCAGGAG CTGCCAAGTA TTCTGCCAAT TCACCCTGGA GCACAATCAA CAAATTCAGC CAGAACACAA
CTACAGCTAC TATTAGAACT ATTATTATTA ATAAATTCCT CTCCAAATCT AGCCCCTTGA CTTCGGATTT

CACGATTTCT CCCTTCCTCC TAGAAACTTG ATAAGTTTCC CGCGCTTCCC TTTTTCTAAG ACTACATGTT

TGTCATCTTA TAAAGCAAAG GGGTGAATAA ATGAACCAAA TCAATAACTT CTGGAATATC TGCAAACAAC

AATAATATCA GCTATGCCAT CTTTCACTAT TTTAGCCAGT ATCGAGTTGA ATGAACATAG AAAAATACAA

AACTGAATTC TTCCCTGTAA ATTCCCCGTT TTGACGACGC ACTTGTAGCC ACGTAGCCAC GCCTACTTAA

GACAATTACA AAAGGCGAAG AAGACTGACT CAGGCTTAAG CTGCCAGCCA GAGAGGGAGT CATTTCATTG

GCGTTTGAGT CAGCAAAGGT ATTGTCCTCA CATCTCTGGC TATTAAAGTA TTTTCTGTTG TTGTTTTTCT

CTTTGGCTGT TTTCTCTCAC ATTGCCTTCT CTAAAGCTAC AGTCTCTCCT TTCTTTTCTT GTCCCTCCCT

GGTTTGGTAT GTGACCTAGA ATTACAGTCA GATTTCAGAA AATGATTCTC TCATTTTGCT GATAAGGACT

GATTCGTTTT ACTGAGGGAC GGCAGAACTA GTTTCCTATG AGGGCATGGG TGAATACAAC TGAGGCTTCT

CATGGGAGGG AATCTCTACT ATCCAAAATT ATTAGGAGAA AATTGAAAAT TTCCAACTCT GTCTCTCTCT

TACCTCTGTG TAAGGCAAAT ACCTTATTCT TGTGGTGTTT TTGTAACCTC TTCAAACTTT CATTGATTGA

ATGCCTGTTC TGGCAATACA TTAGGTTGGG CACATAAGGA ATACCAACAT AAATAAAACA TTCTAAAAGA

AGTTTACGAT CTAATAAAGG AGACAGGTAC ATAGCAAACT AATTCAAAGG AGCTAGAAGA TGGAGAAAAT

GCTGAATGTG GACTAAGTCA TTCAACAAAG TTTTCAGGAA GCACAAAGAG GAGGGCTCC CCTCACAGAT

ATCTGGATTA GAGGCTGGCT GAGCTGATGG TGGCTGGTGT TCTCTGTTGC AGAAGTCAAG ATGGCCAAAG

TTCCAGACAT GTTTGAAGAC CTGAAGAACT GTTACAGGTA AGGAATAAGA TTTATCTCTT GTGATTTAAT

GAGGGTTTCA AGGCTCACCA GAATCCAGCT AGGCATAACA GTGGCCAGCA TGGGGCAGG CCGGCAGAGG

TTGTAGAGAT GTGTACTAGT CCTGAAGTCA GAGCAGGTTC AGAGAAGACC CAGAAAAACT AAGCATTCAG

CATGTTAAAC TGAGATTACA TTGGCAGGGA GACCGCCATT TTAGAAAAAT TATTTTTGAG GTCTGCTGAG

CCCTACATGA ATATCAGCAT CAACTTAGAC ACAGCCTCTG TTGAGATCAC ATGCCCTGAT ATAAGAATGG

GTTTTACTGG TCCATTCTCA GGAAAACTTG ATCTCATTCA GGAACAGGAA ATGGCTCCAC AGCAAGCTGG

GCATGTGAAC TCACATATGC AGGCAAATCT CACTCAGATG TAGAAGAAAG GTAAATGAAC ACAAAGATAA

AATTACGGAA CATATTAAAC TAACATGATG TTTCCATTAT CTGTAGTAAA TACTAACACA AACTAGGCTG
```

```
TCAAAATTTT GCCTGGATAT TTTACTAAGT ATAAATTATG AAATCTGTTT TAGTGAATAC ATGAAAGTAA
TGTGTAACAT ATAATCTATT TGGTTAAAAT AAAAAGGAAG TGCTTCAAAA CCTTTCTTTT CTCTAAAGGA
GCTTAACATT CTTCCCTGAA CTTCAATTAA AGCTCTTCAA TTTGTTAGCC AAGTCCAATT TTTACAGATA
AAGCACAGGT AAAGCTCAAA GCCTGTCTTG ATGACTACTA ATTCCAGATT AGTAAGATAT GAATTACTCT
ACCTATGTGT ATGTGTAGAA GTCCTTAAAT TTCAAAGATG ACAGTAATGG CCATGTGTAT GTGTGTGACC
CACAACTATC ATGGTCATTA AGTACATTG GCCAGAGACC ACATGAAATA ACAACAATTA CATTCTCATC
ATCTTATTTT GACAGTGAAA ATGAAGAAGA CAGTTCCTCC ATTGATCATC TGTCTCTGAA TCAGGTAAGC
AAATGACTGT AATTCTCATG GGACTGCTAT TCTTACACAG TGGTTTCTTC ATCCAAAGAG AACAGCAATG
ACTTGAATCT TAAATACTTT TGTTTTACCC TCACTAGAGA TCCAGAGACC TGTCTTTCAT TATAAGTGAG
ACCAGCTGCC TCTCTAAACT AATAGTTGAT GTGCATTGGC TTCTCCCAGA ACAGAGCAGA ACTATCCCAA
ATCCCTGAGA ACTGGAGTCT CCTGGGGCAG GCTTCATCAG GATGTTAGTT ATGCCATCCT GAGAAAGCCC
CGCAGGCCGC TTCACCAGGT GTCTGTCTCC TAACGTGATG TGTTGTGGTT GTCTTCTCTG ACACCAGCAT
CAGAGGTTAG AGAAAGTCTC CAAACATGAA GCTGAGAGAG AGGAAGCAAG CCAGCTGAAA GTGAGAAGTC
TACAGCCACT CATCAATCTG TGTTATTGTG TTTGGAGACC ACAAATAGAC ACTATAAGTA CTGCCTAGTA
TGTCTTCAGT ACTGGCTTTA AAAGCTGTCC CCAAAGGAGT ATTTCTAAAA TATTTTGAGC ATTGTTAAGC
AGATTTTTAA CCTCCTGAGA GGGAACTAAT TGGAAAGCTA CCACTCACTA CAATCATTGT TAACCTATTT
AGTTACAACA TCTCATTTTT GAGCATGCAA ATAAATGAAA AAGTCTTCCT AAAAAAATCA TCTTTTTATC
CTGGAAGGAG GAAGGAAGGT GAGACAAAAG GGAGAGAGGG AGGGAAGCCT AATGAAACAC CAGTTACCTA
AGACCAGAAT GGAGATCCTC CTCACTACCT CTGTTGAATA CAGCACCTAC TGAAAGAACT TTCATTCCCT
GACCATGAAC AGCCTCTCAG CTTCTGTTTT CCTTCCTCAC AGAAATCCTT CTATCATGTA AGCTATGGCC
CACTCCATGA AGGCTGCATG GATCAATCTG TGTCTCTGAG TATCTCTGAA ACCTCTAAAA CATCCAAGCT
TACCTTCAAG GAGAGCATGG TGGTAGTAGC AACCAACGGG AAGGTTCTGA AGAAGAGACG GTTGAGTTTA
AGCCAATCCA TCACTGATGA TGACCTGGAG GCCATCGCCA ATGACTCAGA GGAAGGTAAG GGGTCAAGCA
CAATAATATC TTTCTTTTAC AGTTTTAAGC AAGTAGGGAC AGTAGAATTT AGGGAAAAT TAAACGTGGA
GTCAGAATAA CAAGAAGACA ACCAAGCATT AGTCTGGTAA CTATACAGAG GAAAATTAAT TTTTATCCTT
CTCCAGGAGG GAGAAATGAG CAGTGGCCTG AATCGAGAAT ACTTGCTCAC AGCCATTATT TCTTAGCCAT
ATTGTAAAGG TCGTGTGACT TTTAGCCTTT CAGGAGAAAG CAGTAATAAG ACCACTTACG AGCTATGTTC
CTCTCATACT AACTATGCCT CCTTGGTCAT GTTACATAAT CTTTTCGTGA TTCAGTTTCC TCTACTGTAA
AATGGAGATA ATCAGAATCC CCCACTCATT GGATTGTTGT AAAGATTAAG AGTCTCAGGC TTTACAGACT
GAGCTAGCTG GGCCCTCCTG ACTGTTATAA AGATTAAATG AGTCAACATC CCCTAACTTC TGGACTAGAA
TAATGTCTGG TACAAAGTAA GCACCCAATA AATGTTAGCT ATTACTATCA TTATTATTAT TATTTTATTT
TTTTTTTTG AGATGGAGTC TGGCTCTGTC ACCCAGGCTG GAGTGCAGTG GCACAATCTC GGCTCACTGC
AAGCTCTGCC TCCTGGGTTC ATGCCATTCT CCTGCCTCAG CCTCCCGAGT AAGCTGGGAA TACAGGCACC
CGCCACTGTT CCCGGCTAAT TTTTTGTATT TTTAGTAGAG ACGGAGTTTC ACCGTGGTCT CCATCTCCTC
GTGATCCACC CACCTTGGCC TCCCAAAGTG CCGGGATTAC AGGCGTGAGC CACCGCGCCC GGCCTATTAT
TATTATTATT ACTACTACTA CTACCTATAT GAATACTACC AGCAATACTA ATTTATTAAT GACTGGATTA
TGTCTAAACC TCACAAGAAT CCTACCTTCT CATTTTACAT AAAAGGAAAC TAAGCTCATT GAGATAGGTA
AACTGCCCAA TGGCATACAT CTGTAAGTGG GAGAGCCTCA AATCTAATTC AGTTCTACCT GAGTAAAAAA
ATCATGGTTT CTCCTCCATC CCTTTACTGT ACAAGCCTCC ACATGAACTA TAAACCCAAT ATTCCTGTTT
```

```
TTAAGATAAT ACCTAAGCAA TAACGCATGT TCACCTAGAA GGTTTTAAAA TGTAACAAAA TATAAGAAAA

TAAAAATCAC TCATATCGTC AGTGAGAGTT TACTACTGCC AGCACTATGG TATGTTTCCT TAAAATCTTT

GCTATACACA TACCTACATG TGAACAAATA TGTCTAACAT CAAGACCACA CTATTTACAA CTTTATATCC

AGCTTTTCTT ACTTAGCAAT GTATTGAGGA CATTTTAGAG TGCCCGTTTT TCACCATTAT AAGCAATGCA

ACAATGAACA TCTGTATAAA TAAATATTCA TTTCTCTCAC CCTTTATTTC CTTAGAATAT ATTCCTAGAA

GTAGAATTTC CCAGAGCCAT GAGGATTTGT GACGCTATTG ATATGTGCCA CTTTGCACTC TCTGTGACAT

ATATAATTAT TTTTAATGCA TTCATTTTTT TCTCAGAGTG CATTCGTTTG AAAACATAGA CGGGAAATAC

TGGTAGTCTT CCTTGTCAGT TAGAAACACC CAAACAATGA AAAATGAAAA AGTTGCACAA ATAGTCTCTA

AAAACAATGA AACTATTGCC TGAGGAATTG AAGTTTAAAA AGAAGCACAT AAGCAACAAC AAGGATAATC

CTAGAAAACC AGTTCTGCTG ACTGGGTGAT TTCACTTCTC TTTGCTTCCT CATCTGGATT GGAATATTCC

TAATACCCCC TCCAGAACTA TTTTCCCTGT TTGTACTAGA CTGTGTATAT CATCTGTGTT TGTACATAGA

CATTAATCTG CACTTGTGAT CATGGTTTTA GAAATCATCA AGCCTAGGTC ATCACCTTTT AGCTTCCTGA

GCAATGTGAA ATACAACTTT ATGAGGATCA TCAAATACGA ATTCATCCTG AATGACGCCC TCAATCAAAG

TATAATTCGA GCCAATGATC AGTACCTCAC GGCTGCTGCA TTACATAATC TGGATGAAGC AGGTACATTA

AAATGGCACC AGACATTTCT GTCATCCTCC CCTCCTTTCA TTTACTTATT TATTTATTTC AATCTTTCTG

CTTGCAAAAA ACATACCTCT TCAGAGTTCT GGGTTGCACA ATTCTTCCAG AATAGCTTGA AGCACAGCAC

CCCCATAAAA ATCCCAAGCC AGGGCAGAAG GTTCAACTAA ATCTGGAAGT TCCACAAGAG AGAAGTTTCC

TATCTTTGAG AGTAAAGGGT TGTGCACAAA GCTAGCTGAT GTACTACCTC TTTGGTTCTT TCAGACATTC

TTACCCTCAA TTTTAAAACT GAGGAAACTG TCAGACATAT TAAATGATTT ACTCAGATTT ACCCAGAAGC

CAATGAAGAA CAATCACTCT CCTTTAAAAA GTCTGTTGAT CAAACTCACA AGTAACACCA AACCAGGAAG

ATCTTTATTA TCTCTGATAA CATATTTGTG AGGCAAAACC TCCAATAAGC TACAAATATG CTTAAAGGA

TGAAGTTTAG TGTCCAAAAA CTTTTATCAC ACACATCCAA TTTTCATGGC GGACATGTTT TAGTTTCAAC

AGTATACATA TTTTCAAAGG TCCAGAGAGG CAATTTTGCA ATAAACAAGC AAGACTTTTT CTGATTGGAT

GCACTTCAGC TAACATGCTT TCAACTCTAC ATTTACAAAT TATTTTGTGT CTATTTTTC TACTTAATAT

TATTTCTGCA ATTTTCCCAA TATTGACATC GTGTATGTAT TTGCCATTTT TAATATCACT AGACAATTCA

ATCAGGTTGC TACGTTGGTC CCTTGGGTTT ACTCTAAATA GCTTGATTGC AAATATCTTT GTATATATTA

TTGTTTTTTC TCCTATCTTG TAATTTCTTT GAGCACATCC CAAAGAGGAA TGCCTAGATC AATGGGCACA

AATAATTTGA CAGCTCTTAT TAAACATTAT TCTGTAAGTA AAAACTGAAC TACTTTTCAG TATCACTAGC

AACATATGAG TGTATCAGCT TCCTAAACCC CTCCATGTTA GGTCATTATG AACTTATGAT CTAACAAATT

ACAGGGTCTT ATCCCACTAA TGAAATTATA AGAGATTCAA CACTTATTCA GCCCCGAAGG ATTCATTCAA

CGTAGAAAAT TCTAAGAACA TTAACCAAGT ATTTACCTGC CTAGTGAGTG TGGAAGACAT TGTGAAGGAC

ACAAAGATGT ATAGAATTCC ATTCCTGACT TCCAGGTATT TACACCATAG GTGGGGACCT AACTACACAC

ACACACACAC ACACACACAC ACACACACAC ACCATGCACA CACAATCTAC ATCAACACTT GATTTATAC

AAATACAATG AATTTACTTT CTTTTTGGTT CTTCTCTTCA CCAGTGAAAT TTGACATGGG TGCTTATAAG

TCATCAAAGG ATGATGCTAA AATTACCGTG ATTCTAAGAA TCTCAAAAAC TCAATTGTAT GTGACTGCCC

AAGATGAAGA CCAACCAGTG CTGCTGAAGG TCAGTTGTCC TTTGTCTCCA ACTTACCTTC ATTTACATCT

CATATGTTTG TAAATAAGCC CAATAGGCAG ACACCTCTAA CAAGGTGACA CTGTCCTCTT TCCTTCCTAC

CACAGCCCCC ACCTACCCAC CCCACTCCCA TTGATTCCAG AGGCGTGCCT AGGCAGGATC TATGAGAAAA

TATAACAGAG AGTAAGAGGA AAATTACCTT CTTTCTTTTT CCTTTCCCTG CCTGACCTTA TTCACCTCCC

ATCCCAGAGC ATCCATTTAT TCCATTGATC TTTACTGACA TCTATTATCT GACCTACACA ATACTAGACA
```

```
TTAGGACAAT GTGGCCTGCC TCCAAGAAAC TCAAATAAGC CAACTGAGAT CAGAGAGGAT TAATCACCTG

CCAATGGGCA CAAAGCAACA AGCTGGGAGC CAAGTCCCAA AATGGGGCCT GCTGCTTCCA GTTCCCCTCT

CTCTGCATTG ATGTCAGCAT TATCCTTCGT CCCAGTCCTG TCTCCACTAC CACTTTCCCC CTCAAACACA

CACACACACA ACAGCCTTAG ATGTTTTCTC CACTGATAAG TAGGTGACTC AATTTGTAAG TATATAATCC

AAGACCTTCT ATTCCCAAGT AGAATTTATG TGCCTGCCTG TGCTTTTCTA CCTGGATCAA GTGATGTCTA

CAGAGTAGGG CAGTAGCTTC ATTCATGAAC TCATTCAACA AGCATTATTC ACTGAGAGCC TTGTATTTTT

CAGGCATAGT GCCAACAGCA GTGTGGACAG TGGTGCATCA AAGCCTCTAG TCTCATAGAA CTTAGTCTTC

TGGAGGATAT GGAAAACAGA CAACCCAAAC AACCAACAAA AGAGCAAGAT GCTGCAAAAA AAAAAAAAT

GAATAGGGTG CTAAGATAGA GAAAAGTGGG AGAGTGCTAT TTAGACAAAG TGGTAAAAAC AAAGCCCCTT

GTGAGATGAG AGCTGCCGAC AGAGGGGCG GGTCATGGTT GTGGGTTTTT GGGTAGGACA TTCAGAGGAG

GGGGCGGGTC GTGGTTGTGG GTTTTTGGGT AGGACATTCA GAGGAGGGGG CGGGTCGTGG TTGTGGGTTT

TTGGGTAGGA CATTCAGAGG AGGGGCGGG TCGTGGTTGT GGGTTTTTGG GTAGGACATT CAGAGGAGGG

GGCGGGTCGT GGTTGTGGGT TTTTGGGACA TTCAGAGGAG TCTGAATGCA CCCAGGCCTA CAACTTCAAG

ATGGTAAAGG ACAGCTCCAA GGATCAGAAG AAGCATTCTT GGAACTGGGG CATTTTGAGA AGGAGGAAAA

ATATGCAGAG ACTAGTGCTT GCAGAGCTTG CATTTGGATT TCATTTGAGG TACAATGAAA ACCCATTAAT

GGGTTTCACA CAGTGCAATG GCCTGACCTC ACTTATATTT CCTAAAATAG AAAACAGATC AGAAGGAAGG

CAATAGAGAA GCAGAAAGTC CAATGAGGAG GTTTCACAGC AGTCATGGGG GTGGGGTAAG GAAAAGAAGT

GGAAAGAAAC AGACAGAATT GGGTTATATT TTGGAGATAG AACCAACAGA AGGAAGAGGA GAAACAACAT

TTACTGAGAA GGGAAAAAGT AGGAGAGGAA TAGGTTTGGG AAATAAATCC TGCTGACATT GGAAACCCCA

AGGAAGCCTC AAAAGTATAT TTACTTGCTT TAGATTTAAA AGAATAGGAA AGAAGCATCT CAACTTGGAA

TTTGAAATCT ATTTTTCCAT AAAAGTATTG TTAAATTCTA CTCATACTCA CAAGAAAAGT ACATTCTAAA

GAGTATATTG AAAGAGTTTA CTGATATACT TAGGAATTTT GTGTGTATGT GTGTGTGTGT ATGTGTGTGT

GTGTGTTTAA CCTTCAATTG TTGACTTAAA TACTGAGATA AATGTCATCT AAATGCTAAA TTGATTTCCC

AAAGGTATGA TTTGTTCACT TGGAGATCAA AATGTTTAGG GGGCTTAGAA TCACTGTAGT GCTCAGATTT

GATGCAAAAT GTCTTAGGCC TATGTTGAAG GCAGGACAGA AACAATGTTT CCCTCCTACC TGCCTGGATA

CAGTAAGATA CTAGTGTCAC TGACAATCTT CATAACTAAT TTAGATCTCT CTCCAATCAA CTAAGGAAAT

CAACTCTTAT TAATAGACTG GGCCACACAT CTACTAGGCA TGTAATAAAT GCTTGCTGAA TGAACAAATG

AATGAAGAGC CTATAGCATC ATGTTACAGC CATAGTCCTA AAGTGGTGTT TCTCATGAAG GCCAAATGCT

AAGGGATTGA GCTTCAGTCC TTTTTCTAAC ATCTTGTTCT CTAACAGAAT TCTCTTCTTT TCTTCATAGG

AGATGCCTGA GATACCCAAA ACCATCACAG GTAGTGAGAC CAACCTCCTC TTCTTCTGGG AAACTCACGG

CACTAAGAAC TATTTCACAT CAGTTGCCCA TCCAAACTTG TTTATTGCCA CAAAGCAAGA CTACTGGGTG

TGCTTGGCAG GGGGGCCACC CTCTATCACT GACTTTCAGA TACTGGAAAA CCAGGCGTAG GTCTGGAGTC

TCACTTGTCT CACTTGTGCA GTGTTGACAG TTCATATGTA CCATGTACAT GAAGAAGCTA ATCCTTTAC

TGTTAGTCAT TTGCTGAGCA TGTACTGAGC CTTGTAATTC TAAATGAATG TTTACACTCT TTGTAAGAGT

GGAACCAACA CTAACATATA ATGTTGTTAT TTAAAGAACA CCCTATATTT TGCATAGTAC CAATCATTTT

AATTATTATT CTTCATAACA ATTTTAGGAG GACCAGAGCT ACTGACTATG GCTACCAAAA AGACTCTACC

CATATTACAG ATGGGCAAAT TAAGGCATAA GAAAACTAAG AAATATGCAC AATAGCAGTT GAAACAAGAA

GCCACAGACC TAGGATTTCA TGATTTCATT TCAACTGTTT GCCTTCTGCT TTTAAGTTGC TGATGAACTC

TTAATCAAAT AGCATAAGTT TCTGGGACCT CAGTTTTATC ATTTTCAAAA TGGAGGGAAT AATACCTAAG
```

```
CCTTCCTGCC GCAACAGTTT TTTATGCTAA TCAGGGAGGT CATTTTGGTA AAATACTTCT CGAAGCCGAG

CCTCAAGATG AAGGCAAAGC ACGAAATGTT ATTTTTTAAT TATTATTTAT ATATGTATTT ATAAATATAT

TTAAGATAAT TATAATATAC TATATTTATG GGAACCCCTT CATCCTCTGA GTGTGACCAG GCATCCTCCA

CAATAGCAGA CAGTGTTTTC TGGGATAAGT AAGTTTGATT TCATTAATAC AGGGCATTTT GGTCCAAGTT

GTGCTTATCC CATAGCCAGG AAACTCTGCA TTCTAGTACT TGGGAGACCT GTAATCATAT AATAAATGTA

CATTAATTAC CTTGAGCCAG TAATTGGTCC GATCTTTGAC TCTTTTGCCA TTAAACTTAC CTGGGCATTC

ATGAGACCAC TGTTATCAAA ACTTTCTTTT CTGGAATGTA ATCAATGTTT CTTCTAGGTT CTAAAAATTG

TGATCAGACC ATAATGTTAC ATTATTATCA ACAATAGTGA TTGATAGAGT GTTATCAGTC ATAACTAAAT

AAAGCTTGCA ACAAAATTCT CTGACACATA GTTATTCATT GCCTTAATCA TTATTTTACT GCATGGTAAT

TAGGGACAAA TGGTAAATGT TTACATAAAT AATTGTATTT AGTGTTACTT TATAAAATCA AACCAAGATT

TTATATTTTT TTCTCCTCTT TGTTAGCTGC CAGTATGCAT AAATGGCATT AAGAATGATA ATATTTCCGG

GTTCACTTAA AGCTCATATT ACACATACAC AAAACATGTG TTCCCATCTT TATACAAACT CACACATACA

GAGCTACATT AAAAACAACT AATAGGCCAG GCACGGTGGC TCAGACCTGT AATCCCAGCA CTTTGGGAGG-3'

(FRAG. NO: _ ) (SEQ. ID NO: 2510)

5'-ACCAACCTCT TCGAGGCACA AGGCACAACA GGCTGCTCTG GGATTCTCTT CAGCCAATCT TCATTGCTCA

AGTGTCTGAA GCAGCCATGG CAGAAGTACC TGAGCTCGCC AGTGAAATGA TGGCTTATTA CAGTGGCAAT

GAGGATGACT TGTTCTTTGA AGCTGATGGC CCTAAACAGA TGAAGTGCTC CTTCCAGGAC CTGGACCTCT

GCCCTCTGGA TGGCGGCATC CAGCTACGAA TCTCCGACCA CCACTACAGC AAGGGCTTCA GGCAGGCCGC

GTCAGTTGTT GTGGCCATGG ACAAGCTGAG GAAGATGCTG GTTCCCTGCC CACAGACCTT CCAGGAGAAT

GACCTGAGCA CCTTCTTTCC CTTCATCTTT GAAGAAGAAC CTATCTTCTT CGACACATGG GATAACGAGG

CTTATGTGCA CGATGCACCT GTACGATCAC TGAACTGCAC GCTCCGGGAC TCACAGCAAA AAAGCTTGGT

GATGTCTGGT CCATATGAAC TGAAAGCTCT CCACCTCCAG GGACAGGATA TGGAGCAACA AGTGGTGTTC

TCCATGTCCT TTGTACAAGG AGAAGAAAGT AATGACAAAA TACCTGTGGC CTTGGGCCTC AAGGAAAAGA

ATCTGTACCT GTCCTGCGTG TTGAAAGATG ATAAGCCCAC TCTACAGCTG GAGAGTGTAG ATCCCAAAAA

TTACCCAAAG AAGAAGATGG AAAAGCGATT TGTCTTCAAC AAGATAGAAA TCAATAACAA GCTGGAATTT

GAGTCTGCCC AGTTCCCCAA CTGGTACATC AGCACCTCTC AAGCAGAAAA CATGCCCGTC TTCCTGGGAG

GGACCAAAGG CGGCCAGGAT ATAACTGACT TCACCATGCA ATTTGTGTCT TCCTAAAGAG AGCTGTACCC

AGAGAGTCCT GTGCTGAATG TGGACTCAAT CCCTAGGGCT GGCAGAAAGG GAACAGAAAG GTTTTTGAGT

ACGGCTATAG CCTGGACTTT CCTGTTGTCT ACACCAATGC CCAACTGCCT GCCTTAGGGT AGTGCTAAGA

GGATCTCCTG TCCATCAGCC AGGACAGTCA GCTCTCTCCT TTCAGGGCCA ATCCCCAGCC CTTTTGTTGA

GCCAGGCCTC TCTCACCTCT CCTACTCACT TAAAGCCCGC CTGACAGAAA CCACGGCCAC ATTTGGTTCT

AAGAAACCCT CTGTCATTCG CTCCCACATT CTGATGAGCA ACCGCTTCCC TATTTATTTA TTTATTTGTT

TGTTTGTTTT ATTCATTGGT CTAATTTATT CAAAGGGGC AAGAAGTAGC AGTGTCTGTA AAAGAGCCTA

GTTTTTAATA GCTATGGAAT CAATTCAATT TGGACTGGTG TGCTCTCTTT AAATCAAGTC CTTTAATTAA

GACTGAAAAT ATATAAGCTC AGATTATTTA AATGGGAATA TTTATAAATG AGCAAATATC ATACTGTTCA

ATGGTTCTGA AATAAACTTC TCTGAAG-3' (FRAG. NO: _ ) (SEQ. ID NO: 2511)

5'-AGAAAGAAAG AGAGAGAGAA AGAAAAGAAA GAGGAAGGAA GGAAGGAAGG AAGAAAGACA GGCTCTGAGG

AAGGTGGCAG TTCCTACAAC GGGAGAACCA GTGGTTAATT TGCAAAGTGG ATCCTGTGGA GGCANNCAGA

GGAGTCCCCT AGGCCACCCA GACAGGGCTT TTAGCTATCT GCAGGCCAGA CACCAAATTT CAGGAGGGCT

CAGTGTTAGG AATGGATTAT GGCTTATCAA ATTCACAGGA AACTAACATG TTGAACAGCT TTTAGATTTC
```

```
CTGTGGAAAA TATAACTTAC TAAAGATGGA GTTCTTGTGA CTGACTCCTG ATATCAAGAT ACTGGGAGCC

AAATTAAAAA TCAGAAGGCT GCTTGGAGAG CAAGTCCATG AAATGCTCTT TTTCCCACAG TAGAACCTAT

TTCCCTCGTG TCTCAAATAC TTGCACAGAG GCTCACTCCC TTGGATAATG CAGAGCGAGC ACGATACCTG

GCACATACTA ATTTGAATAA AATGCTGTCA AATTCCCATT CACCCATTCA AGCAGCAAAC TCTATCTCAC

CTGAATGTAC ATGCCAGGCA CTGTGCTAGA CTTGGCTCAA AAAGATTTCA GTTTCCTGGA GGAACCAGGA

GGGCAAGGTT TCAACTCAGT GCTATAAGAA GTGTTACAGG CTGGACACGG TGGCTCACGC CTGTAATCCC

AACATTTGGG AGGCCGAGGC GGGCAGATCA CAAGGTCAGG AGATCGAGAC CATCCTGGCT AACATGGTGA

AACCCTGTCT CTACTAAAAA TACAAAAAAT TAGCCGGGCG TTGGCGGCAG GTGCCTGTAG TCCCAGCTGC

TGGGAGGCT GAGGCAGGAG AATGGTGTGA ACCCGGGAGG CGGAACTTGC AGGGGGCCGA GATCGTGCCA

CTGCACTCCA GCCTGGGCGA CAGAGTGAGA CTCTGTCTCA AAAAAAAAAA AAAAGTGTTA TGATGCAGAC

CTGTCAAAGA GGCAAAGGAG GGTGTTCCTA CACTCCAGGC ACTGTTCATA ACCTGGACTC TCATTCATTC

TACAAATGGA GGGCTCCCCT GGGCAGATCC CTGGAGCAGG CACTTTGCTG GTGTCTCGGT TAAAGAGAAA

CTGATAACTC TTGGTATTAC CAAGAGATAG AGTCTCAGAT GGATATTCTT ACAGAAACAA TATTCCCACT

TTTCAGAGTT CACCAAAAAA TCATTTTAGG CAGAGCTCAT CTGGCATTGA TCTGGTTCAT CCATGAGATT

GGCTAGGGTA ACAGCACCTG GTCTTGCAGG GTTGTGTGAG CTTATCTCCA GGGTTGCCCC AACTCCGTCA

GGAGCCTGAA CCCTGCATAC CGTATGTTCT CTGCCCCAGC CAAGAAAGGT CAATTTTCTC CTCAGAGGCT

CCTGCAATTG ACAGAGAGCT CCCGAGGCAG AGAACAGCAC CCAAGGTAGA GACCCACACC CTCAATACAG

ACAGGGAGGG CTATTGGCCC TTCATTGTAC CCATTTATCC ATCTGTAAGT GGGAAGATTC CTAAACTTAA

GTACAAAGAA GTGAATGAAG AAAAGTATGT GCATGTATAA ATCTGTGTGT CTTCCACTTT GTCCCACATA

TACTAAATTT AAACATTCTT CTAACGTGGG AAAATCCAGT ATTTTAATGT GGACATCAAC TGCACAACGA

TTGTCAGGAA AACAATGCAT ATTTGCATGG TGATACATTT GCAAAATGTG TCATAGTTTG CTACTCCTTG

CCCTTCCATG AACCAGAGAA TTATCTCAGT TTATTAGTCC CCTCCCCTAA GAAGCTTCCA CCAATACTCT

TTTCCCCTTT CCTTTAACTT GATTGTGAAA TCAGGTATTC AACAGAGAAA TTTCTCAGCC TCCTACTTCT

GCTTTTGAAA GCTATAAAAA CAGCGAGGGA GAAACTGGCA GATACCAAAC CTCTTCGAGG CACAAGGCAC

AACAGGCTGC TCTGGGATTC TCTTCAGCCA ATCTTCATTG CTCAAGTATG ACTTTAATCT TCCTTACAAC

TAGGTGCTAA GGGAGTCTCT CTGTCTCTCT GCCTCTTTGT GTGTATGCAT ATTCTCTCTC TCTCTCTCTT

TCTTTCTCTG TCTCTCCTCT CCTTCCTCTC TGCCTCCTCT CTCAGCTTTT TGCAAAAATG CCAGGTGTAA

TATAATGCTT ATGACTCGGG AAATATTCTG GGAATGGATA CTGCTTATCT AACAGCTGAC ACCCTAAAGG

TTAGTGTCAA AGCCTCTGCT CCAGCTCTCC TAGCCAATAC ATTGCTAGTT GGGGTTTGGT TTAGCAAATG

CTTTTCTCTA GACCCAAAGG ACTTCTCTTT CACACATTCA TTCATTTACT CAGAGATCAT TTCTTTGCAT

GACTGCCATG CACTGGATGC TGAGAGAAAT CACACATGAA CGTAGCCGTC ATGGGAAGT CACTCATTTT

CTCCTTTTTA CACAGGTGTC TGAAGCAGCC ATGGCAGAAG TACCTGAGCT CGCCAGTGAA ATGATGGCTT

ATTACAGGTC AGTGGAGACG CTGAGACCAG TAACATGAGC AGGTCTCCTC TTTCAAGAGT AGAGTGTTAT

CTGTGCTTGG AGACCAGATT TTTCCCCTAA ATTGCCTCTT TCAGTGGCAA ACAGGGTGCC AAGTAAATCT

GATTTAAAGA CTACTTTCCC ATTACAAGTC CCTCCAGCCT TGGGACCTGG AGGCTATCCA GATGTGTTGT

TGCAAGGGCT TCCTGCAGAG GCAAATGGGG AGAAAAGATT CCAAGCCCAC AATACAAGGA ATCCCTTTGC

AAAGTGTGGC TTGGAGGGAG AGGGAGAGCT CAGATTTTAG CTGACTCTGC TGGGCTAGAG GTTAGGCCTC

AAGATCCAAC AGGGAGCACC AGGGTGCCCA CCTGCCAGGC CTAGAATCTG CCTTCTGGAC TGTTCTGCGC

ATATCACTGT GAAACTTGCC AGGTGTTTCA GGCAGCTTTG AGAGGCAGGC TGTTTGCAGT TTCTTATGAA
```

-continued

```
CAGTCAAGTC TTGTACACAG GGAAGGAAAA ATAAACCTGT TTAGAAGACA TAATTGAGAC ATGTCCCTGT
TTTTATTACA GTGGCAATGA GGATGACTTG TTCTTTGAAG CTGATGGCCC TAAACAGATG AAGGTAAGAC
TATGGGTTTA ACTCCCAACC CAAGGAAGGG CTCTAACACA GGGAAAGCTC AAAGAAGGGA GTTCTGGGCC
ACTTTGATGC CATGGTATTT TGTTTTAGAA AGACTTTAAC CTCTTCCAGT GAGACACAGG CTGCACCACT
TGCTGACCTG GCCACTTGGT CATCATATCA CCACAGTCAC TCACTAACGT TGGTGGTGGT GGCCACACTT
GGTGGTGACA GGGGAGGAGT AGTGATAATG TTCCCATTTC ATAGTAGGAA GACAACCAAG TCTTCAACAT
AAATTTGATT ATCCTTTTAA GAGATGGATT CAGCCTATGC CAATCACTTG AGTTAAACTC TGAAACCAAG
AGATGATCTT GAGAACTAAC ATATGTCTAC CCCTTTTGAG TAGAATAGTT TTTTGCTACC TGGGGTGAAG
CTTATAACAA CAAGACATAG ATGATATAAA CAAAAGATG AATTGAGACT TGAAAGAAAA CCATTCACTT
GCTGTTTGAC CTTGACAAGT CATTTTACCC GCTTTGGACC TCATCTGAAA AATAAAGGGC TGAGCTGGAT
GATCTCTGAG ATTCCAGCAT CCTGCAACCT CCAGTTCTGA AATATTTTCA GTTGTAGCTA AGGGCATTTG
GGCAGCAAAT GGTCATTTTT CAGACTCATC CTTACAAAGA GCCATGTTAT ATTCCTGCTG TCCCTTCTGT
TTTATATGAT GCTCAGTAGC CTTCCTAGGT GCCCAGCCAT CAGCCTAGCT AGGTCAGTTG TGCAGGTTGG
AGGCAGCCAC TTTTCTCTGG CTTTATTTTA TTCCAGTTTG TGATAGCCTC CCCTAGCCTC ATAATCCAGT
CCTCAATCTT GTTAAAAACA TATTTCTTTA GAAGTTTTAA GACTGGCATA ACTTCTTGGC TGCAGCTGTG
GGAGGAGCCC ATTGGCTTGT CTGCCTGGCC TTTGCCCCCC ATTGCCTCTT CCAGCAGCTT GGCTCTGCTC
CAGGCAGGAA ATTCTCTCCT GCTCAACTTT CTTTTGTGCA CTTACAGGTC TCTTTAACTG TCTTTCAAGC
CTTTGAACCA TTATCAGCCT TAAGGCAACC TCAGTGAAGC CTTAATACGG AGCTTCTCTG AATAAGAGGA
AAGTGGTAAC ATTTCACAAA AAGTACTCTC ACAGGATTTG CAGAATGCCT ATGAGACAGT GTTATGAAAA
AGGAAAAAAA AGAACAGTGT AGAAAAATTG AATACTTGCT GAGTGAGCAT AGGTGAATGG AAAATGTTAT
GGTCATCTGC ATGAAAAAGC AAATCATAGT GTGACAGCAT TAGGGATACA AAAGATATA GAGAAGGTAT
ACATGTATGG TGTAGGTGGG GCATGTACAA AAAGATGACA AGTAGAATCG GGATTTATTC TAAAGAATAG
CCTGTAAGGT GTCCAGAAGC CACATTCTAG TCTTGAGTCT GCCTCTACCT GCTGTGTGCC CTTGAGTACA
CCCTTAACCT CCTTGAGCTT CAGAGAGGGA TAATCTTTTT ATTTTATTTT ATTTTATTTT GTTTTGTTTT
GTTTTGTTTT GTTTTATGAG ACAGAGTCTC ACTCTGTTGC CCAGGCTGGA GTGCAGTGGT ACAATCTTGG
CTTACTGCAT CCTCCACCTC CTGAGTTCAA GCGATTCTCC TTCCTCAGTC TCCTGAATAG CTAGGATTAC
AGGTGCACCC CACCACACCC AGCTAATTTT TGTATTTTTA GTAGAGAAGG GGTTTCGCCA TGTTGGCCAG
GCTGGTTTTG AAGTCCTGAC CTAAATGATT CATCCACCTC GGCTTCCCAA AGTGCTGGGA TTACAGGCAT
GAGCCACCAC GCCTGGCCCA GAGAGGGATG ATCTTTAGAA GCTCGGGATT CTTTCAAGCC CTTTCCTCCT
CTCTGAGCTT TCTACTCTCT GATGTCAAAG CATGGTTCCT GGCAGGACCA CCTCACCAGG CTCCCTCCCT
CGCTCTCTCC GCAGTGCTCC TTCCAGGACC TGGACCTCTG CCCTCTGGAT GGCGGCATCC AGCTACGAAT
CTCCGACCAC CACTACAGCA AGGGCTTCAG GCAGGCCGCG TCAGTTGTTG TGGCCATGGA CAAGCTGAGG
AAGATGCTGG TTCCCTGCCC ACAGACCTTC AGGAGAATG ACCTGAGCAC CTTCTTTCCC TTCATCTTTG
AAGAAGGTAG TTAGCCAAGA GCAGGCAGTA GATCTCCACT TGTGTCCTCT TGGAAGTCAT CAAGCCCCAG
CCAACTCAAT TCCCCCAGAG CCAAAGCCCT TTAAAGGTAG AAGGCCCAGC GGGGAGACAA AACAAAGAAG
GCTGGAAACC AAAGCAATCA TCTCTTTAGT GGAAACTATT CTTAAAGAAG ATCTTGATGG CTACTGACAT
TTGCAACTCC CTCACTCTTT CTCAGGGGCC TTTCACTTAC ATTGTCACCA GAGGTTCGTA ACCTCCCTGT
GGGCTAGTGT TATGACCATC ACCATTTTAC CTAAGTAGCT CTGTTGCTCG GCCACAGTGA GCAGTAATAG
ACCTGAAGCT GGAACCCATG TCTAATAGTG TCAGGTCCAG TGTTCTTAGC CACCCCACTC CCAGCTTCAT
CCCTACTGGT GTTGTCATCA GACTTTGACC GTATATGCTC AGGTGTCCTC CAAGAAATCA AATTTTGCCA
```

```
CCTCGCCTCA CGAGGCCTGC CCTTCTGATT TTATACCTAA ACAACATGTG CTCCACATTT CAGAACCTAT
CTTCTTCGAC ACATGGGATA ACGAGGCTTA TGTGCACGAT GCACCTGTAC GATCACTGAA CTGCACGCTC
CGGGACTCAC AGCAAAAAAG CTTGGTGATG TCTGGTCCAT ATGAACTGAA AGCTCTCCAC CTCCAGGGAC
AGGATATGGA GCAACAAGGT AAATGGAAAC ATCCTGGTTT CCCTGCCTGG CCTCCTGGCA GCTTGCTAAT
TCTCCATGTT TTAAACAAAG TAGAAAGTTA ATTTAAGGCA AATGATCAAC ACAAGTGAAA AAAATATTA
AAAAGGAATA TACAAACTTT GGTCCTAGAA ATGGCACATT TGATTGCACT GGCCAGTGCA TTTGTTAACA
GGAGTGTGAC CCTGAGAAAT TAGACGGCTC AAGCACTCCC AGGACCATGT CCACCCAAGT CTCTTGGGCA
TAGTGCAGTG TCAATTCTTC CACAATATGG GGTCATTTGA TGGACATGGC CTAACTGCCT GTGGGTTCTC
TCTTCCTGTT GTTGAGGCTG AAACAAGAGT GCTGGAGCGA TAATGTGTCC ATCCCCCTCC CCAGTCTTCC
CCCCTTGCCC CAACATCCGT CCCACCCAAT GCCAGGTGGT TCCTTGTAGG GAAATTTTAC CGCCCAGCAG
GAACTTATAT CTCTCCGCTG TAACGGGCAA AAGTTTCAAG TGCGGTGAAC CCATCATTAG CTGTGGTGAT
CTGCCTGGCA TCGTGCCACA GTAGCCAAAG CCTCTGCACA GGAGTGTGGG CAACTAAGGC TGCTGACTTT
GAAGGACAGC CTCACTCAGG GGGAAGCTAT TTGCTCTCAG CCAGGCCAAG AAAATCCTGT TTCTTTGGAA
TCGGGTAGTA AGAGTGATCC CAGGGCCTCC AATTGACACT GCTGTGACTG AGGAAGATCA AAATGAGTGT
CTCTCTTTGG AGCCACTTTC CCAGCTCAGC CTCTCCTCTC CCAGTTTCTT CCCATGGGCT ACTCTCTGTT
CCTGAAACAG TTCTGGTGCC TGATTTCTGG CAGAAGTACA GCTTCACCTC TTTCCTTTCC TTCCACATTG
ATCAAGTTGT TCCGCTCCTG TGGATGGGCA CATTGCCAGC CAGTGACACA ATGGCTTCCT TCCTTCCTTC
CTTCAGCATT TAAAATGTAG ACCCTCTTTC ATTCTCCGTT CCTACTGCTA TGAGGCTCTG AGAAACCCTC
AGGCCTTTGA GGGGAAACCC TAAATCAACA AAATGACCCT GCTATTGTCT GTGAGAAGTC AAGTTATCCT
GTGTCTTAGG CCAAGGAACC TCACTGTGGG TTCCCACAGA GGCTACCAAT TACATGTATC CTACTCTCGG
GGCTAGGGGT TGGGGTGACC CTGCATGCTG TGTCCCTAAC CACAAGACCC CCTTCTTTCT TCAGTGGTGT
TCTCCATGTC CTTTGTACAA GGAGAAGAAA GTAATGACAA ATACCTGTG GCCTTGGGCC TCAAGGAAAA
GAATCTGTAC CTGTCCTGCG TGTTGAAAGA TGATAAGCCC ACTCTACAGC TGGAGGTAAG TGAATGCTAT
GGAATGAAGC CCTTCTCAGC CTCCTGCTAC CACTTATTCC CAGACAATTC ACCTTCTCCC CGCCCCCATC
CCTAGGAAAA GCTGGGAACA GGTCTATTTG ACAAGTTTTG CATTAATGTA AATAAATTTA ACATAATTTT
TAACTGCGTG CAACCTTCAA TCCTGCTGCA GAAAATTAAA TCATTTTGCC GATGTTATTA TGTCCTACCA
TAGTTACAAC CCCAACAGAT TATATATTGT TAGGGCTGCT CTCATTTGAT AGACACCTTG GGAAATAGAT
GACTTAAAGG GTCCCATTAT CACGTCCACT CCACTCCCAA AATCACCACC ACTATCACCT CCAGCTTTCT
CAGCAAAAGC TTCATTTCCA AGTTGATGTC ATTCTAGGAC CATAAGGAAA AATACAATAA AAAGCCCCTG
GAAACTAGGT ACTTCAAGAA GCTCTAGCTT AATTTTCACC CCCCCAAAAA AAAAAAATTC TCACCTACAT
TATGCTCCTC AGCATTTGGC ACTAAGTTTT AGAAAGAAG AAGGGCTCTT TTAATAATCA CACAGAAAGT
TGGGGGCCCA GTTACAACTC AGGAGTCTGG CTCCTGATCA TGTGACCTGC TCGTCAGTTT CCTTTCTGGC
CAACCCAAAG AACATCTTTC CCATAGGCAT CTTTGTCCCT TGCCCACAA AAATTCTTCT TTCTCTTTCG
CTGCAGAGTG TAGATCCCAA AAATTACCCA AGAAGAAGA TGGAAAAGCG ATTTGTCTTC AACAAGATAG
AAATCAATAA CAAGCTGGAA TTTGAGTCTG CCCAGTTCCC CAACTGGTAC ATCAGCACCT CTCAAGCAGA
AAACATGCCC GTCTTCCTGG GAGGGACCAA AGGCGGCCAG GATATAACTG ACTTCACCAT GCAATTTGTG
TCTTCCTAAA GAGAGCTGTA CCCAGAGAGT CCTGTGCTGA ATGTGGACTC AATCCCTAGG GCTGGCAGAA
AGGAACAGA AAGGTTTTTG AGTACGGCTA TAGCCTGGAC TTTCCTGTTG TCTACACCAA TGCCCAACTG
CCTGCCTTAG GGTAGTGCTA AGAGGATCTC CTGTCCATCA GCCAGGACAG TCAGCTCTCT CCTTTCAGGG
```

CCAATCCCCA GCCCTTTTGT TGAGCCAGGC CTCTCTCACC TCTCCTACTC ACTTAAAGCC CGCCTGACAG

AAACCACGGC CACATTTGGT TCTAAGAAAC CCTCTGTCAT TCGCTCCCAC ATTCTGATGA GCAACCGCTT

CCCTATTTAT TTATTTATTT GTTTGTTTGT TTTGATTCAT TGGTCTAATT TATTCAAAGG GGGCAAGAAG

TAGCAGTGTC TGTAAAAGAG CCTAGTTTTT AATAGCTATG GAATCAATTC AATTTGGACT GGTGTGCTCT

CTTTAAATCA AGTCCTTTAA TTAAGACTGA AAATATATAA GCTCAGATTA TTTAAATGGG AATATTTATA

AATGAGCAAA TATCATACTG TTCAATGGTT CTGAAATAAA CTTCACTGAA GAAAAAAAAA AAAGGGTCTC

TCCTGATCAT TGACTGTCTG GATTGACACT GACAGTAAGC AAACAGGCTG TGAGAGTTCT TGGGACTAAG

CCCACTCCTC ATTGCTGAGT GCTGCAAGTA CCTAGAAATA TCCTTGGCCA CCGAAGACTA TCCTCCTCAC

CCATCCCCTT TATTTCGTTG TTCAACAGAA GGATATTCAG TGCACATCTG AACAGGATC AGCTGAAGCA

CTGCAGGGAG TCAGGACTGG TAGTAACAGC TACCATGATT TATCTATCAA TGCACCAAAC ATCTGTTGAG

CAAGCGCTAT GTACTAGGAG CTGGGAGTAC AGAGATGAGA ACAGTCACAA GTCCCTCCTC AGATAGGAGA

GGCAGCTAGT TATAAGCAGA ACAAGGTAAC ATGACAAGTA GAGTAAGATA GAAGAACGAA GAGGAGTAGC

CAGGAAGGAG GGAGGAGAAC GACATAAGAA TCAAGCCTAA AGGGATAAAC AGAAGATTTC CACACATGGG

CTGGGCCAAT TGGGTGTCGG TTACGCCTGT AATCCCAGCA CTTTGGGTGG CAGGGGCAGA AGATCGCTT

GAGCCCAGGA GTTCAAGACC AGCCTGGGCA ACATAGTGAG ACTCCCATCT CTACAAAAAA TAAATAAATA

AATAAAACAA TCAGCCAGGC ATGCTGGCAT GCACCTGTAG TCCTAGCTAC TTGGGAAGCT GACACTGGAG

GATTGCTTGA GCCCAGAAGT TCAAGACTGC AGTGAGCTTA TCCGTTGACC TGCAGGTCGA C-3' (FRAG.

NO: _ ) (SEQ. ID NO: 2512)

5'-ACAAACCTTT TCGAGGCAAA AGGCAAAAAA GGCTGCTCTG GGATTCTCTT CAGCCAATCT TCAATGCTCA

AGTGTCTGAA GCAGCCATGG CAGAAGTACC TAAGCTCGCC AGTGAAATGA TGGCTTATTA CAGTGGCAAT

GAGGATGACT TGTTCTTTGA AGCTGATGGC CCTAAACAGA TGAAGTGCTC CTTCCAGGAC CTGGACCTCT

GCCCTCTGGA TGGCGGCATC CAGCTACGAA CTCTCCGACCA CCACTACAGC AAGGGCTTCA GGCAGGCCGC

GTCAGTTGTT GTGGCCATGG ACAAGCTGAG GAAGATGCTG GTTCCCTGCC ACAGACCTT CCAGGAGAAT

GACCTGAGCA CCTTCTTTCC CTTCATCTTT GAAGAAGAAC CTATCTTCTT CGACACATGG GATAACGAGG

CTTATGTGCA CGATGCACCT GTACGATCAC TGAACTGCAC GCTCCGGGAC TCACAGCAAA AAAGCTTGGT

GATGTCTGGT CCATATGAAC TGAAAGCTCT CCACCTCCAG GGACAGGATA TGGAGCAACA AGTGGTGTTC

TCCATGTCCT TTGTACAAGG AGAAGAAAGT AATGACAAAA TACCTGTGGC CTTGGGCCTC AAGGAAAAGA

ATCTGTACCT GTCCTGCGTG TTGAAAGATG ATAAGCCCAC TCTACAGCTG GAGAGTGTAG ATCCCAAAAA

TTACCCAAAG AAGAAGATGG AAAAGCGATT TGTCTTCAAC AAGATAGAAA TCAATAACAA GCTGGAATTT

GAGTCTGCCC AGTTCCCCAA CTGGTACATC AGCACCTCTC AAGCAGAAAA CATGCCCGTC TTCCTGGGAG

GGACCAAAGG CGGCCAGGAT ATAACTGACT TCACCATGCA ATTTGTGTCT TCCTAAAGAG AGCTGTACCC

AGAGAGTCCT GTGCTGAATG TGGACTCAAT CCCTAGGGCT GGCAGAAAGG GAACAGAAAG GTTTTTGAGT

ACGGCTATAG CCTGGACTTT CCTGTTGTCT ACACCAATGC CCAACTGCCT GCCTTAGGGT AGTGCTAAGA

GGATCTCCTG TCCATCAGCC AGGACAGTCA GCTCTCTCCT TTCAGGGCCA ATCCCAGCCC TTTTGTTGAG

CCAGGCCTCT CTCACCTCTC CTACTCACTT AAAGCCCGCC TGACAGAAAC CAGGCCACAT TTTGGTTCTA

AGAAACCCTC CTCTGTCATT CGCTCCCACA TTCTGATGAG CAACCGCTTC CCTATTTATT TATTTATTTG

TTTGTTTGTT TTGATTCATT GGTCTAATTT ATTCAAAGGG GGCAAGAAGT AGCAGTGTCT GTAAAAGAGC

CTAGTTTTTA ATAGCTATGG AATCAATTCA ATTTGGACTG GTGTGCTCTC TTTAAATCAA GTCCTTTAAT

TAAGACTGAA AATATATAAG CTCAGATTAT TTAAATGGGA ATATTTATAA ATGAGCAAAT ATCATACTGT

TCAATGGTTC TCAAATAAAC TTCACT-3' (FRAG. NO: _ ) (SEQ. ID NO: 2513)

-continued

5'-CTGGCAGGAG TAGCAGCTGC CCCTTGGCGC GACTGCTGGA GCCGCGAACT AGAGAAACAC AGACACGCCT
CATAGAGCAA CGGCGTCTCT CGGAGCGTGG AGCCCGCCAA GCTCGAGCTG AGCTTTCGCT TGCCGTCCAC
CACTGCCCAC ACTGTCGTTT GCTGCCATCG CAGACCTGCT GCTGACTTCC ATCCCTCTGG ATCCGGCAAG
GGCCTGCGAT TTTGACAATG TCAAGATTTA CCGTATATCC CTGTTTGTTT GGATACACCA GTGACGTCCA
CTTCTAGAAG ACAAAGTTAT ATTACTTAAA CAACCAAAGA TATGAAACTA TCCATGAAGA ACAATATTAT
CAATACACAG CAGTCTTTTG TAACCATGCC CAATGTGATT GTACCAGATA TTGAAAAGGA AATACGAAGG
ATGGAAAATG GAGCATGCAG CTCCTTTTCT GAGGATGATG ACAGTGCCTC TACATCTGAA GAATCAGAGA
ATGAAAACCC TCATGCAAGG GGTTCCTTTA GTTATAAGTC ACTCAGAAAG GGAGGACCAT CACAGAGGGA
GCAGTACCTG CCTGGTGCCA TTGCCATTTT TAATGTGAAC AACAGCGACA ATAAGGACCA GGAACCAGAA
GAAAAAAGA AAAAGAAAAA AGAAAGAAG AGCAAGTCAG ATGATAAAAA CGAAAATAAA AACGACCCAA
AGAAGAAGAT GGAAAAGCGA-3' (FRAG. NO: _ ) (SEQ. ID NO: 2514)

5'-ATGGCCAAAG TTCCAGACAT GTTTGAAGAC CTGAAGAACT GTTACAGTGA AAATGAAGAA GACAGTTCCT
CCATTGATCA TCTGTCTCTG AATCAGAAAT CCTTCTATCA TGTAAGCTAT GGCCACTCC ATGAAGGCTG
CATGGATCAA TCTGTGTCTC TGAGTATCTC TGAAACCTCT AAAACATCCA AGCTTACCTT CAAGGAGAGC
ATGGTGGTAG TAGCAACCAA CGGGAAGGTT CTGAAGAAGA GACGGTTGAG TTTAAGCCAA TCCATCACTG
ATGATGACCT GGAGGCCATC GCCAATGACT CAGAGGAAGA AATCATCAAG CCTAGGTCAG CACCTTTTAG
CTTCCTGAGC AATGTGAAAT ACAACTTTAT GAGGATCATC AAATACGAAT TCATCCTGAA TGACGCCCTC
AATCAAAGTA TAATTCGAGC CAATGATCAG TACCTCACGG CTGCTGCATT ACATAATCTG GATGAAGCAG
TGAAATTTGA CATGGGTGCT TATAAGTCAT CAAAGGATGA TGCTAAAATT ACCGTGATTC TAAGAATCTC
AAAAACTCAA TTGTATGTGA CTGCCCAAGA TGAAGACCAA CCAGTGCTGC TGAAGGAGAT GCCTGAGATA
CCCAAAACCA TCACAGGTAG TGAGACCAAC CTCCTCTTCT TCTGGGAAAC TCACGGCACT AACAACTATT
TCACATCAGT TGCCCATCCA AACTTGTTTA TTGCCACAAA GCAAGACTAC TGGGTGTGCT TGGCAGGGGG
GCCACCCTCT ATCACTGACT TTCAGATACT GGAAAACCAG GCGTAGGTCT GGAGTCTCAC TTGTCTCACT
TGTGCAGTGT TGACAGTTCA TATGTACCAT GTACATGAAG AAGCTAAATC CTTTACTGTT AGTCATTTGC
TGAGCATGTA CTGAGCCTTG TAATTCTAAA TGAATGTTTA CACTCTTTGT AAGAGTGGAA CCAACACTAA
CATATAATGT TGTTATTTAA AGAACACCCT ATATTTTGCA TAGTACCAAT CATTTTAATT ATTATTCTTC
ATAACAATTT TAGGAGGACC AGAGCTACTG ACTATGGCTA CCAAAAAGAC TCTACCCATA TTACAGATGG
GCAAATTAAG GCATAAGAAA ACTAAGAAAT ATGCACAATA GCAGTTGAAA CAAGAAGCCA CAGACCTAGG
ATTTCATGAT TTCATTTCAA CTGTTTGCCT TCTGCTTTTA AGTTGCTGAT GAACTCTTAA TCAAATAGCA
TAAGTTTCTG GGACCTCAGT TTTATCATTT TCAAAATGGA GGGAATAATA CCTAAGCCTT CCTGCCGCAA
CAGTTTTTTA TGCTAATCAG GGAGGTCATT TTGGTAAAAT ACTTCTCGAA GCCGAGCCTC AAGATGAAGG
CAAAGCACGA AATGTTATTT TTAATTATT ATTTATATAT GTATTATAA ATATATTTAA GATAATTATA
ATATACTATA TTTATGGGAA CCCCTTCATC CTCTGAGTGT GACCAGGCAT CCTCCACAAT AGCAGACAGT
GTTTTCTGGG ATAAGTAAGT TTGATTTCAT TAATACAGGG CATTTGGTC CAAGTTGTGC TTATCCCATA
GCCAGGAAAC TCTGCATTCT AGTACTTGGG AGACCTGTAA TCATATAATA AATGTACATT AATTACCTTG
AGCCAGTAAT TGGTCCGATC TTTGACTCTT TTGCCATTAA ACTTACCTGG GCATTCTTGT TCATTCAAT
TCCACCTGCA ATCAAGTCCT ACAAGCTAAA ATTAGATGAA CTCAACTTTG ACAACCATAG ACCACTGTTA
TCAAAACTTT CTTTTCTGGA ATGTAATCAA TGTTTCTTCT AGGTTCTAAA AATTGTGATC AGACCATAAT
GTTACATTAT TATCAACAAT AGTGATTGAT AGAGTGTTAT CAGTCATAAC TAAATAAAGC TTGCAAGTGA

-continued

GGGAGTCATT TCATTGGCGT TTGAGTCAGC AAAGAAGTCA AG-3' (FRAG. NO: _ ) (SEQ. ID NO: 2515)

5'-AGCTGCCAGC CAGAGAGGGA GTCATTTCAT TGGCGTTTGA GTCAGCAAAG AAGTCAAGAT GGCCAAAGTT
CCAGACATGT TTGAAGACCT GAAGAACTGT TACAGTGAAA ATGAAGAAGA CAGTTCCTCC ATTGATCATC
TGTCTCTGAA TCAGAAATCC TTCTATCATG TAAGCTATGG CCCACTCCAT GAAGGCTGCA TGGATCAATC
TGTGTCTCTG AGTATCTCTG AAACCTCTAA AACATCCAAG CTTACCTTCA GGAGAGCAT GGTGGTAGTA
GCAACCAACG GGAAGGTTCT GAAGAAGAGA CGGTTGAGTT TAAGCCAATC CATCACTGAT GATGACCTGG
AGGCCATCGC CAATGACTCA GAGGAAGAAA TCATCAAGCC TAGGTCATCA CCTTTTAGCT TCCTGAGCAA
TGTGAAATAC AACTTTATGA GGATCATCAA ATACGAATTC ATCCTGAATG ACGCCCTCAA TCAAAGTATA
ATTCGAGCCA ATGATCAGTA CCTCACGGCT GCTGCATTAC ATAATCTGGA TGAAGCAGTG AAATTTGACA
TGGGTGCTTA TAACTCATCA AAGGATGATG CTAAAATTAC CGTGATTCTA AGAATCTCAA AAACTCAATT
GTATGTGACT GCCCAAGATG AAGACCAACC AGTGCTGCTG AAGGAGATGC CTGAGATACC AAAACCATC
ACAGGTAGTG AGACCAACCT CCTCTTCTTC TGGGAAACTC ACGGCACTAA GAACTATTTC ACATCAGTTG
CCCATCCAAA CTTCTTTATT GCCACAAAGC AAGACTACTG GGTGTGCTTG GCAGGGGGC CACCCTCTAT
CACTGACTTT CAGATACTGG AAAACCAGGC GTAGGTCTGG AGTCTCACTT GTCTCACTTG TGCAGTGTTG
ACAGTTCATA TGTACCATGT ACATGAAGAA GCTAAATCCT TTACTGTTAG TCATTTGCTG AGCATGTACT
GAGCCTTGTA ATTCTAAATG AATGTTTACA CTCTTTGTAA GAGTGGAACC AACACTAACA TATAATGTT
TTATTTAAAG AACACCCTAT ATTTTGCATA GTACCAATCA TTTTAATTAT TATTCTTCAT AACAATTTTA
GGAGGACCAG AGCCACTGAC TATGGCTACC AAAAAGACTC TACCCATATT ACAGATGGGC AAATTAAGGC
ATAAGAAAAC TAAGAAATAT GCACAATAGC AGTCGAAACA AGAAGCCACA GACCTAGGAT TTCATGATTT
CATTTCAACT GTTTGCCTTC TGCTTTTAAG TTGCTGATGA ACTCTTAATC AAATAGCATA AGTTTCTGGG
ACCTCAGTTT TATCATTTTC AAAATGGAGG GAATAATACC TAAGCCTTCC TGCCGCAACA GTTTTTTATG
CTAATCAGGG AGGTCATTTT GGTAAAATAC TTCTCGAAGC CGAGCCTCAA GATGAAGGCA AGCACGAAA
TGTTATTTTT TAATTATTAT TTATATATGT ATTTATAAAT ATATTTAAGA TAATTATAAT ATACTATATT
TATGGGAACC CCTTCATCCT CTGAGTGTGA CCAGGCATCC TCCACAATAG CAGACAGTGT TTTCTGGGAT
AAGTAAGTTT GATTTCATTA ATACAGGGCA TTTTGGTCCA AGTTGTGCTT ATCCCATAGC CAGGAAACTC
TGCATTCTAG TACTTGGGAG ACCTGTAATC ATATAATAAA TGTACATTAA TTACCTTGAG CCAGTAATTG
GTCCGATCTT TGACTCTTTT GCCATTAAAC TTACCTGGGC ATTCTTGTTT CATTCAATTC CACCTGCAAT
CAAGTCCTAC AAGCTAAAAT TAGATGAACT CAACTTTGAC AACCATGAGA CCACTGTTAT CAAAACTTTC
TTTTCTGGAA TGTAATCAAT GTTTCTTCTA GGTTCTAAAA ATTGTGATCA GACCATAATG TTACATTATT
ATCAACAATA GTGACTGATA GAGTGTTATC AGTCATAACT AAATAAAGCT TGCAACAAAA TTCTCTG-3' (FRAG.
NO: _ ) (SEQ. ID NO: 2515)

Human Interleukin-1 Receptor (IL-1 R) Nucleic Acids and Anti-sense Oligonucleotide Fragments 5'-GCCACGTGCT GCTGGGTCTC AGTCCTCCAC TTCCCGTGTC CTCTGGAAGT TGTCAGGAGC AATGTTGCGC
TTGTACGTGT TGGTAATGGG AGTTTCTGCC TTCACCCTTC AGCCTGCGGC ACACACAGGG GCTGCCAGAA
GCTGCCGGTT TCGTGGGAGG CATTACAAGC GGGAGTTCAG GCTGGAAGGG AGCCTGTAG CCCTGAGGTG
CCCCCAGGTG CCCTACTGGT TGTGGGCCTC TGTCAGCCCC CGCATCAACC TGACATGGCA TAAAAATGAC
TCTGCTAGGA CGGTCCCAGG AGAAGAAGAG ACACGGATGT GGGCCCAGGA CGGTGCTCTG TGGCTTCTGC
CAGCCTTGCA GGAGGACTCT GGCACCTACG TCTGCACTAC TAGAAATGCT TCTTACTGTG ACAAAATGTC
CATTGAGCTC AGAGTTTTTG AGAATACAGA TGCTTTCCTG CCGTTCATCT CATACCCGCA AATTTTAACC
TTGTCAACCT CTGGGGTATT AGTATGCCCT GACCTGAGTG AATTCACCCG TGACAAAACT GACGTGAAGA

```
TTCAATGGTA CAACGATTCT CTTCTTTTGG ATAAAGACAA TGAGAAATTT CTAAGTGTGA GGGGGACCAC

TCACTTACTC GTACACGATG TGGCCCTGGA AGATGCTGGC TATTACCGCT GTGTCCTGAC ATTTGCCCAT

GAAGGCCAGC AATACAACAT CACTAGGAGT ATTGAGCTAC GCATCAAGAA AAAAAAAGAA GAGACCATTC

CTGTGATCAT TTCCCCCCTC AAGACCATAT CAGCTTCTCT GGGGTCAAGA CTGACAATCC CGTGTAAGGT

GTTTCTGGGA ACCCGCACAC CCTTAACCAC CATGCTGTGG TGGACGGCCA ATGACACCCA CATAGAGAGC

GCCTACCCGG GAGGCCGCGT GACCGAGGGG CCACGCCAGG AATATTCAGA AAATAATGAG AACTACATTG

AAGTGCCATT GATTTTTGAT CCTGTCACAA GAGAGGATTT GCACATGGAT TTTAAATGTG TTGTCCATAA

TACCCTGAGT TTTCAGACAC TACGCACCAC AGTCAAGGAA GCCTCCTCCA CGTTCTCCTG GGGCATTGTG

CTGGCCCCAC TTTCACTGGC CTTCTTGGTT TTGGGGGGAA TATGGATGCA CAGACGGTGC AAACACAGAA

CTGGAAAAGC AGATGGTCTG ACTGTGCTAT GGCCTCATCA TCAAGACTTT CAATCCTATC CCAAGTGAAA

TAAATGGAAT GAAATAATTC AAACACAAAA AAAAAAAAA AAAAAAAA GCCGGAGCCG ACTCGGAGCG

CGCGGCGCGG CCGGGAGGAG CCGAGCGCGC CGGGCGCGGC GTGGGGCGC CGGCTGCCCC GCGCGCCCAG

GGAGCGGCAG GAATGTGACA ATCGCGCGCC CGCACCGTAG CACTCCTCGC TCGGCTCCTA GGGCTCTCGC

CCTCTGAGCT GAGCCGGGTT CCGCCCGGGC TGGGATCCCA TCACCCTCCA CGGCCGTCCG TCCAGGTAGA

CGCACCCTCT GAAGATGGTG ACTCCCTCCT GAGAAGCTGG ACCCCTTGGT AAAAGACAAG GCCTTCTCCA

AGAAGAATAT GAAAGTGTTA CTCAGACTTA TTTGTTTCAT AGCTCTACTG ATTTCTTCTC TGGAGGCTGA

TAAATGCAAG GAACGTGAAG AAAAAATAAT TTTAGTGTCA TCTGCAAATG AAATTGATGT TCGTCCCTGT

CCTCTTAACC CAAATGAACA CAAAGGCACT ATAACTTGGT ATAAAGATGA CAGCAAGACA CCTGTATCTA

CAGAACAAGC CTCCAGGATT CATCAACACA AAGAGAAACT TTGGTTTGTT CCTGCTAAGG TGGAGGATTC

AGGACATTAC TATTGCGTGG TAAGAAATTC ATCTTACTGC CTCAGAATTA AAATAAGTGC AAAATTTGTG

GAGAATGAGC CTAACTTATG TTATAATGCA CAAGCCATAT TTAAGCAGAA ACTACCCGTT GCAGGAGACG

GAGGACTTGT GTGCCCTTAT ATGGAGTTTT TTAAAAATGA AAATAATGAG TTACCTAAAT TACAGTGGTA

TAAGGATTGC AAACCTCTAC TTCTTGACAA TATACACTTT AGTGGAGTCA AGATAGGCT CATCGTGATG

AATGTGGCTG AAAAGCATAG AGGGAACTAT ACTTGTCATG CATCCTACAC ATACTTGGGC AAGCAATATC

CTATTACCCG GGTAATAGAA TTTATTACTC TAGAGGAAAA CAAACCCACA AGGCCTGTGA TTGTGAGCCC

AGCTAATGAG ACAATGGAAG TAGACTTGGG ATCCCAGATA CAATTGATCT GTAATGTCAC CGGCCAGTTG

AGTGACATTG CTTACTGGAA GTGGAATGGG TCAGTAATTG ATGAAGATGA CCCAGTGCTA GGGGAAGACT

ATTACAGTGT GGAAAATCCT GCAAACAAAA GAAGGAGTAC CCTCATCACA GTGCTTAATA TATCGGAAAT

TGAAAGTAGA TTTTATAAAC ATCCATTTAC CTGTTTTGCC AAGAATACAC ATGGTATAGA TGCAGCATAT

ATCCAGTTAA TATATCCAGT CACTAATTTC CAGAAGCACA TGATTGGTAT ATGTGTCACG TTGACAGTCA

TAATTGTGTG TTCTGTTTTC ATCTATAAAA TCTTCAAGAT TGACATTGTG CTTTGGTACA GGGATTCCTG

CTATGATTTT CTCCCAATAA AAGCTTCAGA TGGAAAGACC TATGACGCAT ATATACTGTA TCCAAAGACT

GTTGGGGAAG GGTCTACCTC TGACTGTGAT ATTTTTGTGT TTAAAGTCTT GCCTGAGGTC TTGGAAAAAC

AGTGTGGATA TAAGCTGTTC ATTTATGGAA GGGATGACTA CGTTGGGGAA GACATTGTTG AGGTCATTAA

TGAAAACGTA AAGAAAAGCA GAAGACTGAT TATCATTTTA GTCAGAGAAA CATCAGGCTT CAGCTGGCTG

GGTGGTTCAT CTGAAGAGCA AATAGCCATG TATAATGCTC TTGTTCAGGA TGGAATTAAA GTTGTCCTGC

TTGAGCTGGA GAAAATCCAA GACTATGAGA AAATGCCAGA ATCGATTAAA TTCATTAAGC AGAAACATGG

GGCTATCCGC TGGTCAGGGG ACTTTACACA GGGACCACAG TCTGCAAAGA CAAGGTTCTG GAAGAATGTC

AGGTACCACA TGCCAGTCCA GCGACGGTCA CCTTCATCTA AACACCAGTT ACTGTCACCA GCCACTAAGG
```

AGAAACTGCA AAGAGAGGCT CACGTGCCTC TCGGGTAGCA TGGAGAAGTT GCCAAGAGTT CTTTAGGTGC
CTCCTGTCTT ATGGCGTTGC AGGCCAGGTT ATGCCTCATG CTGACTTGCA GAGTTCATGG AATGTAACTA
TATCATCCTT TATCCCTGAG GTCACCAGGA ATCAGG-3' (FRAG. NO: _ ) (SEQ. ID NO: 2520)
5'-GCCACGTGCT GCTGGGTCTC AGTCCTCCAC TTCCCGTGTC CTCTGGAAGT TGTCAGGAGC AATGTTGCGC
TTGTACGTGT TGGTAATGGG AGTTTCTGCC TTCACCCTTC AGCCTGCGGC ACACACAGGG GCTGCCAGAA
GCTGCCGGTT TCGTGGGAGG CATTACAAGC GGGAGTTCAG GCTGGAAGGG GAGCCTGTAG CCCTGAGGTG
CCCCCAGGTG CCCTACTGGT TGTGGGCCTC TGTCAGCCCC CGCATCAACC TGACATGGCA TAAAAATGAC
TCTGCTAGGA CGGTCCCAGG AGAAGAAGAG ACACGGATGT GGGCCCAGGA CGGTGCTCTG TGGCTTCTGC
CAGCCTTGCA GGAGGACTCT GGCACCTACG TCTGCACTAC TAGAAATGCT TCTTACTGTG ACAAAATGTC
CATTGAGCTC AGAGTTTTTG AGAATACAGA TGCTTTCCTG CCGTTCATCT CATACCCGCA AATTTTAACC
TTGTCAACCT CTGGGGTATT AGTATGCCCT GACCTGAGTG AATTCACCCG TGACAAAACT GACGTGAAGA
TTCAATGGTA CAAGGATTCT CTTCTTTTGG ATAAAGACAA TGAGAAATTT CTAAGTGTGA GGGGGACCAC
TCACTTACTC GTACACGATG TGGCCCTGGA AGATGCTGGC TATTACCGCT GTGTCCTGAC ATTTGCCCAT
GAAGGCCAGC AATACAACAT CACTAGGAGT ATTGAGCTAC GCATCAAGAA AAAAAAAGAA GAGACCATTC
CTGTGATCAT TTCCCCCCTC AAGACCATAT CAGCTTCTCT GGGGTCAAGA CTGACAATCC CGTGTAAGGT
GTTTCTGGGA ACCGGCACAC CCTTAACCAC CATGCTGTGG TGGACGGCCA ATGACACCCA CATAGAGAGC
GCCTACCCGG GAGGCCGCGT GACCGAGGGG CCACGCCAGG AATATTCAGA AAATAATGAG AACTACATTG
AAGTGCCATT GATTTTTGAT CCTGTCACAA GAGAGGATTT GCACATGGAT TTTAAATGTG TTGTCCATAA
TACCCTGAGT TTTCAGACAC TACGCACCAC AGTCAAGGAA GCCTCCTCCA CGTTCTCCTG GGGCATTGTG
CTGGCCCCAC TTTCACTGGC CTTCTTGGTT TTGGGGGGAA TATGGATGCA CAGACGGTGC AAACACAGAA
CTGGAAAAGC AGATGGTCTG ACTGTGCTAT GGCCTCATCA TCAAGACTTT CAATCCTATC CCAAGTGAAA
TAAATGGAAT GAAATAATTC AAACACAAAA AAAAAAAAA AAAAAAAA-3' (FRAG. NO: _ ) (SEQ. ID NO: 2518)
5'-GCCGGAGCCG ACTCGGAGCG CGCGGCGCGG CCGGGAGGAG CCGAGCGCGC CGGGCGCGGC GTGGGGGCGC
CGGCTGCCCC GCGCGCCCAG GGAGCGGCAG GAATGTGACA ATCGCGCGCC CGCACCGTAG CACTCCTCGC
TCGGCTCCTA GGGCTCTCGC CCTCTGAGCT GAGCGGGGTT CCGCCCGGGC TGGGATCCCA TCACCCTCCA
CGGCCGTCCG TCCAGGTAGA CGCACCCTCT GAAGATGGTG ACTCCCTCCT GAGAAGCTGG ACCCCTTGGT
AAAAGACAAG GCCTTCTCCA AGAAGAATAT GAAAGTGTTA CTCAGACTTA TTTGTTTCAT AGCTCTACTG
ATTTCTTCTC TGGAGGCTGA TAAATGCAAG GAACGTGAAG AAAAAATAAT TTTAGTGTCA TCTGCAAATG
AAATTGATGT TCGTCCCTGT CCTCTTAACC CAAATGAACA CAAAGGCACT ATAACTTGGT ATAAAGATGA
CAGCAAGACA CCTGTATCTA CAGAACAAGC CTCCAGGATT CATCAACACA AAGAGAAACT TTGGTTTGTT
CCTGCTAAGG TGGAGGATTC AGGACATTAC TATTGCGTGG TAAGAAATTC ATCTTACTGC CTCAGAATTA
AAATAAGTGC AAAATTTGTG GAGAATGAGC CTAACTTATG TTATAATGCA CAAGCCATAT TTAAGCAGAA
ACTACCCGTT GCAGGAGACG GAGGACTTGT GTGCCCTTAT ATGGAGTTTT TTAAAAATGA AAATAATGAG
TTACCTAAAT TACAGTGGTA TAAGGATTGC AAACCTCTAC TTCTTGACAA TATACACTTT AGTGGAGTCA
AAGATAGGCT CATCGTGATG AATGTGGCTG AAAAGCATAG AGGGAACTAT ACTTGTCATG CATCCTACAC
ATACTTGGGC AAGCAATATC CTATTACCCG GGTAATAGAA TTTATTACTC TAGAGGAAAA CAAACCCACA
AGGCCTGTGA TTGTGAGCCC AGCTAATGAG ACAATGGAAG TAGACTTGGG ATCCCAGATA CAATTGATCT
GTAATGTCAC CGGCCAGTTG AGTGACATTG CTTACTGGAA GTGGAATGGG TCAGTAATTG ATGAAGATGA
CCCAGTGCTA GGGGAAGACT ATTACAGTGT GGAAATCCT GCAAACAAAA GAAGGAGTAC CCTCATCACA
GTGCTTAATA TATCGGAAAT TGAAAGTAGA TTTTATAAAC ATCCATTTAC CTGTTTTGCC AAGAATACAC

```
ATGGTATAGA TGCAGCATAT ATCCAGTTAA TATATCCAGT CACTAATTTC CAGAAGCACA TGATTGGTAT
ATGTGTCACG TTGACAGTCA TAATTGTGTG TTCTGTTTTC ATCTATAAAA TCTTCAAGAT TGACATTGTG
CTTTGGTACA GGGATTCCTG CTATGATTTT CTCCCAATAA AAGCTTCAGA TGGAAAGACC TATGACGCAT
ATATACTGTA TCCAAAGACT GTTGGGGAAG GTCTACCTC TGACTGTGAT ATTTTTGTGT TTAAAGTCTT
GCCTGAGGTC TTGCAAAAAC AGTGTGGATA TAAGCTGTTC ATTTATGGAA GGATGACTA CGTTGGGGAA
GACATTGTTG AGGTCATTAA TGAAAACGTA AGAAAAGCA GAAGACTGAT TATCATTTTA GTCAGAGAAA
CATCAGGCTT CAGCTGGCTG GGTGGTTCAT CTGAAGAGCA AATAGCCATG TATAATGCTC TTGTTCAGGA
TGGAATTAAA GTTCTCCTGC TTGAGCTGGA GAAAATCCAA GACTATGAGA AAATGCCAGA ATCGATTAAA
TTCATTAAGC AGAAACATGG GGCTATCCGC TGGTCAGGGG ACTTTACACA GGGACCACAG TCTGCAAAGA
CAAGGTTCTG GAAGAATGTC AGGTACCACA TGCCAGTCCA GCGACGGTCA CCTTCATCTA AACACCAGTT
ACTGTCACCA GCCACTAAGG AGAAACTGCA AAGAGAGGCT CACGTGCCTC TCGGGTAGCA TGGAGAAGTT
GCCAAGAGTT CTTTAGGTGC CTCCTGTCTT ATGGCGTTGC AGGCCAGGTT ATGCCTCATG CTGACTTGCA
GAGTTCATTGG AATGCAACTA TATCATCCTT TATCCCTGAG GTCACCAGGA ATCAGG-3' (FRAG. NO: _ ) (SEQ. ID
NO: 2519)
```

Human Interleukin-8* Fragments Antisense Oligonucleotide Fragments

```
5'-GBTGTTTGTT BCCBBBGCBT CBBGBBTBGC TTTGCTBTCT BBGGBTCBCB TTTBGBCBTB GGBBBBCGCT
GTBGGTCGBB BGBTGTGCTT BCCTTCBCBC BGBGCTGCBG BBBTCBGGBBGG CTGCCBBGBGBG CCBCGGCCBGC
TTGGBGTCBT GTTTBCBCBC BGTGBGGTGC TCCGGTGGCT TTTTGCTTGT GTGCTCTGCT GTCTCTG TTC
CTTCCGGTGG TTTCTTCCTG GCTCTTGTCC TTTCTCTTGG CCCTTGGCCC-3' (FRAG. NO: 1834) (SEQ. ID NO: 1847)
5'-G CTC CGG-3' (FRAG. NO: 1835) (SEQ. ID NO: 1848)
5'-CBBGBBTBGC-3' (FRAG. NO: 1836) (SEQ. ID NO: 1849)
5'-CBCBC BGTGBGGTGC-3' (FRAG. NO: 1837) (SEQ. ID NO: 1850)
5'-BCCBBBGCBT CBBGBBTBGC-3' (FRAG. NO: 1838) (SEQ. ID NO: 1851)
5'-GCCBBGBGBG CCBCGGCCBGC-3' (FRAG. NO: 1839) (SEQ. ID NO: 1852)
5'-GTG CTC CGG TGG CTT TTT-3' (FRAG. NO: 1289) (SEQ. ID NO: 1298)
5'-GCT TGT GTG CTC TGC TGT CTC TG-3' (FRAG. NO: 1290) (SEQ. ID NO: 1299)
5'-TTC CTT CCG GTG GTT TCT TCC TGG CTC TTG TCC T-3' (FRAG. NO: 1291) (SEQ. ID NO: 1300)
5'-TTC TCT TGG CCC TTG GCC C-3' (FRAG. NO: 1292) (SEQ. ID NO: 1301)
5'-GBTGTTTGTT BCCBBBGCBT CBBGBBTBGC TTTGCTBTCT BBGGBTCBCB TTTBGBCBTB GGBBBBCGCT
GTBGGTCGBB BGBTGTGCTT BCCTTCBCBC BGBGCTGCBG BBBTCBGGBBGG CTGCCBBGBGBG CCBCGGCCBGC
TTGGBGTCBT GTTTBCBCBC BGTGBGGTGC TCCGGTGGCT TTTTGCTTGT-3' (FRAG. NO: 1840) (SEQ. ID NO: 1853)
```

Human IL-8 Receptor Alpha Antisense Oligonucleotide Fragments

```
5'-ACAGGGGCTG TAATCTTCATC TGCAGGTGGC ATGCCAGTGA AATTTAGATC ATCAAAATCC CACATCTGTG
GATCTGTAAT ATTTGACATG TCCTCTTCAG TTTCAGCAAT GGTTTGATCT AACTGAAGCA CCGGCCAGGB
CBGGGGCTGT BBTCTTCBTC TGCBGGTGGC BTGCCBGTGB BBTTTBGBTC BTCBBBBTCC CBCBTCTGTG
GBTCTGTBBT BTTTGBCBTG TCCTCTTCBG TTTCBGCBB TGGTTTGBTC TBBCTGBBGC BCCGGCCBGG
TGGCTCGGTG CTTCTGCCCC TGTTGTTCG GCGCTCGGTT GGTGTGGCCC CTGTGGTGCT TCGTTTCCCC
CTCTTTCTCT TTGTTCGGGG GTTCTTGTGG CGGGCTGCTT GTCTCGTTCC-3' (FRAG. NO: 1841) (SEQ. ID NO: 1854)
5'-CBGGGGC-3'-0 (FRAG. NO: 1842) (SEQ. ID NO: 1855)
```

-continued

5'-GCBGGTGGC-3' (FRAG. NO: 1843) (SEQ. ID NO: 1856)

5'-GCGGCGCTC-3' (FRAG. NO: 1844) (SEQ. ID NO: 1857)

5'-TGGCTCGGTGCTTCTGCCCC (FRAG. NO: 1293) (SEQ. ID NO: 1302)

5'-TGTTGTTGCGGCGCTC (FRAG. NO: 1294) (SEQ. ID NO: 1303)

5'-GGTTGGTGTGGCCCCTG (FRAG. NO: 1295) (SEQ. ID NO: 1304)

5'-TGGTGCTTCGTTTCC (FRAG. NO: 1296) (SEQ. ID NO: 1305)

5'-CCCTCTTTCTCTTTGTTC (FRAG. NO: 1297) (SEQ. ID NO: 1306)

5'-GGGGGTTCTTGTGGC (FRAG. NO: 1298) (SEQ. ID NO: 1307)

5'-GGGCTGCTTGTCTCGTTCC (FRAG. NO: 1299) (SEQ. ID NO: 1308)

5'-ACAGGGGCTG TAATCTTCATC TGCAGGTGGC ATGCCAGTGA AATTTAGATC ATCAAAATCC CACATCTGTG
GATCTGTAAT ATTTGACATG TCCTCTTCAG TTTCAGCAAT GGTTTGATCT AACTGAAGCA CCGGCCAGG-3'
(FRAG. NO: 1845) (SEQ. ID NO: 1858)

5'-B CBGGGGCTGT BBTCTTCBTC TGCBGGTGGC BTGCCBGTGB BBTTTBGBTC BTCBBBBTCC CBCBTCTGTG
GBTCTGTBBT BTTTGBCBTG TCCTCTTCBG TTTCBGCBB TGGTTTGBTC TBBCTGBBGC BCCGGCCBGG-3' (FRAG.
NO: 1846) (SEQ. ID NO: 1859)

Interleukin-11 (IL-11) Nucleic Acid and Antisense Oligonucleotide Fragments

5'-GCTCAGGGCA CATGCCTCCC CTCCCCAGGC CGCGGCCCAG CTGACCCTCG GGCTCCCCC GGCAGCGGAC
AGGGAAGGGT TAAAGGCCCC CGGCTCCCTG CCCCCTGCCC TGGGGAACCC CTGGCCCTGT GGGGACATGA
ACTGTGTTTG CCGCCTGGTC CTGGTCGTGC TGAGCCTGTG GCCAGATACA GCTGTCGCCC CTGGGCCACC
ACCTGGCCCC CCTCGAGTTT CCCCAGACCC TCGGGCCGAG CTGGACAGCA CCGTGCTCCT GACCCGCTCT
CTCCTGGCGG ACACGCGGCA GCTGGCTGCA CAGCTGAGGG ACAAATTCCC AGCTGACGGG ACCACAACC
TGGATTCCCT GCCCACCCTG GCCATGAGTG CGGGGGCACT GGGAGCTCTA CAGCTCCCAG GTGTGCTGAC
AAGGCTGCGA GCGGACCTAC TGTCCTACCT GCGGCACGTG CAGTGGCTGC GCCGGGCAGG TGGCTCTTCC
CTGAAGACCC TGGAGCCCGA GCTGGGCACC CTGCAGGCCC GACTGGACCG GCTGCTGCGC CGGCTGCAGC
TCCTGATGTC CCGCCTGGCC CTGCCCCAGC CACCCCCGGA CCCGCCGGCG CCCCCGCTGG CGCCCCCCTC
CTCAGCCTGG GGGGCATCA GGGCCGCCCA CGCCATCCTG GGGGGCTGC ACCTGACACT TGACTGGGCC
GTGAGGGGAC TGCTGCTGCT GAAGACTCGG CTGTGACCCG GGGCCCAAAG CCACCACCGT CCTTCCAAAG
CCAGATCTTA TTTATTTATT TATTTCAGTA CTGGGGGCGA AACAGCCAGG TGATCCCCCC GCCATTATCT
CCCCCTAGTT AGAGACAGTC CTTCCGTGAG GCCTGGGGGA CATCTGTGCC TTATTTATAC TTATTTATTT
CAGGAGCAGG GGTGGGAGGC AGGTGGACTC CTGGGTCCCC GAGGAGGAGG GGACTGGGGT CCCGGATTCT
TGGGTCTCCA AGAAGTCTGT CCACAGACTT CTGCCCTGGC TCTTCCCCAT CTAGGCCTGG GCAGGAACAT
ATATTATTTA TTTAAGCAAT TACTTTTCAT GTTGGGGTGG GGACGGAGGG GAAAGGGAAG CCTGGGTTTT
TGTACAAAAA TGTGAGAAAC CTTTGTGAGA CAGAGAACAG GGAATTAAAT GTGTCATACA TATCC
CAGCTGCGGC ATCCTCTGTC TCAGAGTCTT GGTGTCTCTG TTCCTTTCCC CTCGGGGTCT CCCTGGGTCT
CCCCAAGTCC CTCCTGCTGT CTTCCTCCCG CTCTCTGATC TCTGACTCCC AGAACCTCTC CCTCTGTCTC
CAGGGCTGCC CCTCTGATCC TCTTTGCTTC TCTGGTGTGT CTCTCTGGCT GCCTCCATCT CTGTGGATCT
CCGTCTCCCT GTCTCTGTCT CAGTCTGTCC TTCACTCTGT GTGTGTGTGT GTCTCTCTCT CTCTCTCTCC
TTCCCTTCCA CTCCCTCTTC CTCCTGCCTC CACCTCTCCA GGCCCCTGTC TTGTCCCTCC GTCCGGCCTT
TCTCTGCCTT TCCGTCCTCC TGCCTCCCCA TCTCTCTCTG CTAGTCCTGT CCAGCCGGAC CCCCACCCAC
AGTCGGGCCC CAGCGCTTGA GCCTGAGTGT CTGCTCCGGC CCGTGGAGGT GGAGGGAGGG GACGCCAATG

-continued

```
ACCTCACCAG CCCCTCTCCG ACCACCCCCC CCTTTCCCTT TTCAACTTTT CCAACTTTTC CTTCCGTGCC
CTCCTCCGAG CGCGGCGGCG TGAGCCCTGC AAGGCAGCCG CTCCGTCTGA ATGGAAAAGG CAGGCAGGGA
GGGTGAGTCA GGATGTGTCA GGCCGGCCCT CCCCTGCCGC CTGCCCCCCG CCCGCCCGCC CCAGGCCCCC
TATATAACCC CCCAGGCGTC CACACTCCCT CACTGCCGCG GGCCCTGCTG CTCAGGGCAC ATGCCTCCCC
TCCCCAGCCG CGGGCCCAGC TGACCCTCGG GGCTCCCCCG GCAGCGGACA GGGAAGGGTT AAAGGCCCCC
GGCTCCCTGC CCCCTGCCCT GGGGAACCCC TGGCCCTGTG GGGACATGAA CTGTAAGTTG GTTCATGGGG
AGGGTGGAGG GGACAGGGAG GCAGGGAGGA GAGGGACCCA CGGCGGGGGT GGGAGCAGAC CCCGCTGAGT
CGCACAGAGA GGGACCCGGA GACAGGCAGC CGGGGAGGAG AGCAGCTTCG GAGACAGGAG GCGGCGGAGG
AGATGGGCAG AGAGAGACAC AGACAGGAGC GGATGGAGGC AGCCAATCAG AGGCGCCGCA GGAGGGACGG
GCCAGACAGG GCCCGAGAGG AGCGAGACGC GAGACCGAGC AGGGGCAGGG ACGCAGGGAC TGGTGCCGGG
AGGGAGGTGA CCCCCATCGA CCCAGGCCCC AGGGAGCCCG CGGGGACCGG GAGACTCCCT GGGATTCCGG
CAGAGAGGCT CCGGAGGGAA ACTGAGGCAG GGTCCGCGGA GAGCGGAGCA AGCCAGGGAG TAGCGACCCC
AGCCGGGGGG AGGAGAGAGA CTGGGCGCCG GGGGAAAGCG GGGAGAGCCG GGCAGATGCG GCCGACGGAG
GCGCGGACAG ACCGACGGCT GGCGGGCCCG GGGGCGGGC TGGGGGTGTG CGAGGCGCGG GCGGCCGGGG
AGCGCTGATT GGCTGGCGGG TGGCCGGGTG GGCGGGGCGG CCGGGGTGGG CTGCGGGGAG CGAGCTCCGG
ACCCCCGCGC CCCCGGCGCC CCCCGCGCCC CCCGCCGCCA GCTCTCCCGC TCCCGGCGCC CGGCCGGGCC
ATGGCTCTGC CCCTCTCCGC CCAGGTGCGC TGCGGCCCGG GCTTCTGCCG CCCACCCGGC GGGCTCCTGG
GAGGGCGTCT AAGGGGTCTC CCGTGGGAGA GGTCCGTGTC TCCCGGACTC CGTCCTGGGC TTTTGGCTCC
TTCCCCTGCT CCCAGCCAGC TCGGGCTCCC GCGGCCCGGG GAGGGGGCAG GTTCTGGCCT GTGCCTCCCC
CACCATCCGC GCCCCGGGGC CCAGATTCCG GCGTCCGGGG GCGGACGGGA GACGCCCGGG CCGCGTCTGC
TCCGACGGGC GGGGCAGCCA GAGCCAGGGA GGGAGAGGGA AGCCCGCCTG GCCCTGCGAC CTGCCCGCGG
GCGTTCCACC CTGGGACTTA AGACCTCCAG CTCCATCCTC CCTAAGGCCG GGAGTCCAGG CCCCAGACCC
TCCTCCCCGA GACCCAGGAG TCCAGACCCC AGGCCTTCCT CCCTCAGACC TAGGAGTCCA GGCCCCCAGC
CTCTCCTCCC TCAGACCCAG GAGGAGTCCA GACCCCAGTT CCTCCTCCCT CAGACCCGGG AGTCCAGCCC
AGGCCCTCCT CTCTCAGACC CGGAGTCCAG CCTGAGCTCT CTGCCTTATC CTGCCCCCAG GTGTTTGCCG
CCTGGTCCTG GTCGTGCTGA GCCTGTGGCC AGATACAGCT GTCGCCCCTG GCCACCACC TGGCCCCCCT
CGAGTTTCCC CAGACCCTCG GGCCGAGCTG GACAGCACCG TGCTCCTGAC CCGCTCTCTC CTGGCGGACA
CGCGGCAGCT GGCTGCACAG CTGGTAGGAG AGACTGGGCT GGGGCCAGCA CAGGAGTGAG AGGCAGAGAG
GAACGGAGAG GAGTCTGCGG GCAGCCACTT GGAGGGGTTC TGGGCTCTCA GGTGGCAGAG TGAGGGAGGG
GAAGAGTTGG GGGCCTGGCG TGGGGATGG AGGGAGCCCC GAGGCTGGGC AGGGGCCACC TCACAGCTTT
TTTCCCTGCC AGAGGGACAA ATTCCCAGCT GACGGGACC ACAACCTGGA TTCCCTGCCC ACCCTGGCCA
TGAGTGCAGG GGCACTGGGA GCTCTACAGG TAAGGGCAAG GGAGTGGGCT GGGGACAAGG TGGGAGGCAG
GCAGTGAAGG GGGCGGGGAG GATGAGGGGC ACTGGTCGGG TGTTCTCTGA TGTCCCGGCT CTATCCCCAG
CTCCCAGGTG TGCTGACAAG GCTGCGAGCG GACCTACTGT CCTACCTGCG GCACGTGCAG TGGCTGCGCC
GGGCAGGTGG CTCTTCCCTG AAGACCCTGG AGCCCGAGCT GGGCACCCTG CAGGCCCGAC TGGACCGGCT
GCTGCGCCGG CTGCAGCTCC TGGTATGTCC TGGCCCCAAG ACCTGACACC CCAGACCCCC ACCCCTGGCC
CCAAAATCCT GTGGCCTGAG TCCTTGAAGC CTGAGACCCC AGACCCGAGT GCAACAGCCC CGCTCTGAGA
CCCTGACACC CTAACAGCCC GCTCTGAGAC CCTGACACCG TAACAGCCCC GCTCTGAGAC CCTGACCCTA
ACAGTCCTGC TCTGAGACCC TGACCCTGCA GTCCCAAGAT CCTGTGGCCC TGAGACCCTG AGGCCCTAGA
```

```
CCCCCAAATC CTGCCCAGAA ACTTCAAATT CTCACCCAAG ACCCTGAGAC TCCATCATCC ATGACCTCAA
AGTCCCCAGA TCCCAGCCCC TAAGACCCAA GACCCCATCC TGAAGCCCAA AGCCTTGAGA ATTCAAATCC
TCACCTCAAG ACTTGGAGAC CCTGGCCCCA TGACATTGAA AACCATGGAC CTGGCCAGGC GTGGTGGCTC
ACGCCTGTAA TCCCAGCACT TTGGGAGGCC GAGGCAAGTG GATCACCTGA GGTCGGGAGT TCAAGACCAG
CCAGACCAAC ATGGTGAAAC CCTGTCTCTA CTAAAAATAC AAAATTAGCC AGGCGTGGTG GTGCATGCCT
GTAATCCCAG CTACTTGGGA GGCTGAGGCA GGAGAATCGC TTGAACCTGG GAGGCGGAGG TTGCAGTGAG
CCGAGATCGC ACCATTACAC TCCAGCCTGG GCAACAAGAG CAAAACTCCC TCTCTCTCAA AAAAAAAAAA
AAAAAAAAAA AAGAAGGAAA AGAAAACCAT GGACCTCCAG ACCCTGAGAC CCCAGGCCCC AGCCCTGAGA
TCCTGACATC TTAAAGATCC CAGGCCCTAA GATACAAGAC CTTGACCCAA AGCCAGCCTT GGGACCCTGG
CTGTACAAAC CCAAGACCTC CAGGACCTAG ACCCCGAGCC CTGAGGCCCT ATGTCTCACT CCCAACATCG
AAAACCCTGA CACCTCAGAT CCTGAGCCTG CGCCTGTACG ACTCCAAGAC CCTCACTTCC AAAGCCAGGC
CCAAAGCCCT GAGACCAGAA GACTTCAAAC CCTGGTTCTT GGGCCTAACT CCAAAGACCC TGGATCTCAA
ATTCCAACTT CTAGCTCTGA GACTCCAGCC CTCACCCATG AGTTCCTGAA CTTGAACCCA GAGACCCCAT
CTCTAAGACT TCAGCCTTGA GATCCAGGGC CTGACCCTAG ACTCGAGCCC ACAGACCTCA GATACTGTCT
GTAAAACCCC AGCTCTGGTG GGGAGCAGTG GCTCACTCCT GTAATCCCAA GGCAGGGGAG GCCAAGGCAG
AAGGACCTCT TGAGGCCATG AGTTTGAGAC AGCCTGGGCA GCATAGCAAG ACTCTGTTTC TTAATTATTA
TTATTATTAT TATTTTTTGG AGACAGAGTC TCGCGCTCTG TTGCCCAGGC TAGAGTGCAA TGGTGCCATT
TCGGCTTGCT GGAACCTCCG CCTCCTGGGC TCAAGCGATT CTCCTGCCTC AGCCTCCTGA GTAGCTGGGA
CTTCAGGTGC ACACTGCCAC ACCCGGATAA TTTTTTTGTA TTTTAGTAGA CACAGGGTTT CACCGTGTTG
CCCAGGCTGG TCACAAACTC CTGAGCTCAG GCCATCCGCC CGCCTCGGCC TCCCAAAGCG CTGGGATAAC
AGGCGTGACG CCGCGCCTGG CTTCTTAATT GTTCTAACAG CAGCGACAAC AACAAAAACC CAGCTCTGAG
ATTCCAGCCC CGGCGACTCT AACAGTCCCA GGCCCGATCC CTCACCTAGA ACCGAGATGC CAGCCCTGAC
TCCACAGACT TCACCCCCAA CCCCCACACT CAGCTCTGGA AGCCCGTCCT GACTCCAGCC TCCATTTTCG
GAACCCCACA GCCTGAAGAG CTCCCGGCCT AAACACTTCA CCCCACGCGC CACAGTCCCC CTGTGAATAT
GCAGCCCCGA TTCAGCTGCA GCTCCACAGC ACCCCTGCCC TGCACCCCCG CTGCACCCCC TACCTGTGAC
TCACCTCTCT CCTCTCCCCA CAGATGTCCC GCCTGGCCCT GCCCCAGCCA CCCCCGGACC CGCCGGCGCC
CCCGCTGGCG CCCCCCTCCT CAGCCTGGGG GGGCATCAGG GCCGCCCACG CCATCCTGGG GGGGCTGCAC
CTGACACTTG ACTGGGCCGT GAGGGGACTG CTGCTGCTGA AGACTCGGCT GTGACCCGGG GCCCAAAGCC
ACCACCGTCC TTCCAAAGCC AGATCTTATT TATTTATTTA TTTCAGTACT GGGGGCGAAA CAGCCAGGTG
ATCCCCCGC CATTATCTCC CCCTAGTTAG AGACAGTCCT TCCGTGAGGC CTGGGGGCA TCTGTGCCTT
ATTTATACTT ATTTATTTCA GGAGCAGGGG TGGGAGGCAG GTGGACTCCT GGGTCCCCGA GGAGGAGGGG
ACTGGGGTCC CGGATTCTTG GGTCTCCAAG AAGTCTGTCC ACAGACTTCT GCCCTGGCTC TTCCCCATCT
AGGCCTGGGC AGGAACATAT ATTATTTATT TAAGCAATTA CTTTTCATGT TGGGGTGGGG ACGGAGGGGA
AAGGGAAGCC TGGGTTTTTG TACAAAAATG TGAGAAACCT TTGTGAGACA GAGAACAGGG AATTAAATGT
GTCATACATA TCCACTTGAG GGCGATTTGT CTGAGAGCTG GGGCTGGATG CTTGGGTAAC TGGGGCAGGG
CAGGTGGAGG GGAGACCTCC ATTCAGGTGG AGGTCCCGAG TGGGCGGGGC AGCGACTGGG AGATGGGTCG
GTCACCCAGA CAGCTCTGTG GAGGCAGGGT CTGAGCCTTG CCTGGGGCCC CGCACTGCAT AGGGCCGTTT
GTTTGTTTTT TGAGATGGAG TCTCGCTCTG TTGCCTAGGC TGGAGTGCAG TGAGGCAATC TAAGGTCACT
GCAACCTCCA CCTCCCGGGT TCAAGCAATT CTCCTGCCTC AGCCTCCCGA TTAGCTGGGA TCACAGGTGT
GCACCACCAT GCCCAGCTAA TTATTTATTT CTTTTGTATT TTTAGTAGAG ACAGGGTTTC ACCATGTTGG
```

-continued

```
CCAGGCTGGT TTCGAACTCC TGACCTCAGG TGATCCTCCT GCCTCGGCCT CCCAAAGTGC TGGGATTACA

GGTGTGAGCC ACCACACCTG ACCCATAGGT CTTCAATAAA TATTTAATGG AAGGTTCCAC AAGTCACCCT

GTGATCAACA GTACCCGTAT GGGACAAAGC TGCAAGGTCA AGATGGTTCA TTATGGCTGT GTTCACCATA

GCAAACTGGA AACAATCTAG ATATCCAACA GTGAGGGTTA AGCAACATGG TGCATCTGTG GATAGAACGC

CACCCAGCCG CCCGGAGCAG GGACTGTCAT TCAGGGAGGC TAAGGAGAGA GGCTTGCTTG GATATAGAA

AGATATCCTG ACATTGGCCA GGCATGGTGG CTCACGCCTG TAATCCTGGC ACTTTGGGAG GACGAAGCGA

GTGGATCACT GAAGTCCAAG AGTTTGAGAC CGGCCTGCGA GACATGGCAA ACCCTGTCT CAAAAAAGAA

AGAATGATGT CCTGACATGA AACAGCAGGC TACAAAACCA CTGCATGCTG TGATCCCAAT TTTGTGTTTT

TCTTTCTATA TATGGATTAA AACAAAAATC CTAAAGGGAA ATACGCCAAA ATGTTGACAA TGACTGTCTC

CAGGTCAAAG GAGAGAGGTG GGATTGTGGG TGACTTTTAA TGTGTATGAT TGTCTGTATT TTACAGAATT

TCTGCCATGA CTGTGTATTT TGCATGCACA ATTTTAAAAA TAATAAACAC TATTTTTAGA ATAACAGAAT

ATCAGCCTCC TCCTCTCCAA AAATAAGCCC TCAGGAGGGG ACAAAGTTGA CCGCTGATTG AGCCTGTCAG

GGCTGTGCAC-3' (FRAG. NO: _ ) (SEQ. ID NO: 2523)

5'-GCTCAGGGCA CATGCCTCCC CTCCCCAGGC CGCGGCCCAG CTGACCCTCG GGGCTCCCCC GGCAGCGGAC

AGGGAAGGGT TAAAGGCCCC CGGCTCCCTG CCCCCTGCCC TGGGGAACCC CTGGCCCTGT GGGGACATGA

ACTGTGTTTG CCGCCTGGTC CTGGTCGTGC TGAGCCTGTG GCCAGATACA GCTGTCGCCC TGGGCCACC

ACCTGGCCCC CCTCGAGTTT CCCCAGACCC TCGGGCCGAG CTGGACAGCA CCGTGCTCCT GACCCGCTCT

CTCCTGGCGG ACACGCGGCA GCTGGCTGCA CAGCTGAGGG ACAAATTCCC AGCTGACGGG GACCACAACC

TGGATTCCCT GCCCACCCTG GCCATGAGTG CGGGGGCACT GGGAGCTCTA CAGCTCCCAG GTGTGCTGAC

AAGGCTGCGA GCGGACCTAC TGTCCTACCT GCGGCACGTG CAGTGGCTGC GCCGGGCAGG TGGCTCTTCC

CTGAAGACCC TGGAGCCCGA GCTGGGCACC CTGCAGGCCC GACTGGACCG GCTGCTGCGC CGGCTGCAGC

TCCTGATGTC CCGCCTGGCC CTGCCCCAGC CACCCCCGGA CCCGCCGGCG CCCCCGCTGG CGCCCCCCTC

CTCAGCCTGG GGGGGCATCA GGGCCGCCCA CGCCATCCTG GGGGGCTGC ACCTGACACT TGACTGGGCC

GTGAGGGGAC TGCTGCTGCT GAAGACTCGG CTGTGACCCG GGGCCCAAAG CCACCACCGT CCTTCCAAAG

CCAGATCTTA TTTATTTATT TATTTCAGTA CTGGGGCGA AACAGCCAGG TGATCCCCCC GCCATTATCT

CCCCCTAGTT AGAGACAGTC CTTCCGTGAG GCCTGGGGA CATCTGTGCC TTATTTATAC TTATTTATTT

CAGGAGCAGG GGTGGGAGGC AGGTGGACTC CTGGGTCCCC GAGGAGGAGG GGACTGGGGT CCCGGATTCT

TGGGTCTCCA AGAAGTCTGT CCACAGACTT CTGCCCTGGC TCTTCCCCAT CTAGGCCTGG GCAGGAACAT

ATATTATTTA TTTAAGCAAT TACTTTTCAT GTTGGGGTGG GGACGGAGGG GAAAGGGAAG CCTGGGTTTT

TGTACAAAAA TGTGAGAAAC CTTTGTGAGA CAGAGAACAG GGAATTAAAT GTGTCATACA TATCC-3' (FRAG.

NO: _ ) (SEQ. ID NO: 2521)

5'-CAGCTGCGGC ATCCTCTGTC TCAGAGTCTT GGTGTCTCTG TTCCTTTCCC CTCGGGTCT CCCTGGGTCT

CCCCAAGTCC CTCCTGCTGT CTTCCTCCCG CTCTCTGATC TCTGACTCCC AGAACCTCTC CCTCTGTCTC

CAGGGCTGCC CCTCTGATCC TCTTTGCTTC TCTGGTGTGT CTCTCTGGCT GCCTCCATCT CTGTGGATCT

CCGTCTCCCT GTCTCTGTCT CAGTCTGTCC TTCACTCTGT GTGTGTGTGT GTCTCTCTCT CTCTCTCTCC

TTCCCTTCCA CTCCCTCTTC CTCCTGCCTC CACCTCTCCA GGCCCCTGTC TTGTCCCTCC GTCGGCCTT

TCTCTGCCTT TCCGTCCTCC TGCCTCCCCA TCTCTCTCTG CTAGTCCTGT CCAGCCGGAC CCCCACCCAC

AGTCGGGCCC CAGCGCTTGA GCCTGAGTGT CTGCTCCGGC CCGTGGAGGT GGAGGGAGGG GACGCCAATG

ACCTCACCAG CCCCTCTCCG ACCACCCCCC CCTTTCCCTT TCAACTTTTT CCAACTTTTC CTTCCGTGCC
```

-continued

```
CTCCTCCGAG CGCGGCGGCG TGAGCCCTGC AAGGCAGCCG CTCCGTCTGA ATGGAAAAGG CAGGCAGGGA
GGGTGAGTCA GGATGTGTCA GGCCGGCCCT CCCCTGCCGC CTGCCCCCCG CCCGCCCGCC CCAGGCCCCC
TATATAACCC CCCAGGCGTC CACACTCCCT CACTGCCGCG GGCCCTGCTG CTCAGGGCAC ATGCCTCCCC
TCCCCAGCCG CGGGCCCAGC TGACCCTCGG GGCTCCCCCG GCAGCGGACA GGGAAGGGTT AAAGGCCCCC
GGCTCCCTGC CCCCTGCCCT GGGGAACCCC TGGCCCTGTG GGGACATGAA CTGTAAGTTG GTTCATGGGG
AGGGTGGAGG GGACAGGGAG GCAGGGAGGA GAGGGACCCA CGGCGGGGGT GGGAGCAGAC CCCGCTGAGT
CGCACAGAGA GGGACCCGGA GACAGGCAGC CGGGGAGGAG AGCAGCTTCG GAGACAGGAG GCGGCGGAGG
AGATGGGCAG AGAGAGACAC AGACAGGAGC GGATGGAGGC AGCCAATCAG AGGCGCCGCA GGAGGGACGG
GCCAGACAGG GCCCGAGAGG AGCGAGACGC GAGACCGAGC AGGGGCAGGG ACGCAGGGAC TGGTGCCGGG
AGGGAGGTGA CCCCCATCGA CCCAGGCCCC AGGGAGCCCG CGGGGACCGG GAGACTCCCT GGGATTCCGG
CAGAGAGGCT CCGGAGGGAA ACTGAGGCAG GGTCCGCGGA GAGCGGAGCA AGCCAGGGAG TAGCGACCCC
AGCCGGGGGG AGGAGAGAGA CTGGGCGCCG GGGAAAGCG GGGAGAGCCG GGCAGATGCG GCCGACGGAG
GCGCGGACAG ACCGACGGCT GGCGGGCCCG GGGGCGGGC TGGGGGTGTG CGAGGCGCGG GCGGCCGGGG
AGCGCTGATT GGCTGGCGGG TGGCCGGGTG GGCGGGGCGG CCGGGGTGGG CTGCGGGGAG CGAGCTCCGG
ACCCCCGCGC CCCCGGCGCC CCCCGCGCCC CCGCCGCCA GCTCTCCCGC TCCCGGCGCC CGGCCGGGCC
ATGGCTCTGC CCCTCTCCGC CCAGGTGCGC TGCGGCCCGG GCTTCTGCCG CCCACCCGGC GGGCTCCTGG
GAGGGCGTCT AAGGGGTCTC CCGTGGGAGA GGTCCGTGTC TCCCGGACTC CGTCCTGGGC TTTTGGCTCC
TTCCCCTGCT CCCAGCCAGC TCGGGCTCCC GCGGCCCGGG GAGGGGCAG GTTCTGGCCT GTGCCTCCCC
CACCATCCGC GCCCCGGGGC CCAGATTCCG GCGTCCGGGG GCGGACGGGA GACGCCCGGG CCGCGTCTGC
TCCGACGGGC GGGGCAGCCA GAGCCAGGGA GGGAGAGGGA AGCCCGCCTG GCCCTGCGAC CTGCCCGCGG
GCGTTCCACC CTGGGACTTA AGACCTCCAG CTCCATCCTC CCTAAGGCCG GGAGTCCAGG CCCCAGACCC
TCCTCCCCGA GACCCAGGAG TCCAGACCCC AGGCCTTCCT CCCTCAGACC TAGGAGTCCA GGCCCCCAGC
CTCTCCTCCC TCAGACCCAG GAGGAGTCCA GACCCCAGTT CCTCCTCCCT CAGACCCGGG AGTCCAGCCC
AGGCCCTCCT CTCTCAGACC CGGAGTCCAG CCTGAGCTCT CTGCCTTATC CTGCCCCCAG GTGTTTGCCG
CCTGGTCCTG GTCGTGCTGA GCCTGTGGCC AGATACAGCT GTCGCCCCTG GCCACCACC TGGCCCCCCT
CGAGTTTCCC CAGACCCTCG GGCCGAGCTG GACAGCACCG TGCTCCTGAC CCGCTCTCTC CTGGCGGACA
CGCGGCAGCT GGCTGCACAG CTGGTAGGAG AGACTGGGCT GGGGCCAGCA CAGGAGTGAG AGGCAGAGAG
GAACGGAGAG GAGTCTGCGG GCAGCCACTT GGAGGGGTTC TGGGCTCTCA GGTGGCAGAG TGAGGGAGGG
GAAGAGTTGG GGGCCTGGCG TGGGGGATGG AGGGAGCCCC GAGGCTGGGC AGGGGCCACC TCACAGCTTT
TTTCCCTGCC AGAGGGACAA ATTCCCAGCT GACGGGACC ACAACCTGGA TTCCCTGCCC ACCCTGGCCA
TGAGTGCAGG GGCACTGGGA GCTCTACAGG TAAGGGCAAG GGAGTGGGCT GGGGACAAGG TGGGAGGCAG
GCAGTGAAGG GGGCGGGGAG GATGAGGGGC ACTGGTCGGG TGTTCTCTGA TGTCCCGGCT CTATCCCCAG
CTCCCAGGTG TGCTGACAAG GCTGCGAGCG GACCTACTGT CCTACCTGCG GCACGTGCAG TGGCTGCGCC
GGGCAGGTGG CTCTTCCCTG AAGACCCTGG AGCCCGAGCT GGGCACCCTG CAGGCCCGAC TGGACCGGCT
GCTGCGCCGG CTGCAGCTCC TGGTATGTCC TGGCCCCAAG ACCTGACACC CCAGACCCCC ACCCCTGGCC
CCAAAATCCT GTGGCCTGAG TCCTTGAAGC CTGAGACCCC AGACCCGAGT GCAACAGCCC CGCTCTGAGA
CCCTGACACC CTAACAGCCC GCTCTGAGAC CCTGACACCG TAACAGCCCC GCTCTGAGAC CCTGACCCTA
ACAGTCCTGC TCTGAGACCC TGACCCTGCA GTCCCAAGAT CCTGTGGCCC TGAGACCCTG AGGCCCTAGA
CCCCCAAATC CTGCCCAGAA ACTTCAAATT CTCACCCAAG ACCCTGAGAC TCCATCATCC ATGACCTCAA
AGTCCCCAGA TCCCAGCCCC TAAGACCCAA GACCCCATCC TGAAGCCCAA AGCCTTGAGA ATTCAAATCC
```

-continued

```
TCACCTCAAG ACTTGGAGAC CCTGGCCCCA TGACATTGAA AACCATGGAC CTGGCCAGGC GTGGTGGCTC
ACGCCTGTAA TCCCAGCACT TTGGGAGGCC GAGGCAAGTG GATCACCTGA GGTCGGGAGT TCAAGACCAG
CCAGACCAAC ATGGTGAAAC CCTGTCTCTA CTAAAAATAC AAAATTAGCC AGGCGTGGTG GTGCATGCCT
GTAATCCCAG CTACTTGGGA GGCTGAGGCA GGAGAATCGC TTGAACCTGG GAGGCGGAGG TTGCAGTGAG
CCGAGATCGC ACCATTACAC TCCAGCCTGG GCAACAAGAG CAAAACTCCC TCTCTCTCAA AAAAAAAAAA
AAAAAAAAAA AAGAAGGAAA AGAAAACCAT GGACCTCCAG ACCCTGAGAC CCCAGGCCCC AGCCCTGAGA
TCCTGACATC TTAAAGATCC CAGGCCCTAA GATACAAGAC CTTGACCCAA AGCCAGCCTT GGGACCCTGG
CTGTACAAAC CCAAGACCTC CAGGACCTAG ACCCCGAGCC CTGAGGCCCT ATGTCTCACT CCCAACATCG
AAAACCCTGA CACCTCAGAT CCTGAGCCTG CGCCTGTACG ACTCCAAGAC CCTCACTTCC AAAGCCAGGC
CCAAAGCCCT GAGACCAGAA GACTTCAAAC CCTGGTTCTT GGGCCTAACT CCAAAGACCC TGGATCTCAA
ATTCCAACTT CTAGCTCTGA GACTCCAGCC CTCACCCATG AGTTCCTGAA CTTGAACCCA GAGACCCCAT
CTCTAAGACT TCAGCCTTGA GATCCAGGGC CTGACCCTAG ACTCGAGCCC ACAGACCTCA GATACTGTCT
GTAAAACCCC AGCTCTGGTG GGGAGCAGTG GCTCACTCCT GTAATCCCAA GGCAGGGGAG GCCAAGGCAG
AAGGACCTCT TGAGGCCATG AGTTTGAGAC AGCCTGGGCA GCATAGCAAG ACTCTGTTTC TTAATTATTA
TTATTATTAT TATTTTTTGG AGACAGAGTC TCGCGCTCTG TTGCCCAGGC TAGAGTGCAA TGGTGCCATT
TCGGCTTGCT GGAACCTCCG CCTCCTGGGC TCAAGCGATT CTCCTGCCTC AGCCTCCTGA GTAGCTGGGA
CTTCAGGTGC ACACTGCCAC ACCCGGATAA TTTTTTTGTA TTTTAGTAGA CACGGGTTT CACCGTGTTG
CCCAGGCTGG TCACAAACTC CTGAGCTCAG GCCATCCGCC CGCCTCGGCC TCCCAAAGCG CTGGGATAAC
AGGCGTGACG CCGCGCCTGG CTTCTTAATT GTTCTAACAG CAGCGACAAC AACAAAAACC CAGCTCTGAG
ATTCCAGCCC CGGCGACTCT AACAGTCCCA GGCCCGATCC CTCACCTAGA ACCGAGATGC CAGCCCTGAC
TCCACAGACT TCACCCCCAA CCCCCACACT CAGCTCTGGA AGCCCGTCCT GACTCCAGCC TCCATTTTCG
GAACCCCACA GCCTGAAGAG CTCCCGGCCT AAACACTTCA CCCCACGCGC CACAGTCCCC CTGTGAATAT
GCAGCCCCGA TTCAGCTGCA GCTCCACAGC ACCCCTGCCC TGCACCCCCG CTGCACCCCC TACCTGTGAC
TCACCTCTCT CCTCTCCCCA CAGATGTCCC GCCTGGCCCT GCCCCAGCCA CCCCCGGACC CGCCGGCGCC
CCCGCTGGCG CCCCCCTCCT CAGCCTGGGG GGGCATCAGG GCCGCCCACG CCATCCTGGG GGGGCTGCAC
CTGACACTTG ACTGGGCCGT GAGGGGACTG CTGCTGCTGA AGACTCGGCT GTGACCCGGG CCCAAAGCC
ACCACCGTCC TTCCAAAGCC AGATCTTATT TATTTATTTA TTTCAGTACT GGGGGCGAAA CAGCCAGGTG
ATCCCCCGC CATTATCTCC CCCTAGTTAG AGACAGTCCT TCCGTGAGGC CTGGGGGCA TCTGTGCCTT
ATTTATACTT ATTTATTTCA GGAGCAGGGG TGGGAGGCAG GTGGACTCCT GGGTCCCCGA GGAGGAGGGG
ACTGGGGTCC CGGATTCTTG GGTCTCCAAG AAGTCTGTCC ACAGACTTCT GCCCTGGCTC TTCCCCATCT
AGGCCTGGGC AGGAACATAT ATTATTTATT TAAGCAATTA CTTTTCATGT TGGGGTGGGG ACGGAGGGGA
AAGGGAAGCC TGGGTTTTTG TACAAAAATG TGAGAAACCT TTGTGAGACA GAGAACAGGG AATTAAATGT
GTCATACATA TCCACTTGAG GGCGATTTGT CTGAGAGCTG GGGCTGGATG CTTGGGTAAC TGGGGCAGGG
CAGGTGGAGG GGAGACCTCC ATTCAGGTGG AGGTCCCGAG TGGGCGGGGC AGCGACTGGG AGATGGGTCG
GTCACCCAGA CAGCTCTGTG GAGGCAGGGT CTGAGCCTTG CCTGGGGCCC CGCACTGCAT AGGGCCGTTT
GTTTGTTTTT TGAGATGGAG TCTCGCTCTG TTGCCTAGGC TGGAGTGCAG TGAGGCAATC TAAGGTCACT
GCAACCTCCA CCTCCCGGGT TCAAGCAATT CTCCTGCCTC AGCCTCCCGA TTAGCTGGGA TCACAGGTGT
GCACCACCAT GCCCAGCTAA TTATTTATTT CTTTTGTATT TTTAGTAGAG ACAGGGTTTC ACCATGTTGG
CCAGGCTGGT TTCGAACTCC TGACCTCAGG TGATCCTCCT GCCTCGGCCT CCCAAAGTGC TGGGATTACA
```

-continued

GGTGTGAGCC ACCACACCTG ACCCATAGGT CTTCAATAAA TATTTAATGG AAGGTTCCAC AAGTCACCCT

GTGATCAACA GTACCCGTAT GGGACAAAGC TGCAAGGTCA AGATGGTTCA TTATGGCTGT GTTCACCATA

GCAAACTGGA AACAATCTAG ATATCCAACA GTGAGGGTTA AGCAACATGG TGCATCTGTG GATAGAACGC

CACCCAGCCG CCCGGAGCAG GGACTGTCAT TCAGGGAGGC TAAGGAGAGA GGCTTGCTTG GGATATAGAA

AGATATCCTG ACATTGGCCA GGCATGGTGG CTCACGCCTG TAATCCTGGC ACTTTGGGAG GACGAAGCGA

GTGGATCACT GAAGTCCAAG AGTTTGAGAC CGGCCTGCGA GACATGGCAA AACCCTGTCT CAAAAAAGAA

AGAATGATGT CCTGACATGA AACAGCAGGC TACAAAACCA CTGCATGCTG TGATCCCAAT TTTGTGTTTT

TCTTTCTATA TATGGATTAA AACAAAAATC CTAAAGGGAA ATACGCCAAA ATGTTGACAA TGACTGTCTC

CAGGTCAAAG GAGAGAGGTG GGATTGTGGG TGACTTTTAA TGTGTATGAT TGTCTGTATT TTACAGAATT

TCTGCCATGA CTGTGTATTT TGCATGACAC ATTTTAAAAA TAATAAACAC TATTTTTAGA ATAACAGAAT

ATCAGCCTCC TCCTCTCCAA AAATAAGCCC TCAGGAGGGG ACAAAGTTGA CCGCTGATTG AGCCTGTCAG

GGCTGTGCAC-3' (FRAG. NO: _ ) (SEQ. ID NO: 2522)

Human GM-CSF Nucleic Acid and Antisense Oligonucleotide Fragments

5'-CTTGBGCBGG BBGCTCTGGG GCBGGGBGCT GGCBGGGCCC BGGGGGGTGG CTTCCTGCBC TGTCCBGBGT

GCBCTGTGCC BCBGCBGCBG CTGCBGGGCC BTCBGCTTCB TGGGGCTCTG GGTGGCBGGT CCBGCCBTGG

GTCTGGGTGG GGCTGGGCTG CBGGCTCCGG GCGGTCCBGCCBTGGGTCTG GGGGCTGGG CTGCBGGGCTC

CGGGCGGGCG GGTGCGGGCT GCGTGCTGGG GGCTGCCCCG CAGGCCCTGC GGTCCBGCCB TGGGTCTGGG

GGCTGGGCTG CBGGCTCCGG GCGGGCGGGT GCGGGCTGCG TGCTGGGGGC TGCCCCGCAG GCCCTGC-3' (FRAG.

NO: 1847) (SEQ. ID NO: 1860)

5'-GBGCBGG BBG-3' (FRAG. NO: 1848) (SEQ. ID NO: 1861)

5'-GCCBCBGCBGCBGC-3' (FRAG. NO: 1849) (SEQ. ID NO: 1862)

5'-GGG TGC GGG C-3' (FRAG. NO: 1850) (SEQ. ID NO: 1863)

5'-GGT CCB GCC BTG GGT CTG GG-3' (FRAG. NO: 1300) (SEQ. ID NO: 1309)

5'-GGC TGG GCT GCB GGC TCC GG-3' (FRAG. NO: 1301) (SEQ. ID NO: 1310)

5'-GCG GGC GGG TGC GGG CTG CGT GCT GGG-3' (FRAG. NO: 1302) (SEQ. ID NO: 1311)

5'-GGC TGC CCC GCA GGC CCT GC-3' (FRAG. NO: 1303) (SEQ. ID NO: 1312)

5'-CTTGBGCBGG BBGCTCTGGG GCBGGGBGCT GGCBGGGCCC BGGGGGGTGG CTTCCTGCBC TGTCCBGBGT

GCBCTGTGCC BCBGCBGCBG CTGCBGGGCC BTCBGCTTCB TGGGGCTCTG GGTGGCBGGT CCBGCCBTGG

GTCTGGGTGG GGCTGGGCTG CBGGCTCCGG GC-3' (FRAG. NO: 1851) (SEQ. ID NO: 1864)

Human Tumor Necrosis Factor α Antisense Oligonucleotide Fragments

5'-GCBCGCCTG GBGCCCTGGG GCCCCCCTGT CTTCTTGGGG BGCGCCTCCT CGGCCBGCTC CBCGTCCCGG

BTCBTGCTTT CBGTGCTCBT GGTGTCCTTT CCBGGGGBGB GBGGGGCTGG TCCTCTGCTG TCCTTGCTGG

TGCTCBTGGT GTCCTTTCCG CCCTGGGGCC CCCCTGTCTT CTTGGGGCCT CTTCCCTCTG GGGGCCGTCT

CTCTCCCTCT CTTGCGTCTC TCTCTTTCTC TCTCTCTCTT CCCCTTTCCC GCTCTTTCTG TCTCGGTGTC

TGGTTTTCTC TCTCCGCTGG CTGCCTGTCT GGCCTGCGCT CTTGGCCTGT GCTGTTCCTC CTCCGGTTCC

TGTCCTCTCT GTCTGTCGCC CCCTCTGGGG TCTCCCTCTG GGTGGTGGTC TTGTTGCTTG GCTGGGCTC

CGTGTCTCCB GTGCTCBTGG TGTCCGCTGB GGGBGCGTCT GCTGGCGCTG GTCCTCTGCTGTC CTTGCTGGTG

CTCBTGGTGT CCTTTCCGCC CTGGGGCCCC CCTGTCTTCT TGGGGCCTCT TCCCTCTGGG GGCCGTCTC

TCTCCCTCTC TTGCGTCTCT CTCTTTCTCT CTCTCTTC CCCTTTCCCG CTCTTTCTGT CTCGGTGTCT

GGTTTTCTCT CTCCGCTGGC TGCCTGTCTG GCCTGCGCTC TTGGCCTGTG CTGTTCCTCC TCCGGTTCCT

-continued

GTCCTCTCTG TCTGTCGCCC CCTCTGGGGT CTCCCTCTGG CGTGGTGGTC TTGTTGCTTG GGCTGGGCTC

CGTGTCTCCB GTGCTCBTGG TGTCCGCTGB GGGBGCGTCT GCTGGC-3' (FRAG. NO: 1852) (SEQ. ID NO: 1865)

5'-GGGGCCCCCC-3' (FRAG. NO: 1853) (SEQ. ID NO: 1866)

5'-GGG GGC CG TCT-3' (FRAG. NO: 1854) (SEQ. ID NO: 1867)

5'-CCBGGGGBGB GBGGGGCTGG-3' (FRAG. NO: 1855) (SEQ. ID NO: 1868)

5'-GCBCCGCCTG GBGCCCTGGG GCCCCCCTGT CTTCTTGGGG BGCGCCTCCT CGGCCBGCTC CBCGTCCCGG

BTCBTGCTTT CBGTGCTCBT GGTGTCCTTT CCBGGGGBGB GBGGG-3' (FRAG. NO: 1304) (SEQ. ID NO: 1313)

5'-GCT GGT CCT CTG CTG TCC TTG CTG GTG CTC BTG GTG TCC TTT CC GCC CTG GGG CCC CCC TGT CTT CTT

GGG G CCT CTT CCC TCT GGG GGC CG TCT CTC TCC CTC TCT TGC GTC TCT C TCT TTC TCT CTC TCT CTT CCC

C TTT CCC GCT CTT TCT GTC TC GGT GTC TGG TTT TCT CTC TCC GCT GGC TGC CTG TCT GGC CTG CGC TCT T

GGC CTG TGC TGT TCC TCC TCC GGT TCC TGT CCT CTC TGT CTG TC GCC CCC TCT GGG GTC TCC CTC TGG C

GTG GTG GTC TTG TTG CTT GGG CTG GGC TCC GTG TCT C CBG TGC TCB TGG TGT CC-3' (FRAG. NO: 1305)

(SEQ. ID NO: 1314)

5'-GCT GBG GGB GCG TCT GCT GGC GCT GGT CCT CTG CTG TCC TTG CTG GTG CTC BTG GTG TCC TTT CC GCC

CTG GGG CCC CCC TGT CTT CTT GGG G CCT CTT CCC TCT GGG GGC CG TCT CTC TCC CTC TCT TGC GTC TCT

C TCT TTC TCT CTC TCT CTT CCC C TTT CCC GCT CTT TCT GTC TC GGT GTC TGG TTT TCT CTC TCC GCT GGC

TGC CTG TCT GGC CTG CGC TCT T GGC CTG TGC TGT TCC TCC TCC GGT TCC TGT CCT CTC TGT CTG TC GCC

CCC TCT GGG GTC TCC CTC TGG C GTG GTG GTC TTG TTG CTT GGG CTG GGC TCC GTG TCT C CBG TGC TCB

TGG TGT CC GCT GBG GGB GCG TCT GCT GGC-3' (FRAG. NO: 1306) (SEQ. ID NO: 1315)

5'-GCT GGT CCT CTG CTG TCC TTG CTG-3' (FRAG. NO: 1655) (SEQ. ID NO: 1664)

5'-GTG CTC BTG GTG TCC TTT CC-3' (FRAG. NO: 1656) (SEQ. ID NO: 1665)

5'-GCC CTG GGG CCC CCC TGT CTT CTT GGG G-3' (FRAG. NO: 1657) (SEQ. ID NO: 1666)

5'-CCT CTT CCC TCT GGG GGC CG-3' (FRAG. NO: 1658) (SEQ. ID NO: 1667)

5'-TCT CTC TCC CTC TCT TGC GTC TCT C-3' (FRAG. NO: 1659) (SEQ. ID NO: 1668)

5'-TCT TTC TCT CTC TCT CTT CCC C-3' (FRAG. NO: 1660) (SEQ. ID NO: 1669)

5'-TTT CCC GCT CTT TCT GTC TC-3' (FRAG. NO: 1661) (SEQ. ID NO: 1670)

5'-GGT GTC TGG TTT TCT CTC TCC-3' (FRAG. NO: 1662) (SEQ. ID NO: 1671)

5'-GCT GGC TGC CTG TCT GGC CTG CGC TCT T-3' (FRAG. NO: 1663) (SEQ. ID NO: 1672)

5'-GGC CTG TGC TGT TCC TCC-3' (FRAG. NO: 1664) (SEQ. ID NO: 1673)

5'-TCC GGT TCC TGT CCT CTC TGT CTG TC-3' (FRAG. NO: 1665) (SEQ. ID NO: 1674)

5'-GCC CCC TCT GGG GTC TCC CTC TGG C-3' (FRAG. NO: 1666) (SEQ. ID NO: 1675)

5'-GTG GTG GTC TTG TTG CTT-3' (FRAG. NO: 1667) (SEQ. ID NO: 1676)

5'-GGG CTG GGC TCC GTG TCT C-3' (FRAG. NO: 1668) (SEQ. ID NO: 1677)

5'-CBG TGC TCB TGG TGT CC-3' (FRAG. NO: 1669) (SEQ. ID NO: 1678)

5'GCT GBG GGB GCG TCT GCT GGC-3' (FRAG. NO: 1670) (SEQ. ID NO: 1679)

Human Leukotriene C4 Synthase Nucleic Acids and Antisense Oligonucleotide Fragments

5'-CTCGGTBGBC GCGCTCGBBC TCGGGTGGGC CGGTGGTGBG CGGCGGCGBCB CGCGGBBGGC CCTGCGCGCC

GBGBTCBCCTG CBGGGBGBBG TBGGCTTGCB GCGGGCTCC CBGGBGGGTG BCBGCBGCCB GTBGBGCTBC

CTCGTCCTTC BTGGTBCCGT CGGTGTGGTG GCBCGGGCT TGTGTGBBGG CGBGCTGGGC CCCGTCTGCT

GCTCCTCGTG CCGCCTCGTC CTTCA TGG TA CCGTCGGTGT GGTGGCCTCG GGTGGGCCGG TGGTGGGGCG

CGCGCGCTCG CGTGGCTCCG GCTCTTCTTT CCCGGCTCCGT CGGCCCGGGG GCCTTGGTCT CCCTCGTCCT

TCBTGGTBCC G-3' (FRAG. NO: 1856) (SEQ. ID NO: 1869)

5'-GCB GCBGGBC-3' (FRAG. NO: 1857) (SEQ. ID NO: 1870)

5'-CCCGGCTCCG-3' (FRAG. NO: 1858) (SEQ. ID NO: 1871)

5'-CGGCCCGGGG GCC-3' (FRAG. NO: 1859) (SEQ. ID NO: 1872)

5'-CB CGCGG-3' (FRAG. NO: 1860) (SEQ. ID NO: 1873)

5'-GCC CCG TCT GCT GCT CCT CGT GCC G-3' (FRAG. NO: 1307) (SEQ. ID NO: 1316)

5'-CCT CGT CCT TCA TGG TAC CGT CGG TGT GGT GGC-3' (FRAG. NO: 1308) (SEQ. ID NO: 1317)

5'-CTC GGG TGG GCC GGT GGT G-3' (FRAG. NO: 1309) (SEQ. ID NO: 1318)

5'-GGG CGC GCG CGC TCG CGT-3' (FRAG. NO: 1310) (SEQ. ID NO: 1319)

5'-GGC TCC GGC TCT TCT TTC CCG GCT CCG TCG GCC CGG GGG CCT GGG TCT C-3' (FRAG. NO: 1311) (SEQ. ID NO: 1320)

5'-CCT CGT CCT TCB TGG TBC CG-3' (FRAG. NO: 1312) (SEQ. ID NO: 1321)

5'-CTCGGTBGBC GCGCTCGBBC TCGGGTGGGC CGGTGGTGBG CGGCGGCGBCB CGCGGBBGGC CCTGCGCGCC

GBGBTCBCCTG CBGGGBGBBG TBGGCTTGCB GCBGGBCTCC CBGGBGGGTG BCBGCBGCCB GTBGBGCTBC

CTCGTCCTTC BTGGTBCCGT CGGTGTGGTG GCBCGGGCTG TGTGTGBBGG CGBGCTGG-3' (FRAG. NO: 1861)

(SEQ. ID NO: 1874)

Human Endothelin-1 Nucleic Acids and Antisense Oligonucleotide Fragments

5'-BCCGGCGGBG CCGCCBGGGT GGBCTGGGBG TGGGTTTCTC CCCGCCGTTC TCBCCCBCCG CGCTGBGCTC

BGCGCCTBBG BCTGCTGTTT CTGGBGCTCC TTGGCBBGCC BCBBBCBGCB GBGBGBBBBT CBTGBGCBBB

TBBTCCBTTC TGBBBBBBBG GGBTCBBBBB CCTCCCGTTC CCCGTTCGCC TGGCGCGCGC TGCGGGTTCC

TCGTGGGTTT CTCCCCGCCG TTCTCCGGTC TGTTGCCTTT GTGGGCTTCT TGTCTTTTTG GCTGTTCTTT

TCCTGCTTGG CGTCTTTTCC TTTCTTTGTG CTCGGTTGTG GGTCCGCTGG TCCTTTGCCC TGTGTGTTTC

TGCTGCCCGT TCGCCTGGCG CGCGCTGCGG GTTCCTCGTG GGTTTCTCCC CGCCGTTCTC CGGTCTGTTG

CCTTTGTGGG CTTCTTGTCT TTTTGGCTGT TCTTTTCCTG CTTGGCGTCT TTTCCTTTCT TTGTGCTCGG

TTGTGGGTCC GCTGGTCCTT TGCCCTGTGT GTTTCTGCTG-3' (FRAG. NO: 1862) (SEQ. ID NO: 1875)

5'-CCGGCGGBG CCGCCBGGGT GGBC-3' (FRAG. NO: 1863) (SEQ. ID NO: 1876)

5'-CCGCCBGGG-3' (FRAG. NO: 1864) (SEQ. ID NO: 1877)

5'-GGCGCGCGC-3' (FRAG. NO: 1865) (SEQ. ID NO: 1878)

5'-GTGGGTCCGC-3' (FRAG. NO: 1866) (SEQ. ID NO: 1879)

5'-CCCGTTCGCCTGGCGC-3' (FRAG. NO: 1313) (SEQ. ID NO: 1322)

5'-GCGCTGCGGGTTCCTC-3' (FRAG. NO: 1314) (SEQ. ID NO: 1323)

5'-GTGGGTTTCTCCCCGCCGTTCTC-3' (FRAG. NO: 1315) (SEQ. ID NO: 1324)

5'-CGGTCTGTTGCCTTTGTGGG-3' (FRAG. NO: 1316) (SEQ. ID NO: 1325)

5'-CTTCTTGTCTTTTTGGCT-3' (FRAG. NO: 1317) (SEQ. ID NO: 1326)

5'-GTTCTTTTCCTGCTTGGC-3' (FRAG. NO: 1318) (SEQ. ID NO: 1327)

5'-GTCTTTTCCTTTCTT-3' (FRAG. NO: 1319) (SEQ. ID NO: 1328)

5'-TGTGCTCGGTTGTGGGTC-3' (FRAG. NO: 1320) (SEQ. ID NO: 1329)

5'-CGCTGGTCCTTTGCC-3' (FRAG. NO: 1321) (SEQ. ID NO: 1330)

-continued

5'-CTGTGTGTTTCTGCTG-3' (FRAG. NO: 1322) (SEQ. ID NO: 1331)

5'-CCCGTTCGCCTGCCGC-3' (FRAG. NO: 1323) (SEQ. ID NO: 1332)

5'-GCGCTGCGGGTTCCTC-3' (FRAG. NO: 1324) (SEQ. ID NO: 1333)

5'-GTGGGTTTCTCCCCGCCGTTCTC-3' (FRAG. NO: 1325) (SEQ. ID NO: 1334)

5'-CGGTCTGTTGCCTTTGTGGG-3' (FRAG. NO: 1326) (SEQ. ID NO: 1335)

5'-CTTCTTGTCTTTTTGGCT-3' (FRAG. NO: 1327) (SEQ. ID NO: 1336)

5'-GTTCTTTTCCTGCTTGGC-3' (FRAG. NO: 1328) (SEQ. ID NO: 1337)

5'-GTCTTTTCCTTTCTT-3' (FRAG. NO: 1329) (SEQ. ID NO: 1338)

5'-TGTGCTCGGTTGTGGGTC-3' (FRAG. NO: 1330) (SEQ. ID NO: 1339)

5'-CGCTGGTCCTTTGCC-3' (FRAG. NO: 1331) (SEQ. ID NO: 1340)

5'-CTGTGTGTTTCTGCTG-3' (FRAG. NO: 1332) (SEQ. ID NO: 1341)

Endothelin Receptor ET-B Nucleic Acids and Antisense Oligonucleotide Fragments

5'-GCCCTGTCGG GCGGGAAGCC TCTCTCCTCT CCCCAGATC CGCGACAGGC CGCAGGCAAG AACCAGCGCA

ACCAGGGCGC GTCCGCACAG ACTTGGAGGC GGCTGCATGC TGCTACCTGC TCCAGAAGCG TCCGGTGGCC

GCCGCGCC CTGTCGGGCG GGBBGCCTCT CTCCTCTCCC CBGBTCCGCG BCBGGCCGCB GGCBBGBBCC

BGCGCBBCCB GGGCGCGTCC GCBCBGBCTT GGBGGCGGCT GCBTGCTGCT BCCTGCTCGGGCG GGBBGCCTCCG

GTGGCCGCCG CGCGTCCGGT GGCCGCCGCG CCTCTCTCCT CTCCCCGTGG CCCTGTCGGG CGGGTCCTGC

CGTCCTGTCT CCTTTTCTTT TGCTGTCTTG TCTTCCCGTC TCTGCTTT-3' (FRAG. NO: 1867) (SEQ. ID NO: 1880)

5'-CGGGCG GGBBGCC-3' (FRAG. NO: 1868) (SEQ. ID NO: 1881)

5'-CGGGCGGG-3' (FRAG. NO: 1869) (SEQ. ID NO: 1882)

5'-CCGCBCBGBC-3' (FRAG. NO: 1870) (SEQ. ID NO: 1883)

5'-GCGTCCGGTGGCCGCCGC-3' (FRAG. NO: 1333) (SEQ. ID NO: 1342)

5'-GCCTCTCTCCTCTCCCC-3' (FRAG. NO: 1334) (SEQ. ID NO: 1343)

5'-GTGGCCCTGTCGGGCGGG-3' (FRAG. NO: 1335) (SEQ. ID NO: 1344)

5'-TCCTGCCGTCCTGTCTCCTTT-3' (FRAG. NO: 1336) (SEQ. ID NO: 1345)

5'-TCTTTTGCTGTCTTGT-3' (FRAG. NO: 1337) (SEQ. ID NO: 1346)

5'-CTTCCCGTCTCTGCTTT-3' (FRAG. NO: 1338) (SEQ. ID NO: 1347)

5'-GCCCTGTCGG GCGGGAAGCC TCTCTCCTCT CCCCAGATC CGCGACAGGC CGCAGGCAAG AACCAGCGCA

ACCAGGGCGC GTCCGCACAG ACTTGGAGGC GGCTGCATGC TGCTACCTGC TCCAGAAGCG TCCGGTGGCC

GCCGC-3' (FRAG. NO: 1871) (SEQ. ID NO: 1884)

5'-GCCCTGTCGG GCGGGBBGCC TCTCTCCTCT CCCCBGTCC GCGBCBGGCC GCBGGCBBGB BCCBGCGCB

BCCBGGGCGC GTCCGCBCBG BCTTGGBGGC GGCTGCBTGC TGCTBCCTGC TCCBGBBGCG TCCGGTGGCC GCCGC-

3' (FRAG. NO: 1872) (SEQ. ID NO: 1885)

Endothelin ETA Receptor Nucleic Acids and Antisense Oligonucleotide Fragments

5'-GTCTGTCCTC CCCGTCTCCT CCCACTGCTT CTCCCGGGGG CTTCCCCGGC TTCGGGTGGC CGGTGTCCCG

GGCTCCGGCG CGGCGGCGGC TTCGGCTGCG GGTGGGTGGC GCGGGCTGCC GGGTCCGCGC GGCGCCTGGG

CCCTTGTGCT GCTTTTTGCT TGTTCCGTTC TGGCTGCTCC GGTCTGTGTT GTGGTTGTTT TGTTTCTTCT

TGGGTGTGGG CCTTGCGGTT TTGGCTGTGG GCCCTTTGGG GCCTTGGCTT CTGGCTCGTC TGTCCTCCCC

GTCTCCTCCC ACTCCTTCT CCCGGGGGCT TCCCCGGCTT CGGGTGGCCG GTGTCCCGGG CTCCGGCGCG

GCGGCGGCTT CGGCTGCGGG TGGGTGGCGC GGGCTGCCGG GTCCGCGCGG CGCCTGGGCC CTTGTGCTGC

TTTTTGCTTG TTCCGTTCTG GCTGCTCCGG TCTGTGTTGT GGTTGTTTTG TTTCTTCTTG GGTGTGGGCC

TTGCGGTTTT GGCTGTGGGC CCTTTGGGGC CTTGGCTTCT GGCTCCAT CCACATGATT GCTTAGATTT

GTGCTGTATC TCTCAGGATT ATCACTGATT ACACATCCAA CCAGTGCCAG CCAAAAGGAT GCCCTGAGGC

AAAGGGTTTC CATCTTGAGG CAAATTTGAG GACBTCCBC BTGBTTGCTT BGBTTTGTGC TGTBTCTCTC

BGGBTTBTCB CTGBTTBCBC BTCCBBCCBG TGCCBGCCBB BBGGBTGCCC TGBGGCBBBG GGTTTCCBTC

TTGBGGCBBB TTTGBGGB-3' (FRAG. NO: 1873) (SEQ. ID NO: 1886)

5'-GBGGCBBBGGG-3' (FRAG. NO: 1874) (SEQ. ID NO: 1887)

5'-GCCBGCCBB BBGGB-3' (FRAG. NO: 1875) (SEQ. ID NO: 1888)

5'-CGCCTGGGCC C-3' (FRAG. NO: 1876) (SEQ. ID NO: 1889)

5'-GTCTGTCCTCCCCGTCTCCTCCC-3' (FRAG. NO: 1339) (SEQ. ID NO: 1348)

5'-ACTGCTTCTCCCGCGG-3' (FRAG. NO: 1340) (SEQ. ID NO: 1349)

5'-GCTTCCCCGGCTTC-3' (FRAG. NO: 1341) (SEQ. ID NO: 1350)

5'-GGGTGGCCGGTGTCCCGGGCTCCGGCGCGGCGGC-3' (FRAG. NO: 1342) (SEQ. ID NO: 1351)

5'-GGCTTCGGCTGC-3' (FRAG. NO: 1343) (SEQ. ID NO: 1352)

5'-GGGTGGGTGGCGCGG-3' (FRAG. NO: 1344)(SEQ. ID NO: 1353)

5'-GCTGCCGGGTCCGCGCGGCGCCTGGGCC-3' (FRAG. NO: 1345) (SEQ. ID NO: 1354)

5'-CTTGTGCTGCTTTT-3' (FRAG. NO: 1346) (SEQ. ID NO: 1355)

5'-TGCTTGTTCCGTTC-3' (FRAG. NO: 1347) (SEQ. ID NO: 1356)

5'-TGGCTGCTCCGGTCTGTGTTGTGGTTGTTTTG-3' (FRAG. NO: 1348) (SEQ. ID NO: 1357)

5'-TTTCTTCTTGGGTGTGGG-3' (FRAG. NO: 1349) (SEQ. ID NO: 1358)

5'-CCTTGCGGTTTTGG-3' (FRAG. NO: 1350) (SEQ. ID NO: 1359)

5'-CTGTGGGCCCTTTG-3' (FRAG. NO: 1351) (SEQ. ID NO: 1360)

5'-GGGCCTTGGCTTCTGGCTC-3' (FRAG. NO: 1352) (SEQ. ID NO: 1361)

5'-CATCCACATG ATTGCTTAGA TTTGTGCTGT ATCTCTCAGG ATTATACTG ATTACACATC CAACCAGTGC

CAGCCAAAAG GATCCCCTGA GGCAAAGGGT TTCCATCTTG AGGCAAATTT GAGGA-3' (FRAG. NO: 1353)

(SEQ. ID NO: 1362)

5'-CBTCCBCBTG BTTGCTTBGB TTTGTGCTGT BTCTCTCBGG BTTBTCBCTG BTTBCBCBTC CBBCCBGTGC

CBGCCBBBBG GBTGCCCTGB GGCBBBGGGT TTCCBTCTTG BGGCBBBTTT GBGGB-3' (FRAG. NO: 1354) (SEQ. ID NO: 1363)

Endothelin Receptor A Nucleic Acid and Antisense Oligonucleotide Fragments

5'-GCCACCATGG AAACCCTTTG CCTCAGGGCA TCCTTTTGGC TGGCACTGGT TGGATGTGTA ATCAGTGATA

ATCCTGAGAG ATACAGCACA AATCTAAGCA ATCATGTGGA TGATTCACC ACTTTTCGTG GCACAGAGCT

CAGCTTCCTG GTTACCACTC ATCAACCCAC TAATTTGGTC CTACCCAGCA ATGGCTCAAT GCACAACTAT

TGCCCACAGC AGACTAAAAT TACTTCAGCT TTCAAATACA TTAACACTGT GATATCTTGT ACTATTTTCA

TCGTGGGAAT GGTGGGGAAT GCAACTCTGC TCAGGATCAT TTACCAGAAC AAATGTATGA GGAATGGCCC

CAACGCGCTG ATAGCCAGTC TTGCCCTTGG AGACCTTATC TATGTGGTCA TTGATCTCCC TATCAATGTA

TGGCTGGGCG CTGGCCTTTT GATCACAATG ACTTTGGCGT ATTTCTTTGC AAGCTGTTCC CCTTTTTGCA

GAAGTCCTCG GTGGGATCA CCGTCCTCAA CCTCTGCGCT CTTAGTGTTG ACAGGTACAG AGCAGTTGCC

TCCTGGAGTC GTGTTCAGGG AATTGGGATT CCTTTGGTAA CTGCCATTGA AATTGCCTCC ATCTGGATCC

TGTCCTTTAT CCTGGCCATT CCTGAAGCGA TTGGCTTCGT CATGGTACCC TTTGAATATA GGGGTGGACA

-continued

```
GCATAAAACC TGTATGCTCA ATGCCACATC AAAATTCATG GAGTTCTACC AAGATGTAAA GGACTGGTGG

CTCTTCGGGT TCTATTTCTG TATGCCCTTG GTGTGCACTG CGATCTTCTA CACCCTCATG ACTGGTGAGA

TGTTGAACAG AAGGAATGGC AGCTTGAGAA TTGCCCTCAG TGAACATCTT AAGCAGCGTC GAGAAGTGGC

AAAAACAGTT TTCTGCTTGG TTGTAATTTT TGCTCTTTGC TGGTTCCCTC TTCATTTAAG CCGTATATTG

AAGAAAACTG TGTATAACGA GATGGACAAG AACCGATGTG AATTACTTAG TTTCTTACTG CTCATGGATT

ACATCGGTAT TAACTTGGCA ACCATGAATT CATGTATAAA CCCCATAGCT CTGTATTTTG TGAGCAAGAA

ATTTAAAAAT TGTTTCCAGT CATGCCTCTG CTGCTGCTGT TACCAGTCCA AAAGTCTGAT GACCTCGGTC

CCCATGAACG GAACAAGCAT CCAGTGGAAG AACCACGATC AAAACAACCA CAACACAGAC CGGAGCAGCC

ATAAGGACAG CATGAACTGA CCACCCTTAG AAGCACTCCT GAATTCGGGA AAAAGTGAAG GTGTAAAAGC

AGCACAAGTG CAATAAGAGA TATTTCCTCA AATTTGCCTC AAGATGGAAA CCCTTTGCCT CAGGGCATCC

TTTTGGCTGG CACTGGTTGG ATGTGTAATC AGTGATAATC CTGAGAGATA CAGCACAAAT CTAAGCAATC

ATGTGGATGA TTTCACCACT TTTCGTGGCA CAGAGCTCAG CTTCCTGGTT ACCACTCATC AACCCACTAA

TTTGGTCCTA CCCAGCAATG GCTCAATGCA CAACTATTGC CCACAGCAGA CTAAAATTAC TTCAGCTTTC

AAATACATTA ACACTGTGAT ATCTTGTACT ATTTTCATCG TGGGAATGGT GGGGAATGCA ACTCTGCTCA

GGATCATTTA CCACAACAAA TGTATGAGGA ATGGCCCCAA CGCGCTGATA GCCAGTCTTG CCCTTGGAGA

CCTTATCTAT GTGCTCATTG ATCTCCCTAT CAATGTATTT AAGCTGCTGG CTGGGCGCTG GCCTTTTGAT

CACAATGACT TTGGCGTATT TCTTTGCAAG CTGTTCCCCT TTTTGCAGAA GTCCTCGGTG GGGATCACCG

TCCTCAACCT CTGCGCTCTT AGTGTTGACA GGTACAGAGC AGTTGCCTCC TGGAGTCGTG TTCAGGGAAT

TGGGATTCCT TTGCTAACTG CCATTGAAAT TGTCTCCATC TGGATCCTGT CCTTTATCCT GGCCATTCCT

GAAGCGATTG GCTTCGTCAT GGTACCCTTT GAATATAGGG GTGAACAGCA TAAAACCTGT ATGCTCAATG

CCACATCAAA ATTCATGGAG TTCTACCAAG ATGTAAAGGA CTGGTGGCTC TTCGGGTTCT ATTTCTGTAT

GCCCTTGGTG TGCACTGCGA TCTTCTACAC CCTCATGACT TGTGAGATGT TGAACAGAAG GAATGGCAGC

TTGAGAATTG CCCTCAGTGA ACATCTTAAG CAGCGTCGAG AAGTGGCAAA ACAGTTTTC TGCTTGGTTG

TAATTTTTGC TCTTTGCTGG TTCCCTCTTC ATTTAAGCCG TATATTGAAG AAAACTGTGT ATAACGAGAT

GGACAAGAAC CGATGTGAAT TACTTAGTTT CTTACTGCTC ATGGATTACA TCGGTATTAA CTTGGCAACC

ATGAATTCAT GTATAAACCC CATAGCTCTG TATTTTGTGA GCAAGAAATT TAAAAATTGT TTCCAGTCAT

GCCTCTGCTG CTGCTGTTAC CAGTCCAAAA GTCTGATGAC CTCGGTCCCC ATGAACGGAA CAAGCATCCA

GTGGAAGAAC CACGATCAAA ACAACCACAA CACAGACCGG AGCAGCCATA AGGACAGCAT GAACTGACCA

CCCTTAGAAG CACTCCTCGG TACTCCCATA ATCCTCTCGG AGAAAAAAT CACAAGGCAA CTGTGAGTCC

GGGAATCTCT TCTCTGATCC TTCTTCCTTA ATTCACTCCC ACACCAAGA AGAAATGCTT TCCAAAACCG

CAAGGGTAGA CTGGTTTATC CACCCACAAC ATCTACGAAT CGTACTTCTT TAATTGATCT AATTTACATA

TTCTGCGTGT TGTATTCAGC ACTAAAAAAT GGTGGGAGCT GGGGGAGAAT GAAGACTGTT AAATGAAACC

AGAAGGATAT TTACTACTTT TGCATGAAAA TAGAGCTTTC AAGTACATGG CTAGCTTTTA TGGCAGTTCT

GGTGAATGTT CAATGGGAAC TGGTCACCAT GAAACTTTAG AGATTAACGA CAAGATTTTG TACTTTTTTT

AAGTGATTTT TTTGTCCTTC AGCCAAACAC AATATGGGCT CAAGTCACTT TTATTTGAAA TGTCATTTGG

TGCCAGTATC CCGAATTC GAATTCGGGA AAAAGTGAAG GTGTAAAAGC AGCACAAGTG CAATAAGAGA

TATTTCCTCA AATTTGCCTC AAGATGGAAA CCCTTTGCCT CAGGGCATCC TTTTGGCTGG CACTGGTTGG

ATGTGTAATC AGTCATAATC CTGAGAGATA CAGCACAAAT CTAAGCAATC ATGTGGATGA TTTCACCACT

TTTCGTGGCA CAGTGCTCAG CTTCCTGGTT ACCACTCATC AACCCACTAA TTTGGTCCTA CCCAGCAATG
```

-continued

```
GCTCAATGCA CAACTATTGC CCACAGCAGA CTAAAATTAC TTCAGCTTTC AAATACATTA ACACTGTGAT
ATCTTGTACT ATTTTCATCG TGGGAATGGT GGGGAATGCA ACTCTGCTCA GGATCATTTA CCAGAACAAA
TGTATGAGGA ATGGCCCCAA CGCGCTGATA GCCAGTCTTG CCCTTGGAGA CCTTATCTAT GTGGTCATTG
ATCTCCCTAT CAATGTATTT AAGCTGCTGG CTGGGCGCTG GCCTTTTGAT CACAATGACT TTGGCGTATT
TCTTTGCAAG CTGTTCCCCT TTTTGCAGAA GTCCTCGGTG GGGATCACCG TCCTCAACCT CTGCGCTCTT
AGTGTTGACA GGTACAGAGC AGTTGCCTCC TGGAGTCGTG TTCAGGGAAT TGGGATTCCT TTGGTAACTG
CCATTGAAAT TGTCTCCATC TGGATCCTGT CCTTTATCCT GGCCATTCCT GAAGCGATTG GCTTCGTCAT
GGTACCCTTT GAATATAGGG GTGAACAGCA TAAAACCTGT ATGCTCAATG CCACATCAAA ATTCATGGAG
TTCTACCAAG ATGTAAAGGA CTGGTGGCTC TTCGGGTTCT ATTTCTGTAT GCCCTTGGTG TGCACTGCGA
TCTTCTACAC CCTCATGACT TGTGAGATGT TGAACAGAAG GAATGGCAGC TTGAGAATTG CCCTCAGTGA
ACATCTTAAG CAGCGTCGAG AAGTGGCAAA ACAGTTTTC TGCTTGGTTG TAATTTTTGC TCTTTGCTGG
TTCCCTCTTC ATTAAGCCG TATATTGAAG AAAACTGTGT ATAACGAGAT GGACAAGAAC CGATGTGAAT
TACTTAGTTT CTTACTGCTC ATGGATTACA TCGGTATTAA CTTGGCAACC ATGAATTCAT GTATAAACCC
CATAGCTCTG TATTTTGTGA GCAAGAAATT TAAAAATTGT TTCCAGTCAT GCCTCTGCTG CTGCTGTTAC
CAGTCCAAAA GTCTGATGAC CTCGGTCCCC ATGAACGGAA CAAGCATCCA GTGGAAGAAC CACGATCAAA
ACAACCACAA CACAGACCGG AGCAGCCATA AGGACAGCAT GAACTGACCA CCCTTAGAAG CACTCCTCGG
TACTCCCATA ATCCTCTCGG AGAAAAAAT CACAAGGCAA CTGTGAGTCC GGGAATCTCT TCTCTGATCC
TTCTTCCTTA ATTCACTCCC ACACCCAAGA AGAAATGCTT TCCAAAACCG CAAGGGTAGA CTGGTTTATC
CACCCACAAC ATCTACGAAT CGTACTTCTT TAATTGATCT AATTTACATA TTCTGCGTGT TGTATTCAGC
ACTAAAAAAT GGTGGGAGCT GGGGGAGAAT GAAGACTGTT AAATGAAACC AGAAGGATAT TTACTACTTT
TGCATGAAAA TAGAGCTTTC AAGTACATGG CTAGCTTTTA TGGCAGTTCT GGTGAATGTT CAATGGGAAC
TGGTCACCAT GAAACTTTAG AGATTAACGA CAAGATTTTC TACTTTTTTT AAGTGATTTT TTTGTCCTTC
AGCCAAACAC AATATGGGCT CAAGTCACTT TTATTTGAAA TGTCATTTGG TGCCAGTATC CCGAATTC-3' (FRAG.
NO: _ ) (SEQ. ID NO: 3014)
5'-GAATTCGGGA AAAAGTGAAG GTGTAAAAGC AGCACAAGTG CAATAAGAGA TATTTCCTCA AATTTGCCTC
AAGATGGAAA CCCTTTGCCT CAGGGCATCC TTTTGGCTGG CACTGGTTGG ATGTGTAATC AGTGATAATC
CTGAGAGATA CAGCACAAAT CTAAGCAATC ATGTGGATGA TTTCACCACT TTTCGTGGCA CAGAGCTCAG
CTTCCTGGTT ACCACTCATC AACCCACTAA TTTGGTCCTA CCCAGCAATG GCTCAATGCA CAACTATTGC
CCACAGCAGA CTAAAATTAC TTCAGCTTTC AAATACATTA ACACTGTGAT ATCTTGTACT ATTTTCATCG
TGGGAATGGT GGGGAATGCA ACTCTGCTCA GGATCATTTA CCAGAACAAA TGTATGAGGA ATGGCCCCAA
CGCGCTGATA GCCAGTCTTG CCCTTGGAGA CCTTATCTAT GTGGTCATTG ATCTCCCTAT CAATGTATTT
AAGCTGCTGG CTGGGCGCTG GCCTTTTGAT CACAATGACT TTGGCGTATT TCTTTGCAAG CTGTTCCCCT
TTTTGCAGAA GTCCTCGGTG GGGATCACCG TCCTCAACCT CTGCGCTCTT AGTGTTGACA GGTACAGAGC
AGTTGCCTCC TGGAGTCGTG TTCAGGGAAT TGGGATTCCT TTGGTAACTG CCATTGAAAT TGTCTCCATC
TGGATCCTGT CCTTTATCCT GGCCATTCCT GAAGCGATTG GCTTCGTCAT GGTACCCTTT GAATATAGGG
GTGAACAGCA TAAAACCTGT ATGCTCAATG CCACATCAAA ATTCATGGAG TTCTACCAAG ATGTAAAGGA
CTGGTGGCTC TTCGGGTTCT ATTTCTGTAT GCCCTTGGTG TGCACTGCGA TCTTCTACAC CCTCATGACT
TGTGAGATGT TGAACAGAAG GAATGGCAGC TTGAGAATTG CCCTCAGTGA ACATCTTAAG CAGCGTCGAG
AAGTGGCAAA ACAGTTTTC TGCTTGGTTG TAATTTTTGC TCTTTGCTGG TTCCCTCTTC ATTAAGCCG
TATATTGAAG AAAACTGTGT ATAACGAGAT GGACAAGAAC CGATGTGAAT TACTTAGTTT CTTACTGCTC
```

ATGGATTACA TCGGTATTAA CTTGGCAACC ATGAATTCAT GTATAAACCC CATAGCTCTG TATTTTGTGA

GCAAGAAATT TAAAAATTGT TTCCAGTCAT GCCTCTGCTG CTGCTGTTAC CAGTCCAAAA GTCTGATGAC

CTCGGTCCCC ATGAACGGAA CAAGCATCCA GTGGAAGAAC CACGATCAAA ACAACCACAA CACAGACCGG

AGCAGCCATA AGGACAGCAT GAACTGACCA CCCTTAGAAG CACTCCTCGG TACTCCCATA ATCCTCTCGG

AGAAAAAAAT CACAAGGCAA CTGTGAGTCC GGGAATCTCT TCTCTGATCC TTCTTCCTTA ATTCACTCCC

ACACCCAAGA AGAAATGCTT TCCAAAACCG CAAGGGTAGA CTGGTTTATC CACCCACAAC ATCTACGAAT

CGTACTTCTT TAATTGATCT AATTTACATA TTCTGCGTGT TGTATTCAGC ACTAAAAAAT GGTGGGAGCT

GGGGGAGAAT GAAGACTGTT AAATGAAACC AGAAGGATAT TTACTACTTT TGCATGAAAA TAGAGCTTTC

AAGTACATGG CTAGCTTTTA TGGCAGTTCT GGTGAATGTT CAATGGGAAC TGGTCACCAT GAAACTTTAG

AGATTAACGA CAAGATTTTC TACTTTTTTT AAGTGATTTT TTTGTCCTTC AGCCAAACAC AATATGGGCT

CAAGTCACTT TTATTTGAAA TGTCATTTGG TGCCAGTATC CCGAATTC-3' (FRAG. NO: _ ) (SEQ. ID NO. 2482)

5'-GAATTCGGGA AAAAGTGAAG GTGTAAAAGC AGCACAAGTG CAATAAGAGA TATTTCCTCA AATTTGCCTC

AAGATGGAAA CCCTTTGCCT CAGGGCATCC TTTTGGCTGG CACTGGTTGG ATGTGTAATC AGTGATAATC

CTGAGAGATA CAGCACAAAT CTAAGCAATC ATGTGGATGA TTTCACCACT TTTCGTGGCA CAGAGCTCAG

CTTCCTGGTT ACCACTCATC AACCCACTAA TTTGGTCCTA CCCAGCAATG GCTCAATGCA CAACTATTGC

CCACAGCAGA CTAAAATTAC TTCAGCTTTC AAATACATTA ACACTGTGAT ATCTTGTACT ATTTTCATCG

TGGGAATGGT GGGGAATGCA ACTCTGCTCA GGATCATTTA CCAGAACAAA TGTATGAGGA ATGGCCCCAA

CGCGCTGATA GCCAGTCTTG CCCTTGGAGA CCTTATCTAT GTGGTCATTG ATCTCCCTAT CAATGTATTT

AAGCTGCTGG CTGGGCGCTG GCCTTTTGAT CACAATGACT TTGGCGTATT TCTTTGCAAG CTGTTCCCCT

TTTTCCAGAA GTCCTCGGTG GGGATCACCG TCCTCAACCT CTGCGCTCTT AGTGTTGACA GGTACAGAGC

AGTTGCCTCC TGGAGTCGTG TTCAGGGAAT TGGGATTCCT TTGGTAACTG CCATTGAAAT TGTCTCCATC

TGGATCCTGT CCTTTATCCT GGCCATTCCT GAAGCGATTG GCTTCGTCAT GGTACCCTTT GAATATAGGG

GTGAACAGCA TAAAACCTGT ATGCTCAATG CCACATCAAA ATTCATGGAG TTCTACCAAG ATGTAAAGGA

CTGGTGGCTC TTCCGGTTCT ATTTCTGTAT GCCCTTGGTG TGCACTGCGA TCTTCTACAC CCTCATGACT

TGTGAGATGT TGAACAGAAG GAATGGCAGC TTGAGAATTG CCCTCAGTGA ACATCTTAAG CAGCGTCGAG

AAGTGGCAAA AACAGTTTTC TGCTTGGTTG TAATTTTTGC TCTTTGCTGG TTCCCTCTTC ATTTAAGCCG

TATATTGAAG AAAACTGTGT ATAACGAGAT GGACAAGAAC CGATGTGAAT TACTTAGTTT CTTACTGCTC

ATGGATTACA TCGGTATTAA CTTGGCAACC ATGAATTCAT GTATAAACCC CATAGCTCTG TATTTTGTGA

GCAAGAAATT TAAAAATTGT TTCCAGTCAT GCCTCTGCTG CTGCTGTTAC CAGTCCAAAA GTCTGATGAC

CTCGGTCCCC ATGAACGGAA CAAGCATCCA GTGGAAGAAC CACGATCAAA ACAACCACAA CACAGACCGG

AGCAGCCATA AGGACAGCAT GAACTGACCA CCCTTAGAAG CACTCCTCGG TACTCCCATA ATCCTCTCGG

AGAAAAAAAT CACAAGGCAA CTGTGAGTCC GGGAATCTCT TCTCTGATCC TTCTTCCTTA ATTCACTCCC

ACACCCAAGA AGAAATGCTT TCCAAAACCG CAAGGGTAGA CTGGTTTATC CACCCACAAC ATCTACGAAT

CGTACTTCTT TAATTGATCT AATTTACATA TTCTGCGTGT TGTATTCAGC ACTAAAAAAT GGTGGGAGCT

GGGGGAGAAT GAAGACTGTT AAATGAAACC AGAAGGATAT TTACTACTTT TGCATGAAAA TAGAGCTTTC

AAGTACATGG CTAGCTTTTA TGGCAGTTCT GGTGAATGTT CAATGGGAAC TGGTCACCAT GAAACTTTAG

AGATTAACGA CAAGATTTTC TACTTTTTTT AAGTGATTTT TTTGTCCTTC AGCCAAACAC AATATGGGCT

CAAGTCACTT TTATTTGAAA TGTCATTTGG TGCCAGTATC CCGAATTC-3' (FRAG. NO: _ ) (SEQ. ID NO: 2470)

5'-GCCACCATGG AAACCCTTTG CCTCAGGGCA TCCTTTTGGC TGGCACTGGT TGGATGTGTA ATCAGTGATA

-continued

ATCCTGAGAG ATACAGCACA AATCTAAGCA ATCATGTGGA TGATTTCACC ACTTTTCGTG GCACAGAGCT

CAGCTTCCTG GTTACCACTC ATCAACCCAC TAATTTGGTC CTACCCAGCA ATGGCTCAAT GCACAACTAT

TGCCCACAGC AGACTAAAAT TACTTCAGCT TTCAAATACA TTAACACTGT GATATCTTGT ACTATTTTCA

TCGTGGGAAT GGTCGGGAAT GCAACTCTGC TCAGGATCAT TTACCAGAAC AAATGTATGA GGAATGGCCC

CAACGCGCTG ATAGCCAGTC TTGCCCTTGG AGACCTTATC TATGTGGTCA TTGATCTCCC TATCAATGTA

TGGCTGGGCG CTGGCCTTTT GATCACAATG ACTTTGGCGT ATTTCTTTGC AAGCTGTTCC CCTTTTTGCA

GAAGTCCTCG GTGTTCATCA CCGTCCTCAA CCTCTGCGCT CTTAGTGTTG ACAGGTACAG AGCAGTTGCC

TCCTGGAGTC GTGTTCAGGG AATTGGGATT CCTTTGGTAA CTGCCATTGA AATTGCCTCC ATCTGGATCC

TGTCCTTTAT CCTGGCCATT CCTGAAGCGA TTGGCTTCGT CATGGTACCC TTTGAATATA GGGGTGGACA

GCATAAAACC TGTATGCTCA ATGCCACATC AAAATTCATG GAGTTCTACC AAGATGTAAA GCACTGGTGG

CTCTTCGGGT TCTATTTCTG TATGCCCTTG GTGTGCACTG CGATCTTCTA CACCCTCATG ACTGGTGAGA

TGTTGAACAG AAGGAATGGC AGCTTGAGAA TTGCCCTCAG TGAACATCTT AAGCAGCGTC GAGAAGTGGC

AAAAACAGTT TTCTGCTTGG TTGTAATTTT TGCTCTTTGC TGGTTCCCTC TTCATTTAAG CCGTATATTG

AAGAAAACTG TGTATAACGA GATGGACAAG AACCGATGTG AATTACTTAG TTTCTTACTG CTCATGGATT

ACATCGGTAT TAACTTGGCA ACCATGAATT CATGTATAAA CCCCATAGCT CTGTATTTTG TGAGCAAGAA

ATTTAAAAAT TGTTTCCAGT CATGCCTCTG CTGCTGCTGT TACCAGTCCA AAAGTCTGAT GACCTCGGTC

CCCATGAACG GAACAAGCAT CCAGTGGAAG AACCACGATC AAAACAACCA CAACACAGAC CGGAGCAGCC

ATAAGGACAG CATGAACTGA CCACCCTTAG AAGCACTCCT-3' FRAG. NO: _ ) (SEQ. ID NO: 2469)

Substance P Antisense Nucleic Acids and Oligonucleotide Antisense Oligonucleotide Fragments

5'-CTGCTGBGGC TTGGGTCTCC GGGCGBTTCT CTGCBGBBGB TGCTCBBBGG GCTCCGGCBG TTCCTCCTTG

BTCTGGTCGCT GTCGTBCCBG TCGGBCCBGT BBTTCBGBTC BTCBTTGGCT CCTBTTTCTT CTGCBBBCBG

CTGBGTGGBG BCBBGBBBBB BGBCTGCCBB GGCCBCGBGG BTTTTCBTGT TGGBTTTTGC GBCGGBCBGT

CCCGCGGGGT GCTGAGTTTC TCTGGTTCCT CCGBGCGCBC GTGGTCGCTC CGCGTTTCTC TGGTTCCTCC

GGTCCCGCGG GGTGCTGTCT GGTCGCTGTC GTGGCTTGGG TCTCCGGGCG GTTTCCTTCC TTTTCCGC-3' (FRAG.

NO: 1877) (SEQ. ID NO: 1890)

5'-CTCC GGGCGB-3' FRAG. NO: 1878) (SEQ. ID NO: 1891)

5'-GGCCBCGBGG-3' (FRAG. NO: 1879) (SEQ. ID NO: 1892)

5'-GGGTCTCCGGGCG-3' (FRAG. NO: 1880) (SEQ. ID NO: 1893)

5'-GGG TCTCCGGGCGG-3' (FRAG. NO: 1881) (SEQ. ID NO: 1894)

5'-CGTGGTCGCTCCGC-3' (FRAG. NO: 1355) (SEQ. ID NO: 1364)

5'-GTTTCTCTGGTTCCTCCG-3' (FRAG. NO: 1356) (SEQ. ID NO: 1365)

5'-GTCCCGCGGGGTGCTG-3' (FRAG. NO: 1357) (SEQ. ID NO: 1366)

5'-TCTGGTCGCTGTCGT-3' (FRAG. NO: 1358) (SEQ. ID NO: 1367)

5'-GGCTTGGGTCTCCGGGCG-3' (FRAG. NO: 1359) (SEQ. ID NO: 1368)

5'-GTTTCCTTCCTTTTCCGC-3' (FRAG. NO: 1360) (SEQ. ID NO: 1369)

5'-CTGCTGBGGC TTGGGTCTCC GGGCGBTTCT CTGCBGBBGB TGCTCBBBGG GCTCCGGCBG TTCCTCCTTG

BTCTGGTCGCT GTCGTBCCBG TCGGBCCBGT BBTTCBGBTC BTCBTTGGCT CCTBTTTCTT CTGCBBBCBG

CTGBGTGGBG BCBBGBBBBB BGBCTGCCBB GGCCBCGBGG BTTTTCBTGT TGGBTTTTGC GBCGGBCBGT

CCCGCGGGGT GCTGAGTTTC TCTGGTTCCT CCGBGCGCB-3' (FRAG. NO: 1882) (SEQ. ID NO: 1895)

Substance P Receptor Nucleic Acids and Antisense Oligonucleotide Fragments

-continued

5'-GGGCTBBGBT GBTCCBCBTC BCTBCCBCGT TGCCCBCCBC BGBGGTCBCC BCBBTGBCCG TGTBGGCBGC

TGCCCBBBGG BCBBTTTGCC BGGCTGGTTG CBCGBBCTGB TTGGGTTCCG BGGTGTTBGT GGBGBTGTTT

GGGGBGBGGT CTGBGTCCBC CGGGBGGBCG TTBTCCBTTT CGBBGCTBGG CGGTBBBGCC CTBCTBTCTG

TBCBCBBCCC CCCTCTGCBG CBGBGTCCTG TCGTGGCGCC TGGGGCTCBG GGTCCGGGC TAAGATGATC

CACATCACTA CCACGTTGCC CACCACAGAG GTCACCACAA TGACCGTGTA GGCAGCTGCC CAAAGGACAA

TTTGCCAGGC TGGTTGCACG AACTGATTGG GTTCCGAGGT GTTAGTGGAG ATGTTTGGGG AGAGGTCTGA

GTCCACCGGG AGGACGTTAT CCATTTCGAA GCTAGGCGGT AAAGCCCTAC TATCTGTACA CAACCCCCCT

CTGCAGCAGA GTCCTGTCGT GGCGCCTGGG GCTCAGGGTC CGTCCTGTCG TGGCGCCTGG GGCTCTTCTT

TTGTGGGCTC TTTCGTGGCT GTGGCTGTGG TCTCTGTGGT TGCTGCCCTG GGTCTGGGGG TGTGGCCTTG

GGGCCGTCCT CTGGCTCCTC CTCGTGGGCC CCC-3' (FRAG. NO: 1883) (SEQ. ID NO: 1896)

5'-GGGBGGBCG-3' (FRAG. NO: 1884) (SEQ. ID NO: 1897)

5'-GGGTC CG-3' (FRAG. NO: 1885) (SEQ. ID NO: 1898)

5'-GGGCC CCC-3' (FRAG. NO: 1886) (SEQ. ID NO: 1899)

5'-GTCCTGTCGTGGCGCCTGGGGCTC-3' (FRAG. NO: 1361) (SEQ. ID NO: 1370)

5'-TTCTTTTGTGGGCT-3' (FRAG. NO: 1362) (SEQ. ID NO: 1371)

5'-CTTTGGTGGCTGTGGCTG-3' (FRAG. NO: 1363) (SEQ. ID NO: 1372)

5'-TGGTCTCTGTGGTTG-3' (FRAG. NO: 1364) (SEQ. ID NO: 1373)

5'-CTGCCCTGGGTCTGG-3' (FRAG. NO: 1365) (SEQ. ID NO: 1374)

5'-GGGTGTGGCCTTGGGGCCGTCCTCTGGCTCCTCCTCGTGGGCCCC (FRAG. NO: 1366) (SEQ. ID NO: 1375)

5'-GGGCTAAGAT GATCCACATC ACTACCACGT TGCCCACCAC AGAGGTCACC ACAATGACCG TGTAGGCAGC

TGCCCAAAGG ACAATTTGCC AGGCTGGTTG CACGAACTGA TTGGGTTCCG AGGTGTTAGT GGAGATGTTT

GGGGAGAGGT CTGAGTCCAC CGGGAGGACG TTATCCATTTC GAAGCTAGGC GGTAAAGCCC TACTATCTGTA

CACAACCCCC CTCTGCAGCA GAGTCCTGTC GTGGCGCCTG GGCTCAGGGTCC-3' (FRAG. NO: 1367) (SEQ. ID NO: 1376)

5'-GGGCTBBGBT GBTCCBCBTC BCTBCCBCGT TGCCCBCCBC BGBGGTCBCC BCBBTGBCCG TGTBGGCBGC

TGCCCBBBGG BCBBTTTGCC BGGCTGGTTG CBCGBBCTGB TTGGGTTCCG BGGTGTTBGT GGBGBTGTTT

GGGGBGBGGTC TGBGTCCBCC GGGBGGBCGT TBTCCBTTTC GBBGCTBGGC GGTBBBGCCC TBCTBTCTGTB

CBCBBCCCCC CTCTGCBGCB GBGTCCTGTC GTGGCGCCTG GGGCTCBGGG TCC-3' (FRAG. NO: 1368) (SEQ. ID NO: 1377)

Chymase Antisense Nucleic Acids and Oligonucleotides Antisense Oligonucleotide Fragments

5'-GGBGCTGBTB CTGCBGATTT CBGBGGGBBG BBCCCTGBTB CTCBCCBGCT TCBGCTCTGG BGCBCBBGBG

BBBGBGCBGC BGGGGGBGBG GBBGBBGCBG CBTCTTCCCB GBGBGGCTGC CTGBGCBBBT GCTGGTTTTC

CTTTCCBGTC TTGGGTTTTB TBBCTCCCBG BBGGCBBGBG BGGGGCBBGG CGTTTTCTTC TCTCGCTGGT

TTTCCTTTCC TGGCAGTGGG TGGGGTGGG GGTGGGGTGG CTTCCTTGTT CCTGGGGGTG TCCTCTTGCT

CTGGGCTTTT CTCCCCTTTT CCTTCCTGTC TGTTTTCCTG GGGCTCTCCT CTGTCTCTGT GTCCTTGCCC

TGGCCCTCTT CCCTCTCCTG TCTCCTGTCC CTGTGTTCCG CCCGTCTTCC

CTCTCCTGAC CTCCTTTTCC TCCGCTGGGT GGGGCCCTGC CTGTTCTCTG CTCCCTGGCT TGGGGTTTCT

TCTGTGTGTC TTCTTCCTCT GTTGGCTGGC TTTCTCCTTC TTTTGTCTTC CTGGGTGCCC CTTCTTCCTT

TCTTGGGTCC TTGGTGCTTG GGCTGGG TCCCAGTTAA TACATAATCA ATATGCAATT TATTAATACA

TCTCTCCATG TCCACTCCCC CTGTATCTTG CCATTCTTGA CCTGCATTTC CATCCTCCTT ACCTTCCCTA

```
GAGGCCAACT CATTTTCTTT GAAAAACCTG GCATTTCCCA GAAAAAAAAG TGAAGGGCTG GGAGCTGTCC
GTTGTCCTGA TTTGCTCCCT CTGCCCTTGC TTCCAAATGT GGTTGGAAAG AAGCACTATT GAAAAATCCC
TAAACGCACC CCTGCAGGGT TGGCTCTACC CTGTAGCCAT GGACACATGC TGTTGATACC ACCTGCCTCA
TGAGTCTCAC ATAATTTGCC CTTTCACACT ATCTACCCCA TCAGCCTTAC CAAAACCATA CCTGCATCCT
GGGCAGCATC TGCCCTTCAA GAGACTAAGG AATCTCCTTG CAACCAAGAA TGACTAGACC AATGAGACAC
CCTTTAAGGC CCCAGCACAA TATAGAAATC CCACAATATG GTAATCCCAG TAAGGAGCTA TCAAGCCATT
GCAGGACCAT CTAGAATACA ACTAGAGTAT AGTTCCTTTC AATCCAGGAA CTATACTCTA ACAGCTTGGC
TCACAGGAAC CAGAAGTGAA GATGATGAGG ATCAGGGCTG AGCCTGTGAG CACCAGCTCC ACCACTGACA
CCAACCACAG ATTAAACAAG CATCTTGTGG ACCCCTGGGA TGGAAAGAAT AGTTGTTGCC TTATCAACCT
CCCCCACAGC CCACACAGAA AAGATAAAAT CATCATGGCT ACAGTGTTAC AGAAGATGAT GACCCAAGGA
GTAGGCCTGC CTGAGTGAAT GCTGAGAGTG ATAATGGGAG CAGTAGCATC TCAGAGACTA CAGCAGAAAC
CATCCACATA AAGAGCTTTG CCCAAACTTA TGATAAAGGG CACCCTCAGA GACTCTCCCT ACTTTAATAT
TAGCCCATTG CAGAAATGGT GAGTGGAAAG AGAAATCTTA GGAAGAACCC CTTAAAAAAG CAAAATGCTT
TTTAGGTTTG TGCTGAAGAG CCTGGAAAAG AAATAAGGAC ACACACGCTG AGAAATCTTC CTCCTGCCCC
AACACTGGGA TAATCTCCAA GGATCTCTCC ATATCTCATT CTCCTGGATA CACTGTCCAC TCAGAAATAT
TGTGCAGAGT GCAGTAATTC AAAAGTGAGC TATTGTGTTA GGAGTGAAGG CAAGAGTATC GTAAATAAA
TCAAATTTGA AATGAATTCT CTTAAATTGC TTTATAGATG TTTAATGTAA GCCAGCAGCT ATTAAACGAT
AAACCTTAAA TTCGAGAAAA ACTTGGTCAT TCAGAAACTA TAGAAACAGG CAGGACTTAT TGCGAGGGCA
AACACAGAGT GAGCTCCAGC CTGCTTCAGG AAAATCTGCC AGTGCCATGA AGGATGTACT CTGTCTGCTC
CACTGCACTA CTGCTCAGTA TGAGCCCATG CCATCAGCTG TCCCTGACCC ACAGGAGTTC TTTAGAAGAG
ACTGGTCAAC AAAAGTTTCT AGGGTGTTTT ATACCTGCCA ACTCGAGGGT TAAAACAAGT TGCATAGAAA
TGCTCAATCA AGAAAGACAC AGTCATTACT CAGAGAATAA TAAACAGCCT GGCAGCACAT GAATGAATAG
AAAAAAGATG TTACATGCAA AGCATGAAAT AACCAAATTC CATAACAGAT GTTAATCTGT AATGTGTTTA
GGAGAATTTA GAGGAAGTAT AAGATTTATT CTTTCATCAA AAAAATTATA GCCAATGAGG ATATATCTAT
CAATTATCCA TCAAGTGGTG ATATGGCAGC ACAAGGTAAA ACACAAGGA ATAAAACCAA CGTTTATTAA
GAACCAATCA TGTGGCATTT CACATTGAGC ATCATATTTA ATTCTGAAAA AAATCCTTGT ACTGTATCAT
TCTTCATATT TTATGGATGC AGTAACTAAG GCTGAGAACT TTAAAATTTT TCCTAAGTTC AGACACATAG
CTAAGTGGCA GAACCAAGAT TCAAACTCAC CCCATCTAAC TGCAGAGCAA ACTGCATGCC TTAAATGTCA
AAGTGAATAC TAGCACAGTT AATACAATGT TTGGAAACTC AGAGAAGGAA TGATCCCTCT GCATTATAGT
TACTAAGGAA TCATTGCCAT TATTTAAATG CCAGTGCTTC TACATCAGGC CCAAATTTTC TGTCCTACTA
ACTGTGAATC AAGACTTGAT TCAACCTCTA CTTGAGTATC TGCCGCAATG AGAAATCACT TACCTCCACT
AACCACACAT TTATTTTATA ACAACAGATT GTTAGTAAGT CCTTTCTTAT ACATACTCAA CAGCTGCTTC
CCAAGATGCT GTAGGATTAT GTCTAGAGTC AAACTAGCCA GAAGCAATGT CCAAAATACA CCATAACACT
GTGCAGCAAA GGTCCTACTA CCACTTGTTT GGCCCAAACA TTCTAGGCAG CACTGGATAT CTGAATCATC
AATTATTTCC ACAAACACTG ACCCCTCTAC CAGTCACCCT CACTAGAAGA ATTAATTCCA CATGATAATA
GCTCCCTCAT GTTACTCCCT TCTAAGTCAA ATTGTACACC CCTTTATCTG ATTAACAGAG TCTAAGTCAC
ATGACCTAAA TGCAAGAGAA CTGGGAATGG ACGTTTGTGG ATTCTACCTT AGTAAGGCAA AGTTATCATT
GGGAATTCCT CTAATACAGG AAGGGTGTTC CAGAGACATT AAGGAGCCAT ATAAATGGAA AATGTCCACT
ACAATCCATC ACTTGGTTGC CCCACATCAA CATTCATTCT TTTGCACAC TTAAAGTTTC CAAGAACAAA
AATTATCCCA CTGAACATAA TCTTTACTAT CTTTTATATA AAGGAAAATT AGACTTGACT CAGCAGAACT
```

```
GAAATAACCC AGCTCTAACA GTTACTGCTT TTAACTTCAA GTACTGTGTC TCTAGGTGAT ACCTGCTCCA
ACAATAGTTT GGTCACATTT TCAATTTGAT ATTCTCTAGT CTCCCAACTT GATAACTGTA CCCTAAACCA
TAAAGTTCAC TACCAACATG CTATATATAA AATAACCAAA GGGGGAAGAA GAAAGAGAAA AAGGAAATCT
CTTAAAATAC ACAGGTATAC ATATGACAAA GCAAAGAAGG AAATGTGAGC AGATAGTGCA GTCCTCGTTT
CTGAAATTGG TCCCCTGACT GGGGCTATAC CTATTCCATT TCCTCACCCT CAGCCAGGCA GGTGGAGCAA
AAACTTAAGT CTTGGTGGAT CTGAATCTTG ATGCTGTGGA GCTGTCTTAC TAGCCCCAGA CTACCTGCCT
CTCAATTTCT AATTATATCA GTGAAAGCAA ACAGCTTTGA TTTGTTTAAG CCTCTGATTT TTTGGTCTAA
CTGATGTAAG ACCACAAGGA CAAGAGTTCT CCAGCTCCGG ATTCTCTTCT GTTCTGTTAA TGGTGAAATG
CCCGAGAGAA GAGTTGCCAA CTTTGGCAAA TAAAAAATAC AGGATTCCAG TTAAATTCAA ATTTAGATAA
ACAACAATTT TTTAGTATTA GTGTGTCCCA TTCAATATTT GGACATACTT AACTAAAAAA TGATTTGTTG
TTCATCTGAA ATACAAATTT AACTGGGCAT TCTGAATATT CTCTGGCAAC CCCGAGAGA GTGAAGAAAG
TGGTACAAGG ACACTTAAGA AGACCAGATT TGAAAAGACA TTACGGATGT GTTTAAATGT CTTATTCTAG
AGAGAGTTAG AGCTGTAGGT AGAACTTGGG AAATTAAGTT AAAAGCAGAC ACAGAGACCT GGCCAATATA
TACTAAGGAG TGGATCACTC TGGTCACAAG CCCAACCTGA GACCAAGGGC ATAGTGAGAT GATTTGGGAA
AGGCACTTAT ACACTACTCA TCCCCGTCTT TGAACTAAAT GCCTTATAAA TCTCCAAGAG AAATGACAGT
CCACCATGTG GACTGCTTTC TGTAAGTCCA GGGAAAATAA AAGCTATGTG CTTGAAACCC ACTTCTGATA
TTATAAGGTG TGTGATCTTT GTCATGTTAA TGGGTCTGAG TATCAATTCT ACAATTGTAA AGTGACAGTA
ATGGTGTGTC CCCAGGTTGT TGTGGAAAGC TTGATTCTTA ATGCAACAGT AGGAAACCCC AGCCTCTCTG
GAGCAAACAC CCTTCTACAT CTTTACTTCC CCTGCACATT GGCAGGACTC TATTCCTCTA TTTCTCTCTA
GTGCTAGAGC AGAAAGGGAC CTTGATTTGA TATCAGGAAA ATCTATTTCT GAACCATAAG CTATGATAGC
TGATTTAAAA AATTGACTAT CATGACATGA TAATGATCAT AATGGTAATA CATATTGATA GGGTTGCCGT
GAAAGTAATA ATATATCTAA GAGTTGTGAC AATATATGAT ACGCCTAGAC TCTCAGAAAA TGCTAATTCC
AATCCCAATT GCTCTTTGCA TAAAGTTCTG TCCTAGGGTC TGTTCTTTTC CCACATCTAC CCTCCTTGGA
TCTCTCTTCT GTCTTTTTCA TGTGGTTCAG AGGAGGAGAG AGATCCAGGT CAATGTTTTT CAAATTACAA
GGAATTATCA TTTAAATGGG GAAGAAGCTC AAGTTTTGAC GTGTAGTGGA ATTGGAGTGG AGTGGAGTGG
AATGGAAACT AACAGGAAGA CACTGCACAT GGTTAAGATA AAGATTGTTT CCTGAAACCT TAAATTTGTG
CTTACATACT CACACATACA TATGTGCATG CACTGGGACT CTGCAATATG CATTTCTGAC TATGGAACAT
AGCCATAAAA GTCTTTGCAC TGAACGTTCA GTGGGCCTTT CACAAGCTGC CCTAATTGGG AAAGAAAAAC
ATGGTCCCTC CATTTCCTGC CCCCAACTCC AGAAAAGTCA CCATAGTTGA GGGTACATCT GAGAAGCCAG
CACTTGGGAG TTCAGGGCTC AAGTTCCTTT CTAGAAAAAC ACTGGGTGAT CTAGGGGAA CTTCCGATCA
GAAACAGCCA ATTCAGAGTG AGAGAAGAAA ACGTGACCAT GCAGTTCCTG TGGTTACCAG CCTTGCCCCT
CTCTTGCCTT CTGGGAGTTA TAAAACCCAA GACTGGAAAG GAAAACCAGC ATTTGCTCAG GCAGCCTCTC
TGGGAAGATG CTGCTTCTTC CTCTCCCCCT GCTGCTCTTT CTCTTGTGCT CCAGAGCTGA AGCTGGTGAG
TATCAGGGTT CTTCCCTCTG AAATCTGCAG TATCAGCTCC TGAAACAAAG ATGTTTAGTC TGAAATAGCT
GACTCCTAAA CAGGGTTCCA AGATCTCTCT TCAAGAGTCC CACAGAGGAA ATTTCCACTT GGGATGTGTG
CCACCCCACC CCCACCCCCA CCCACTGCCA TTCTCTACAG CCTAGGACAC CCCCAGGAAC AAGGAATTTC
ACCTCAATTG TAGAAAAGCC CAGAGCAAGT GGAAGGAAAA GGGGTATCCC CAGGAAAACA GACATGTCCT
CTTAATCTTC TGAGCATCAG GGCTACCCAT TACTTTGTGA CTTTCTCACT CTGTGACCAT GCTCAAGAGC
TATGGAGAAA TCTAAAACAG GAACCTGGAC AGTGGGTCCT ACACAGAGAC AGAGGAGAGT GGGCCAGGGC
```

-continued

```
AAGGTGGGAG TGGGAGAAGT CTGAGATGAA AACATCAGAA TGGAGCAGAG GCAAGAATGA GATTTCACCT

GGGAGGTTAT GGGTGGGGAA AGATACGAAA TACAGGAGAC AGGAGAGGGA AGATGGGCGG AACACAGGGT

GAGAATGAGA TTCCAGGGAA GCCTAGCTCA GCTTTAACCC AATTTGTCCA TTCATTGGAG AGAGTATCTA

TGGCCGTGTT CAAACCCTGG GGTGCTCTGT TCCAGGGGAG ATCATCGGGG GCACAGAATG CAAGCCACAT

TCCCGCCCCT ACATGGCCTA CCTGGAAATT GTAACTTCCA ACGGTCCCTC AAAATTTTGT GGTGGTTTCC

TTATAAGACG GAACTTTGTG CTGACGGCTG CTCATTGTGC AGGAAGGTGA GACAACAGGG TCTATTTATC

TCCAAATGGG AGATGAACAA CCAGAGTAGC ATCCAGGAAT ACACCTGCAC TGGGGACTGA AGAGGGGGTC

CTGGGTCTTG TCAACTTTCA GGAGAGGGAA GACTTTGGGC TGAAAGACTT TAGTCTGTGT TTGAATAGTT

CCTTGAGCCT CAGTCACTGA GCTAAGCTCC CTTCGGAGGA AAAGGAGGTC CTGTCCGAAG GTCCCTCTTG

TTGCAGTAGC ACCCCTCACC CCTACCCAAC TCAAGACACA CGGCTCACTT TTCAGGGCCC CACCCAGTCT

CAGGGCCACT TCCTCTATGG CCTTTTCAAG AACACTGGCT CTAGTTCTCA GGGTCCTGAA CCCATCATTT

TATGGGAGCA GAGAACAGGT CTACATAAGA CCCCCACTTT CCCGTTTTAA CTGATATCTC CTGCTTCAGG

GGCTGGCCCT CATGCAGGGT TCCCTGAATT AGGAAGTGTG AACCCTGTCC CCTGAGTCCT CCCTGGCCTG

TTCAGTCCCC AGCAATTCCA GGGGTCGTAG AAATTGTGTC TGTTTCCTGA GAAAGCTCTT TCATGAGTTA

AGCCTGAGCC CTCAAATGCC ACAAGTGGCC CATGAAAAGG GAGATGGGTA GAGTCCGGCN ACCCAGTGAC

AGAGTTTAGT CCTCTTTTCT CAGAATGAGC TCACCTCAGA AGAAACCCCA AGCCATCACT GTCGCCTCCT

TTTCCTTCCT TCTTCCTCAC AGCAGGTCTA TAACAGTCAC CCTTGGAGCC CATAACATAA CAGAGGAAGA

AGACACATGG CAGAAGCTTG AGGTTATAAA GCAATTCCGT CATCCAAAAT ATAACACTTC TACTCTTCAC

CACGATATCA TGTTACTAAA GGTGACAACA CCTCTCTTCT CCCTTTCCAC TTCCCATTCT CCTAAGCTTC

TCCTTCAGGT CCTCATTGCC CTGAATTTTT CTTAGGACTT GGCTATAACA TGAAGCTACT CACCCTGTCC

CTCCCTGATC ACCTCCAACT GTCCAGAGCC CATTTCGAGG ACTGACAGTC CTTCATTCCC TTCACAGTTG

AAGGAGAAAG CCAGCCTGAC CCTGGCTGTG GGGACACTCC CCTTCCCATC ACAATTCAAC TTTGTCCCAC

CTGGGAGAAT GTGCCGGGTG GCTGGCTGGG GAAGAACAGG TGTGTTGAAG CCGGGCTCAG ACACTCTGCA

AGAGGTGAAG CTGAGACTCA TGGATCCCCA GGCCTGCAGC CACTTCAGAG ACTTTGACCA CAATCTTCAG

CTGTGTGTGG GCAATCCCAG GAAGACAAAA TCTGCATTTA AGGTGATCCT CCAACTAGGT TTCCTCTCCA

AAACTCACTG TTCAGGGACC TGAATGCTCT TAGAAGGAGA TGGGGTCAGC AGGTTGTCAG TCAGGTGACA

GGGTGAGCAT CACAGGAATT GCTGTCCTCC CGTGGTCCAA GACAGCCTCT GACCATCCAT TCCAGTCTAC

TGCACTGGGG GCATGGGGTG ACTGTGGAGA ATGTGGATGA CGGTCCCAAG AAAGGAAGAA GGGGCATCAG

AACTAGATGT ATAAGTGAGG AGCTCCACCT CCTGGGTCTG ACTTTAGGTC TCACTGTGAC TCCAAGCTGG

CTGGCAGACA GGAGTGGAGG ACTTCCCGGG CTCACCTTCT TCTCTCTCTC CTCCCCCTAC AGGGAGACTC

TGGGGGCCCT CTTCTGTGTG CTGGGGTGGC CCAGGGCATC GTATCCTATG GACGGTCGGA TGCAAAGCCC

CCTGCTGTCT TCACCCGAAT CTCCCATTAC CGGCCCTGGA TCAACCAGAT CCTGCAGGCA AATTAATCCT

GGATCCTGAG CCAGCCTGAA GGGAAGCTGG AACTGGACCT TAGCAGCAAA GTGTGTGCAA CTCATTCTGG

TTCTACCCTT GGTTCCCTCA GCCACAACCC TAAGCCTCCA AGAGGTCTCC TACAGGTAAC AGAACTTTCA

ATAAACTTCA GTGAAGACAC AGCTTCTAGT CGTGAGTGTG TGTCCCTCTC TGCTGCTCTC TTCTCCTGCA

CATGTGACCT GATTCCCAGC CCAAGCACCA AGGA ATCATCGGGG GCACAGAATC CAAGCCACAT TCCCGCCCCT

ACATGGCCTA CCTGGAAATT GTAACTTCCA ACGGTCCCTC AAAATTTGT GGTGGTTTCC TTATAAGACG

GAACTTTGTG CTGACGGCTG CTCATTGTGC AGGAAGGTCT ATAACAGTCA CCCTTGGAGC CCATAACATA

ACAGAGGAAG AAGACACATG GCAGAAGCTT GAGGTTATAA AGCAATTCCG TCATCCAAAA TATAACACTT

CTACTCTTCA CCACGATATC ATGTTACTAA AGTTGAAGGA GAAAGCCAGC CTGACCCTGG CTGTGGGGAC
```

ACTCCCCTTC CCATCACAAT TCAACTTTGT CCCACCTGGG AGAATGTGCC GGGTGGCTGG CTGGGGAAGA

ACAGGTGTGT TGAAGCCGGG CTCAGACACT CTGCAAGAGG TGAAGCTGAG ACTCATGGAT CCCCAGGCCT

GCAGCCACTT CAGAGACTTT GACCACAATC TTCAGCTGTG TGTGGGCAAT CCCAGGAAGA CAAAATCTGC

ATTTAAGGGA GACTCTGGGG GCCCTCTTCT GTGTGCTGGG GTGGCCCAGG GCATCGTATC CTATGGACGG

TCGGATGCAA AGCCCCCTGC TGTCTTCACC CGAATCTCCC ATTACCGGCC CTGGATCAAC CAGATCCTGC

AGGCAAATTA A-3' (FRAG. NO: 1887) (SEQ. ID NO: 3015)

5'-ATCATCGGGG GCACAGAATC CAAGCCACAT TCCCGCCCCT ACATGGCCTA CCTGGAAATT GTAACTTCCA

ACGGTCCCTC AAAATTTTGT GGTGGTTTCC TTATAAGACG GAACTTTGTG CTGACGGCTG CTCATTGTGC

AGGAAGGTCT ATAACAGTCA CCCTTGGAGC CCATAACATA ACAGAGGAAG AAGACACATG GCAGAAGCTT

GAGGTTATAA AGCAATTCCG TCATCCAAAA TATAACACTT CTACTCTTCA CCACGATATC ATGTTACTAA

AGTTGAAGGA GAAAGCCAGC CTGACCCTGG CTGTGGGGAC ACTCCCCTTC CCATCACAAT TCAACTTTGT

CCCACCTGGG AGAATGTGCC GGGTGGCTGG CTGGGGAAGA ACAGGTGTGT TGAAGCCGGG CTCAGACACT

CTGCAAGAGG TGAAGCTGAG ACTCATGGAT CCCCAGGCCT GCAGCCACTT CAGAGACTTT GACCACAATC

TTCAGCTGTG TGTGGGCAAT CCCAGGAAGA CAAAATCTGC ATTTAAGGGA GACTCTGGGG GCCCTCTTCT

GTGTGCTGGG GTGGCCCAGG GCATCGTATC CTATGGACGG TCGGATGCAA AGCCCCCTGC TGTCTTCACC

CGAATCTCCC ATTACCGGCC CTGGATCAAC CAGATCCTGC AGGCAAATTA A-3' (FRAG. NO: _ ) (SEQ. ID NO: 2468)

5'-TCCCAGTTAA TACATAATCA ATATGCAATT TATTAATACA TCTCTCCATG TCCACTCCCC CTGTATCTTG

CCATTCTTGA CCTGCATTTC CATCCTCCTT ACCTTCCCTA GAGGCCAACT CATTTTCTTT GAAAAACCTG

GCATTTCCCA GAAAAAAAAG TGAAGGGCTG GGAGCTGTCC GTTGTCCTGA TTTGCTCCCT CTGCCCTTGC

TTCCAAATGT GGTTGGAAAG AAGCACTATT GAAAAATCCC TAAACGCACC CCTGCAGGGT TGGCTCTACC

CTGTAGCCAT GGACACATGC TGTTGATACC ACCTGCCTCA TGAGTCTCAC ATAATTTGCC CTTTCACACT

ATCTACCCCA TCAGCCTTAC CAAAACCATA CCTGCATCCT GGGCAGCATC TGCCCTTCAA GAGACTAAGG

AATCTCCTTG CAACCAAGAA TGACTAGACC AATGAGACAC CCTTTAAGGC CCCAGCACAA TATAGAAATC

CCACAATATG GTAATCCCAG TAAGGAGCTA TCAAGCCATT GCAGGACCAT CTAGAATACA ACTAGAGTAT

AGTTCCTTTC AATCCAGGAA CTATACTCTA ACAGCTTGGC TCACAGGAAC CAGAAGTGAA GATGATGAGG

ATCAGGGCTG AGCCTGTGAG CACCAGCTCC ACCACTGACA CCAACCACAG ATTAAACAAG CATCTTGTGG

ACCCCTGGGA TGGAAAGAAT AGTTGTTGCC TTATCAACCT CCCCCACAGC CCACACAGAA AAGATAAAAT

CATCATGGCT ACAGTGTTAC AGAAGATGAT GACCCAAGGA GTAGGCCTGC CTGAGTGAAT GCTGAGAGTG

ATAATGGGAG CAGTAGCATC TCAGAGACTA CAGCAGAAAC CATCCACATA AAGAGCTTTG CCCAAACTTA

TGATAAAGGG CACCCTCAGA GACTCTCCCT ACTTTAATAT TAGCCCATTG CAGAAATGGT GAGTGGAAAG

AGAAATCTTA GGAAGAACCC CTTAAAAAAG CAAAATGCTT TTTAGGTTTG TGCTGAAGAG CCTGGAAAAG

AAATAAGGAC ACACACGCTG AGAAATCTTC CTCCTGCCCC AACACTGGGA TAATCTCCAA GGATCTCTCC

ATATCTCATT CTCCTGGATA CACTGTCCAC TCAGAAATAT TGTGCAGAGT GCAGTAATTC AAAAGTGAGC

TATTGTGTTA GGAGTGAAGG CAAGAGTATC GTAAATAAA TCAAATTTGA AATGAATTCT CTTAAATTGC

TTTATAGATG TTTAATGTAA GCCAGCAGCT ATTAAACGAT AAACCTTAAA TTCGAGAAAA ACTTGGTCAT

TCAGAAACTA TAGAAACAGG CAGGACTTAT TGCGAGGGCA AACACAGAGT GAGCTCCAGC CTGCTTCAGG

AAAATCTGCC AGTGCCATGA AGGATGTACT CTGTCTGCTC CACTGCACTA CTGCTCAGTA TGAGCCCATG

CCATCAGCTG TCCCTGACCC ACAGGAGTTC TTTAGAAGAG ACTGGTCAAC AAAAGTTTCT AGGGTGTTTT

ATACCTGCCA ACTCGAGGGT TAAAACAAGT TGCATAGAAA TGCTCAATCA AGAAAGACAC AGTCATTACT

-continued

```
CAGAGAATAA TAAACAGCCT GGCAGCACAT GAATGAATAG AAAAAAGATG TTACATGCAA AGCATGAAAT
AACCAAATTC CATAACAGAT GTTAATCTGT AATGTGTTTA GGAGAATTTA GAGGAAGTAT AAGATTTATT
CTTTCATCAA AAAAATTATA GCCAATGAGG ATATATCTAT CAATTATCCA TCAAGTGGTG ATATGGCAGC
ACAAGGTAAA ACACAAAGGA ATAAAACCAA CGTTTATTAA GAACCAATCA TGTGGCATTT CACATTGAGC
ATCATATTTA ATTCTGAAAA AAATCCTTGT ACTGTATCAT TCTTCATATT TTATGGATGC AGTAACTAAG
GCTGAGAACT TTAAAATTTT TCCTAAGTTC AGACACATAG CTAAGTGGCA GAACCAAGAT TCAAACTCAC
CCCATCTAAC TGCAGAGCAA ACTGCATGCC TTAAATGTCA AAGTGAATAC TAGCACAGTT AATACAATGT
TTGGAAACTC AGAGAAGGAA TGATCCCTCT GCATTATAGT TACTAAGGAA TCATTGCCAT TATTTAAATG
CCAGTGCTTC TACATCAGGC CCAAATTTTC TGTCCTACTA ACTGTGAATC AAGACTTGAT TCAACCTCTA
CTTGAGTATC TGCCGCAATG AGAAATCACT TACCTCCACT AACCACACAT TTATTTTATA CAACAGATT
GTTAGTAAGT CCTTTCTTAT ACATACTCAA CAGCTGCTTC CCAAGATGCT GTAGGATTAT GTCTAGAGTC
AAACTAGCCA GAAGCAATGT CCAAAATACA CCATAACACT GTGCAGCAAA GGTCCTACTA CCACTTGTTT
GGCCCAAACA TTCTAGGCAG CACTGGATAT CTGAATCATC AATTATTTCC ACAAACACTG ACCCCTCTAC
CAGTCACCCT CACTAGAAGA ATTAATTCCA CATGATAATA GCTCCCTCAT GTTACTCCCT TCTAAGTCAA
ATTGTACACC CCTTTATCTG ATTAACAGAG TCTAAGTCAC ATGACCTAAA TGCAAGAGAA CTGGGAATGG
ACGTTTGTGG ATTCTACCTT AGTAAGGCAA AGTTATCATT GGGAATTCCT CTAATACAGG AAGGGTGTTC
CAGAGACATT AAGGAGCCAT ATAAATGGAA AATGTCCACT ACAATCCATC ACTTGGTTGC CCCACATCAA
CATTCATTCT TTTGCCACAC TTAAAGTTTC CAAGAACAAA AATTATCCCA CTGAACATAA TCTTTACTAT
CTTTTATATA AAGGAAAATT AGACTTGACT CAGCAGAACT GAAATAACCC AGCTCTAACA GTTACTGCTT
TTAACTTCAA GTACTGTGTC TCTAGGTGAT ACCTGCTCCA ACAATAGTTT GGTCACATTT TCAATTTGAT
ATTCTCTAGT CTCCCAACTT GATAACTGTA CCCTAAACCA TAAAGTTCAC TACCAACATG CTATATATAA
AATAACCAAA GGGGGAAGAA GAAAGAGAAA AAGGAAATCT CTTAAAATAC ACAGGTATAC ATATGACAAA
GCAAAGAAGG AAATGTGAGC AGATAGTGCA GTCCTCGTTT CTGAAATTGG TCCCCTGACT GGGGCTATAC
CTATTCCATT TCCTCACCCT CAGCCAGGCA GGTGGAGCAA AAACTTAAGT CTTGGTGGAT CTGAATCTTG
ATGCTGTGGA GCTGTCTTAC TAGCCCCAGA CTACCTGCCT CTCAATTTCT AATTATATCA GTGAAAGCAA
ACAGCTTTGA TTTGTTTAAG CCTCTGATTT TTTGGTCTAA CTGATGTAAG ACCACAAGGA CAAGAGTTCT
CCAGCTCCGG ATTCTCTTCT GTTCTGTTAA TGGTGAAATG CCCGAGAGAA GAGTTGCCAA CTTTGGCAAA
TAAAAAATAC AGGATTCCAG TTAAATTCAA ATTTAGATAA ACAACAATTT TTTAGTATTA GTGTGTCCCA
TTCAATATTT GGACATACTT AACTAAAAAA TGATTTGTTG TTCATCTGAA ATACAAATTT AACTGGGCAT
TCTGAATATT CTCTGGCAAC CCCCGAGAGA GTGAAGAAAG TGGTACAAGG ACACTTAAGA AGACCAGATT
TGAAAAGACA TTACGGATGT GTTTAAATGT CTTATTCTAG AGAGAGTTAG AGCTGTAGGT AGAACTTGGG
AAATTAAGTT AAAAGCAGAC ACAGAGACCT GGCCAATATA TACTAAGGAG TGGATCACTC TGGTCACAAG
CCCAACCTGA GACCAAGGGC ATAGTGAGAT GATTTGGGAA AGGCACTTAT ACACTACTCA TCCCCGTCTT
TGAACTAAAT GCCTTATAAA TCTCCAAGAG AAATGACAGT CCACCATGTG GACTGCTTTC TGTAAGTCCA
GGGAAAATAA AAGCTATGTG CTTGAAACCC ACTTCTGATA TTATAAGGTG TGTGATCTTT GTCATGTTAA
TGGGTCTGAG TATCAATTCT ACAATTGTAA AGTGACAGTA ATGGTGTGTC CCCAGGTTGT TGTGGAAAGC
TTGATTCTTA ATGCAACAGT AGGAAACCCC AGCCTCTCTG GAGCAAACAC CCTTCTACAT CTTTACTTCC
CCTGCACATT GGCAGGACTC TATTCCTCTA TTTCTCTCTA GTGCTAGAGC AGAAAGGGAC CTTGATTTGA
TATCAGGAAA ATCTATTTCT GAACCATAAG CTATGATAGC TGATTTAAAA AATTGACTAT CATGACATGA
TAATGATCAT AATGGTAATA CATATTGATA GGGTTGCCGT GAAAGTAATA ATATATCTAA GAGTTGTGAC
```

-continued

```
AATATATGAT ACGCCTAGAC TCTCAGAAAA TGCTAATTCC AATCCCAATT GCTCTTTGCA TAAAGTTCTG

TCCTAGGGTC TGTTCTTTTC CCACATCTAC CCTCCTTGGA TCTCTCTTCT GTCTTTTTCA TGTGGTTCAG

AGGAGGAGAG AGATCCAGGT CAATGTTTTT CAAATTACAA GGAATTATCA TTTAAATGGG AAGAAGCTC

AAGTTTTGAC GTGTAGTGGA ATTGGAGTGG AGTGGAGTGG AATGGAAACT AACAGGAAGA CACTGCACAT

GGTTAAGATA AAGATTGTTT CCTGAAACCT TTAATTTGTG CTTACATACT CACACATACA TATGTGCATG

CACTGGGACT CTGCAATATG CATTTCTGAC TATGGAACAT AGCCATAAAA GTCTTTGCAC TGAACGTTCA

GTGGGCCTTT CACAAGCTGC CCTAATTGGG AAAGAAAAAC ATGGTCCCTC CATTTCCTGC CCCCAACTCC

AGAAAAGTCA CCATAGTTGA GGGTACATCT GAGAAGCCAG CACTTGGGAG TTCAGGGCTC AAGTTCCTTT

CTAGAAAAAC ACTGGGTGAT CTAGGGGAA CTTCCGATCA GAAACAGCCA ATTCAGAGTG AGAAGAAA

ACGTGACCAT GCAGTTCCTG TGGTTACCAG CCTTGCCCCT CTCTTGCCTT CTGGGAGTTA TAAAACCCAA

GACTGGAAAG GAAAACCAGC ATTTGCTCAG GCAGCCTCTC TGGGAAGATG CTGCTTCTTC CTCTCCCCCT

GCTGCTCTTT CTCTTGTGCT CCAGAGCTGA AGCTGGTGAG TATCAGGGTT CTTCCCTCTG AAATCTGCAG

TATCAGCTCC TGAAACAAAG ATGTTTAGTC TGAAATAGCT GACTCCTAAA CAGGGTTCCA AGATCTCTCT

TCAAGAGTCC CACAGAGGAA ATTTCCACTT GGGATGTGTG CCACCCCACC CCCACCCCCA CCCACTGCCA

TTCTCTACAG CCTAGGACAC CCCCAGGAAC AAGGAATTTC ACCTCAATTG TAGAAAAGCC CAGAGCAAGT

GGAAGGAAAA GGGGTATCCC CAGGAAAACA GACATGTCCT CTTAATCTTC TGAGCATCAG GGCTACCCAT

TACTTTGTGA CTTTCTCACT CTGTGACCAT GCTCAAGAGC TATGGAGAAA TCTAAAACAG GAACCTGGAC

AGTGGGTCCT ACACAGAGAC AGAGGAGAGT GGGCCAGGGC AAGGTGGGAG TGGGAGAAGT CTGAGATGAA

AACATCAGAA TGGAGCAGAG GCAAGAATGA GATTTCACCT GGGAGGTTAT GGGTGGGGAA AGATACGAAA

TACAGGAGAC AGGAGAGGGA AGATGGGCGG AACACAGGGT GAGAATGAGA TTCCAGGGAA GCCTAGCTCA

GCTTTAACCC AATTTGTCCA TTCATTGGAG AGAGTATCTA TGGCCGTGTT CAAACCCTGG GGTGCTCTGT

TCCAGGGGAG ATCATCGGGG GCACAGAATG CAAGCCACAT TCCCGCCCCT ACATGGCCTA CCTGGAAATT

GTAACTTCCA ACGGTCCCTC AAAATTTTGT GGTGGTTTCC TTATAAGACG AACTTTGTG CTGACGGCTG

CTCATTGTGC AGGAAGGTGA GACAACAGGG TCTATTTATC TCCAAATGGG AGATGAACAA CCAGAGTAGC

ATCCAGGAAT ACACCTGCAC TGGGGACTGA AGAGGGGTC CTGGGTCTTG TCAACTTTCA GGAGAGGGAA

GACTTTGGGC TGAAAGACTT TAGTCTGTGT TTGAATAGTT CCTTGAGCCT CAGTCACTGA GCTAAGCTCC

CTTCGGAGGA AAAGGAGGTC CTGTCCGAAG GTCCCTCTTG TTGCAGTAGC ACCCCTCACC CCTACCCAAC

TCAAGACACA CGGCTCACTT TTCAGGGCCC CACCCAGTCT CAGGGCCACT TCCTCTATGG CCTTTTCAAG

AACACTGGCT CTAGTTCTCA GGGTCCTGAA CCCATCATTT TATGGGAGCA GAGAACAGGT CTACATAAGA

CCCCCACTTT CCCCTTTTAA CTGATATCTC CTGCTTCAGG GGCTGGCCCT CATGCAGGGT TCCCTGAATT

AGGAAGTGTG AACCCTGTCC CCTGAGTCCT CCCTGGCCTG TTCAGTCCCC AGCAATTCCA GGGGTCGTAG

AAATTGTGTC TGTTTCCTGA GAAAGCTCTT TCATGAGTTA AGCCTGAGCC CTCAAATGCC ACAAGTGGCC

CATGAAAAGG GAGATGGGTA GAGTCCGGCN ACCCAGTGAC AGAGTTTAGT CCTCTTTTCT CAGAATGAGC

TCACCTCAGA AGAAACCCCA AGCCATCACT GTCGCCTCCT TTTCCTTCCT TCTTCCTCAC AGCAGGTCTA

TAACAGTCAC CCTTGGAGCC CATAACATAA CAGAGGAAGA AGACACATGG CAGAAGCTTG AGGTTATAAA

GCAATTCCGT CATCCAAAAT ATAACACTTC TACTCTTCAC CACGTATATCA TGTTACTAAA GGTGACAACA

CCTCTCTTCT CCCTTTCCAC TTCCCATTCT CCTAAGCTTC TCCTTCAGGT CCTCATTGCC CTGAATTTTT

CTTAGGACTT GGCTATAACA TGAAGCTACT CACCCTGTCC CTCCCTGATC ACCTCCAACT GTCCAGAGCC

CATTTCGAGG ACTCACAGTC CTTCATTCCC TTCACAGTTG AAGGAGAAAG CCAGCCTGAC CCTGGCTGTG
```

-continued

```
GGGACACTCC CCTTCCCATC ACAATTCAAC TTTGTCCCAC CTGGGAGAAT GTGCCGGGTG GCTGGCTGGG

GAAGAACAGG TGTGTTGAAG CCGGGCTCAG ACACTCTGCA AGAGGTGAAG CTGAGACTCA TGGATCCCCA

GGCCTGCAGC CACTTCAGAG ACTTTGACCA CAATCTTCAG CTGTGTGTGG GCAATCCCAG GAAGACAAAA

TCTGCATTTA AGGTGATCCT CCAACTAGGT TTCCTCTCCA AAACTCACTG TTCAGGGACC TGAATGCTCT

TAGAAGGAGA TGGGGTCAGC AGGTTGTCAG TCAGGTGACA GGGTGAGCAT CACAGGAATT GCTGTCCTCC

CGTGGTCCAA GACAGCCTCT GACCATCCAT TCCAGTCTAC TGCACTGGGG GCATGGGGTG ACTGTGGAGA

ATGTGGATGA CGGTCCCAAG AAAGGAAGAA GGGGCATCAG AACTAGATGT ATAAGTGAGG AGCTCCACCT

CCTGGGTCTG ACTTTAGGTC TCACTGTGAC TCCAAGCTGG CTGGCAGACA GGAGTGGAGG ACTTCCCGGG

CTCACCTTCT TCTCTCTCTC CTCCCCCTAC AGGGAGACTC TGGGGGCCCT CTTCTGTGTG CTGGGGTGGC

CCAGGGCATC GTATCCTATG GACGGTCGGA TGCAAAGCCC CCTGCTGTCT TCACCCGAAT CTCCCATTAC

CGGCCCTGGA TCAACCAGAT CCTGCAGGCA AATTAATCCT GGATCCTGAG CCAGCCTGAA GGGAAGCTGG

AACTGGACCT TAGCAGCAAA GTGTGTGCAA CTCATTCTGG TTCTACCCTT GGTTCCCTCA GCCACAACCC

TAAGCCTCCA AGAGGTCTCC TACAGGTAAC AGAACTTTCA ATAAACTTCA GTGAAGACAC AGCTTCTAGT

CCTGAGTGTG TGTCCCTCTC TGCTGCTCTC TTCTCCTGCA CATGTGACCT GATTCCCAGC CCAAGCACCA AGGA-3'
```

(FRAG. NO: _ ) (SEQ. ID NO: 2467)

5'-GGBGCBCBBG-3' (FRAG. NO: 1888) (SEQ. ID NO: 1901)

5'-GBBGCBGC-3' (FRAG. NO: 1889) (SEQ. ID NO: 1902)

5'-GGGGCBBGG CG-3' (FRAG. NO: 1890) (SEQ. ID NO: 1903)

5'-CGTTTTCTTCTCTC-3' (FRAG. NO: 1369) (SEQ. ID NO: 1378)

5'-GCTGGTTTTCCTTTCC-3' (FRAG. NO: 1370) (SEQ. ID NO: 1379)

5'-TGGCAGTGGGTGGGGTGGGGTGGGTGGC-3' (FRAG. NO: 1371) (SEQ. ID NO: 1380)

5'-TTCCTTGTTCCTGGGGTGTCCT-3' (FRAG. NO: 1372) (SEQ. ID NO: 1381)

5'-CTTGCTCTGGGCTTTTCT-3' (FRAG. NO: 1373) (SEQ. ID NO: 1382)

5'-CCCCTTTTCCTTCC-3' (FRAG. NO: 1374) (SEQ. ID NO: 1383) [

5'-TGTCTGTTTTCCTGGGG-3' (FRAG. NO: 1375) (SEQ. ID NO: 1384)

5'-CTCTCCTCTGTCTCTGTGT-3' (FRAG. NO: 1376) (SEQ. ID NO: 1385)

5'-CCTTGCCCTGGCCC-3' (FRAG. NO: 1377) (SEQ. ID NO: 1386)

5'-TCTTCCCTCTCCTGTCTCCTGT-3' (FRAG. NO: 1378) (SEQ. ID NO: 1387)

5'-CCCTGTGTTCCGCCC-3' (FRAG. NO: 1379) (SEQ. ID NO: 1388)

5'-GTCTTCCCTCTCCTG-3' (FRAG. NO: 1380) (SEQ. ID NO: 1389)

5'-ACCTCCTTTTCCTCCG-3' (FRAG. NO: 1381) (SEQ. ID NO: 1390)

5'-CTGGGTGGGGCCCTG-3' (FRAG. NO: 1382) (SEQ. ID NO: 1391)

5'-CCTGTTCTCTGCTCCC-3' (FRAG. NO: 1383) (SEQ. ID NO: 1392)

5'-TGGCTTGGGGTTTCTTCTG-3' (FRAG. NO: 1384) (SEQ. ID NO: 1393)

5'-TGTGTCTTCTTCCTCTGTT-3' (FRAG. NO: 1385) (SEQ. ID NO: 1394)

5'-GGCTGGCTTTCTCCTTC-3' (FRAG. NO: 1386) (SEQ. ID NO: 1395)

5'-TTTTGTCTTCCTGGG-3' (FRAG. NO: 1387) (SEQ. ID NO: 1396) [1397)]

5'-TGCCCCTTCTTCCTTTCTTGGG-3' (FRAG. NO: 1388) (SEQ. ID NO: 1397)

5'-TCCTTGGTGCTGGGCTGGG-3' (FRAG. NO: 1389) (SEQ. ID NO: 1398)

5'-GGBGCTGBTB CTGCBGATTT CBGBGGGBBG BBCCCTGBTB CTCBCCBGCT TCBGCTCTGG BGCBCBBGBG

-continued

```
BBBGBGCBGC BGGGGGBGBG GBBGBBGCBG CBTCTTCCCB GBGBGGCTGC CTGBGCBBBT GCTGGTTTTC
CTTTCCBGTC TTGGGTTTTB TBBCTCCCBG BBGGCBBGBG BGGGGCBBGG-3' (FRAG. NO: 1891) (SEQ. ID NO: 1904)
Endothethelial Nitric Oxide Synthase Nucleic Acids and Antisense Oligonucleotide Fragments
5'-GCGTCTTGGG GTGCBGGGCC CBTCCTGCTG CGCCTGGGCG CTGCTGTGCG TCCGTCTGCT GGGGGGCCGG
GGTGGCTGGG CCCTGCTTGC CGCACGACCC CGGGCCGACC CGAGGCTCGG GGGGCTGTGT TCTGGCGCTG
GTGGGCTTGG GCCCCTCTGG GGGCTGGGTT TCCTGCTGCG CCTGGGCGCT GGCGTCTTGG GGTGCGGGGC
CGGGGGGCCG GGGGGCCGCT GTTCGTGGGC CTGGGGGTGC CTGTGGCTGC CGGTTGCCCC GGTTGGTGGC
GCCGTCCTGC TGCCGGTCGT TGGCTGGGTC CCCCCGCCCG TTTCCTGGGG TCCGCGTGGG GTGCTCCGGT
TCCTCGTGCC GCTGCTGCCT TGTCTTTCCG GCCGTGGCGG CGTGGTGGTC CGCCCCCCCT GGCCTTCTGC
TCGGGGTCTG GCTGGTTGCC GGTGCCCTTG GCGGCGGTCT TCTTCCTGGT GGCTCTGGGC CCGGCCGGTC
TCGGGCGTCT CGTGTTCGCT CTTGTGCTGT TCCGGCCGCT CCTTCCTCTT CCGCCGCCGC CGCTCCCCGC
CCGCTCGTCG CCCTGGCCCG GCCTCCTCCT GGCCGCTGTC TCGGGCGGCG GCCTTGGCGC TCCGTTTGGG
GCTGCCTCTG GCGCTTCCGG CCCTCGGCCT GGGCGCTCTC TTCCGCCTGT GCTGGTGGCC CTCGTGGGCC
CCTCCTGGCC TCCGGTGTCC TGTGGTCCCC CGGCTGGTGG CCGGGCCGGT TGGGCGGGCG TGGGCGCCGG
CGGGTCCTCC GGGCTGCCCT TCTCCGCCGG GGGTCCCGCG CTCCTGCTGT TCCCTGGGCT CTTCTGCCTC
TCTCCTGGGT GGGTGCTGGG TGCCGGGGTC TCCGGGCTTG CCCCGCGCTG CTGGGCGTTC TGCGGTCTTG
GGGTTGTCTG TGGCCCCGCT CGTGTCGCCC TCCGTCGCCC GTCGCCGGCC TCGTCCCCTC CTGGGTGCGC
GGCGGGCTGG TCCTGGCGTT TTGCTCCTTC CTGGGCGTCT TGGGGTGCBG GGCCCBTCCT GCTGCGCCTG
GGCGCTGCTG TGCGTCCGTC TGCTGGGGGG CCGGGGTGGC TGGGCCCTGC TTGCCGCACG ACCCCGGGCC
GACCCGAGGC TCGGGGGGCT GTGTTCTGGC GCTGGTGGGC TTGGGCCCCT CTGGGGGCTG GGTTTCCTGC
TGCGCCTGGG CGCTGGCGTC TTGGGGTGCG GGGCCGGGGG GCCGGGGGGC CGCTGTTCGT GGGCCTGGGG
GTGCCTGTGG CTGCCGGTTG CCCCGGTTGG TGGCGCCGTC CTGCTGCCGG TCGTTGGCTG GGTCCCCCCG
CCCGTTTCCT GGGGTCCGCG TGGGGTGCTC CGGTTCCTCG TGCCGCTGCT GCGTTGTCTT TCCGGCCGTG
GCGGCGTGGT GGTCCGCCCC CCCTGGCCTT CTGCTCGGGG TCTGGCTGGT TGCCGGTGCC CTTGGCGGCG
GTCTTCTTCC TGGTGGCTCT GGGCCCGGCC GGTCTCGGGC GTCTCGTGTT CGCTCTTGTG CTGTTCCGGC
CGCTCCTTCC TCTTCCGCCG CCGCCGCTCC CCGCCCGCTC GTCGCCCTGG CCCGGCCTCC TCCTGGCCGC
TGTCTCGGGC GGCGGCCTTG GCGCTCCGTT TGGGGCTGCC TCTGGCGCTT CCGGCCCTCG GCCTGGGCGC
TCTCTTCCGC CTGTGCTGGT GGCCCTCGTG GGCCCCTCCT GGCCTCCGGT GTCCTGTGGT CCCCCGGCTG
GTGGCCGGGC CGGTTGGGCG GGCGTGGGCG CCGGCGGGTC CTCCGGGCTG CCCTTCTCCG CCGGGGGTCC
CGCGCTCCTG CTGTTCCCTG GGCTCTTCTG CCTCTCTCCT GGGTGGGTGC TGGGTGCCGG GGTCTCCGGG
CTTGCCCCGC GCTGCTGGGC GTTCTGCGGT CTTGGGGTTG TCTGTGGCCC CGCTCGTGTC GCCCTCCGTC
GCCCGTCGCC GGCCTCGTCC CCTCCTGGGT GCGCGGCGGG CTGGTCCTGG CGTTTTGCTC CTTCCTGG-3' (FRAG.
NO: 1892) (SEQ. ID NO: 1905)
5'-GCGGGGCCG-3' (FRAG. NO: 1893) (SEQ. ID NO: 1906)
5'-CGGGGGGC-3' (FRAG. NO: 1894) (SEQ. ID NO: 1907)
5'-GCGCGGCGGGC-3' (FRAG. NO: 1895) (SEQ. ID NO: 1908)
5'-CTGTGCGTCCGTCTGCTGG (FRAG. NO: 1390) (SEQ. ID NO: 1399)
GGGGCCGGGGTGGCTGGGCCCTGCTTGCCGC (FRAG. NO: 1391) (SEQ. ID NO: 1400)
ACGACCCCGGGCCGACCCGAG (FRAG. NO: 1392) (SEQ. ID NO: 1401)
```

-continued

GCTCGGGGGGCTGTGTTCTGGCGCTGGTGGG (FRAG. NO: 1393) (SEQ. ID NO: 1402)

CTTGGGCCCCTCTGGGGGCTGGGTT (FRAG. NO: 1394) (SEQ. ID NO: 1403)

TCCTGCTGCGCCTGGGCGCTG (FRAG. NO: 1395) (SEQ. ID NO: 1404)

GCGTCTTGGGGTGC (FRAG. NO: 1396) (SEQ. ID NO: 1405)

GGGGCCGGGGGGCCGGGGG (FRAG. NO: 1397) (SEQ. ID NO: 1406)

GCCGCTGTTCGTGGGCCTGGG (FRAG. NO: 1398) (SEQ. ID NO: 1407)

GGTGCCTGTGGCTGCC (FRAG. NO: 1399) (SEQ. ID NO: 1408)

GGTTGCCCCGGTTGGTGGC (FRAG. NO: 1400) (SEQ. ID NO: 1409)

GCCGTCCTGCTGCCGGT (FRAG. NO: 1401) (SEQ. ID NO: 1410)

CGTTGGCTGGGTCCCCCGC (FRAG. NO: 1402) (SEQ. ID NO: 1411)

CCGTTTCCTGGGGTCC (FRAG. NO: 1403) (SEQ. ID NO: 1412)

GCGTGGGGTGCTCC (FRAG. NO: 1404) (SEQ. ID NO: 1413)

GGTTCCTCGTGCCG (FRAG. NO: 1405) (SEQ. ID NO: 1414)

CTGCTGCCTTGTCTTTCC (FRAG. NO: 1406) (SEQ. ID NO: 1415)

GGCCGTGGCGGCGTGGTGGTCC (FRAG. NO: 1407) (SEQ. ID NO: 1416)

GCCCCCCCTGGCCTTCTGCTC (FRAG. NO: 1408) (SEQ. ID NO: 1417)

GGGGTCTGGCTGGT (FRAG. NO: 1409) (SEQ. ID NO: 1418)

TGCCGGTGCCCTTGGCGGC (FRAG. NO: 1410) (SEQ. ID NO: 1419)

GGTCTTCTTCCTGGTG (FRAG. NO: 1411) (SEQ. ID NO: 1420)

GCTCTGGGCCCGGCCGGTCTCGG (FRAG. NO: 1412) (SEQ. ID NO: 1421)

GCGTCTCGTGTTCG (FRAG. NO: 1413) (SEQ. ID NO: 1422)

CTCTTGTGCTGTTCCGGCCG (FRAG. NO: 1414) (SEQ. ID NO: 1423)

CTCCTTCCTCTTCCGCCGCC (FRAG. NO: 1415) (SEQ. ID NO: 1424)

GCCGCTCCCCGCCC (FRAG. NO: 1416) (SEQ. ID NO: 1425)

GCTCGTCGCCCTGGCCC (FRAG. NO: 1417) (SEQ. ID NO: 1426)

GGCCTCCTCCTGGCCGC (FRAG. NO: 1418) (SEQ. ID NO: 1427)

TGTCTCGGGCGGCGGCCTTGGC (FRAG. NO: 1419) (SEQ. ID NO: 1428)

GCTCCGTTTGGGGCTG (FRAG. NO: 1420) (SEQ. ID NO: 1429)

CCTCTGGCGCTTCC (FRAG. NO: 1421) (SEQ. ID NO: 1430)

GGCCCTCGGCCTGGGCGCTC (FRAG. NO: 1422) (SEQ. ID NO: 1431)

TCTTCCGCCTGTGC (FRAG. NO: 1423)(SEQ. ID NO:1432)

TGGTGGCCCTCGTGG (FRAG. NO:1424)(SEQ. ID NO:1433)

GCCCCTCCTGGCCTCCGGTGTCC (FRAG. NO:1425)(SEQ. ID NO:1434)

TGTGGTCCCCGGCTGGT (FRAG. NO:1426)(SEQ. ID NO:1435)

GGCCGGGCCGGTTGGGCGGGC (FRAG. NO:1427)(SEQ. ID NO:1436)

GTGGGCGCCGGCGGGTCCTCC (FRAG. NO:1428)(SEQ. ID NO:1437)

GGGCTGCCCTTCTCC (FRAG. NO:1429)(SEQ. ID NO:1438)

GCCGGGGTCCCGC (FRAG. NO:1430)(SEQ. ID NO:1439)

GCTCCTGCTGTTCCCTGGGCTCTTCTGCC (FRAG. NO:1431)(SEQ. ID NO:1440)

TCTCTCCTGGGTGGGTGCTGGGTGCCG (FRAG. NO:1432)(SEQ. ID NO:1441)

-continued

GGGTCTCCGGGCTTG (FRAG. NO:1433)(SEQ. ID NO:1442)

CCCCGCGCTGCTGGGCGTTCTGC (FRAG. NO: 1434)(SEQ. ID NO:1443)

GGTCTTGGGGTTGTC (FRAG. NO:1435)(SEQ. ID NO:1444)

TGTGGCCCCGCTCG (FRAG. NO:1436)(SEQ. ID NO:1445)

TGTCGCCCTCCGTCGCC (FRAG. NO:1437)(SEQ. ID NO:1446)

CGTCGCCGGCCTCGTCC (FRAG. NO:1438)(SEQ. ID NO:1447)

CCTCCTGGGTGCGC (FRAG. NO:1439)(SEQ. ID NO:1448)

GGCGGGCTGGTCCT (FRAG. NO:1440)(SEQ. ID NO:1449)

GGCGTTTTGCTCCTTCCTGG (FRAG. NO:1441)(SEQ. ID NO:1450)

5'-GCGTCTTGGGGTGCBGGGCCCBTCCTGCTGCGCCTGGGCGCTG-3'(FRAG. NO:1896) (SEQ. ID NO: 1909)

Inducible Nitric Oxide Synthase Nucleic Acids and
Antisense Oligonucleotide Fragments

5'-CTGCCCCBGT TTTTGBTCCT CBCBTGCCGT GGGGBGGBCB BTGGCTGCCT CCCCGGGGTT TCTGCTGCTT

GCTGCTTCTT TCCCGTCTCC CTTCTTTCCC GTCTCCTTTT TGCCTCTTTG GGTTCCTGTT GTTTCTGGCC

TGCTTGGTGG CGGCTTGTGC GTTTCCTCTC TCTTCTCTTG GGTCTCCGCT TCTCGTCCTG CCTTTTCCTG

TCTCTGTCGC GCCGTTCCTC CTCCGGCGTC CTCCTGCCCT GTGCTGTTTG CCTCGGGTGG TGCGGGTCCC

GGTGCTCCCC CGGCGGGCCG GCTGGTTGCC TGGGCCTGTC TGGTGGGGTG TGGGGCCGCT GGGTTGGGGG

TGTGGTGGGC TCTTCTGTGG CCTGTGGGGC TGTTGGTGTC TCTGTGGGCG TGTGCTGGGT CTTGGGGCTT

CCTCCCTTGT GCTGGGTGCG GCCTCCCCGC CCCCCTTCTG GGCCGGTGGC CTGGCTCCTT GTGGGCGCTT

CTGGCTCTTG CCCTGTCCTT CTTCGCCTCG TGGCTGCTGG GCTGC CATATGTATG GAATACTGT ATTTCAGGCA

TTATAAGGAA TGAAATTATA GGCCGGGCAT TGTGGCTAAC CCTTGTAATC CTAGCACTTT GAGAGGCTGA

AGTGGGCAGA TCACTTGAGC TTCAGAGTTC GAGACCAGCA TGGACAACAT GGTGAAACCC AGTCTCTACC

AAAAACACAA AAATATTAGC TGGGTGTGGT GGTGCATGCC TGTAGTCCCA GCTACTCAGG AGGCTGAGGT

GGGAGGATCG CTTGAGCCTG GGAGGCAGAA GTTGCAATGA GCAGAGATCG TGCCACTCCG CTCCAGTCTT

GGTGACAGAA TGAGACTCCA TCTCAAAAAT AAATAAATAA ATAAATAAAA TAAATGAAAT GAAATTATAA

GAAATTACCA CTTTTTCATG TAAGAAGTGA TCATTTCCAT TATAAGGGAA GGAATTTAAT CCTACCTGCC

ATTCCACCAA AGCTTACCTA GTGCTAAAGG ATGAGGTGTT AGTAAGACCA ACATCTCAGA GGCCTCTCTG

TGCCAATAGC CTTCCTTCCT TTCCCTTCCA AAAACCTCAA GTGACTAGTT CAGAGGCCTG TCTGGAATAA

TGGCATCATC TAATATCACT GGCCTTCTGG AACCTGGGCA TTTTGCAGTG TGTTCCATAC TGTCAATATT

CCCCCAGCTT CCTGGACTCC TGTCACAAGC TGGAAAAGTG AGAGGATGGA CAGGGATTAA CCAGAGAGCT

CCCTGCTGAG GAAAAAATCT CCCAGATGCT GAAAGTGAGG CCATGTGGCT TGGCCAAATA AAACCTGGCT

CCGTGGTGCC TCTGTCTTAG CAGCCACCCT GCTGATGAAC TGCCACCTTG GACTTGGGAC CAGAAAGAGG

TGGGTTGGGT GAAGAGGCAC CACACAGAGT GATGTAACAG CAAGATCAGG TCACCCACAG GCCCTGGCAG

TCACAGTCAT AAATTAGCTA ACTGTACACA AGCTGGGGAC ACTCCCTTTG GAAACCAAAA AAAAAAAAA

AAAAAAGAGA CCTTTATGCA AAAACAACTC TCTGGATGGC ATGGGTGAG TATAAATACT TCTTGGCTGC

CAGTGTGTTC ATAACTTTGT AGCGAGTCGA AAACTGAGGC TCCGGCCGCA GAGAACTCAG CCTCATTCCT

GCTTTAAAAT CTCTCGGCCA CCTTTGATGA GGGGACTGGG CAGTTCTAGA CAGTCCCGAA GTTCTCAAGG

CACAGGTCTC TTCCTGGTTT GACTGTCCTT ACCCCGGGGA GGCAGTGCAG CCAGCTGCAA GGTGAGTTGC C

CATATGTATG GAATACTGT ATTTCAGGCA TTATAAGGAA TGAAATTATA GGCCGGGCAT TGTGGCTAAC

```
CCTTGTAATC CTAGCACTTT GAGAGGCTGA AGTGGGCAGA TCACTTGAGC TTCAGAGTTC GAGACCAGCA
TGGACAACAT GGTGAAACCC AGTCTCTACC AAAAACACAA AAATATTAGC TGGGTGTGGT GGTGCATGCC
TGTAGTCCCA GCTACTCAGG AGGCTGAGGT GGGAGGATCG CTTGAGCCTG GGAGGCAGAA GTTGCAATGA
GCAGAGATCG TGCCACTCCG CTCCAGTCTT GGTGACAGAA TGAGACTCCA TCTCAAAAAT AAATAAATAA
ATAAATAAAA TAAATGAAAT GAAATTATAA GAAATTACCA CTTTTTCATG TAAGAAGTGA TCATTTCCAT
TATAAGGGAA GGAATTTAAT CCTACCTGCC ATTCCACCAA AGCTTACCTA GTGCTAAAGG ATGAGGTGTT
AGTAAGACCA ACATCTCAGA GGCCTCTCTG TGCCAATAGC CTTCCTTCCT TTCCCTTCCA AAAACCTCAA
GTGACTAGTT CAGAGGCCTG TCTGGAATAA TGGCATCATC TAATATCACT GGCCTTCTGG AACCTGGGCA
TTTTCCAGTG TGTTCCATAC TGTCAATATT CCCCCAGCTT CCTGGACTCC TGTCACAAGC TGGAAAAGTG
AGAGGATGGA CAGGGATTAA CCAGAGAGCT CCCTGCTGAG GAAAAAATCT CCCAGATGCT GAAAGTGAGG
CCATGTGGCT TGGCCAAATA AAACCTGGCT CCGTGGTGCC TCTGTCTTAG CAGCCACCCT GCTGATGAAC
TGCCACCTTG GACTTGGGAC CAGAAAGAGG TGGGTTGGGT GAAGAGGCAC CACACAGAGT GATGTAACAG
CAAGATCAGG TCACCCACAG GCCCTGGCAG TCACAGTCAT AAATTAGCTA ACTGTACACA AGCTGGGGAC
ACTCCCTTTG GAAACCAAAA AAAAAAAAAA AAAAAGAGA CCTTTATGCA AAACAACTC TCTGGATGGC
ATGGGGTGAG TATAAATACT TCTTGGCTGC CAGTGTGTTC ATAACTTTGT AGCGAGTCGA AAACTGAGGC
TCCGGCCGCA GAGAACTCAG CCTCATTCCT GCTTTAAAAT CTCTCGGCCA CCTTTGATGA GGGGACTGGG
CAGTTCTAGA CAGTCCCGAA GTTCTCAAGG CACAGGTCTC TTCCTGGTTT GACTGTCCTT ACCCCGGGGA
GGCAGTGCAG CCAGCTGCAA GGTGAGTTGC C-3' (FRAG. NO:_)(SEQ. ID NO: 3016)
5'-CTGCTTTAAA ATCTCTCGGC CACCTTTGAT GAGGGACTG GCAGTTCTA GACAGTCCCG AAGTTCTCAA
GGCACAGGTC TCTTCCTGGT TTGACTGTCC TTACCCCGGG GAGGCAGTGC AGCCAGCTGC AAGCCCCACA
GTGAAGAACA TCTGAGCTCA AATCCAGATA AGTGACATAA GTGACCTGCT TGTAAAGCC ATAGAGATGG
CCTGTCCTTG GAAATTTCTG TTCAAGACCA AATTCCACCA GTATGCAATG AATGGGGAAA AAGACATCAA
CAACAATGTG GAGAAAGCCC CCTGTGCCAC CTCCAGTCCA GTGACACAGG ATGACCTTCA GTATCACAAC
CTCAGCAAGC AGCAGAATGA GTCCCCGCAG CCCCTCGTGG AGACGGGAAA GAAGTCTCCA GAATCTCTGG
TCAAGCTGGA TGCAACCCCA TTGTCCTCCC CACGGCATGT GAGGATCAAA ACTGGGGCA GCGGGATGAC
TTTCCAAGAC ACACTTCACC ATAAGGCCAA AGGGATTTTA ACTTGCAGGT CCAAATCTTG CCTGGGGTCC
ATTATGACTC CCAAAAGTTT GACCAGAGGA CCCAGGGACA AGCCTACCCC TCCAGATGAG CTTCTACCTC
AAGCTATCGA ATTTGTCAAC CAATATTACG GCTCCTTCAA AGAGGCAAAA ATAGAGGAAC ATCTGGCCAG
GGTGGAAGCG GTAACAAAGG AGATAGAAAC AACAGGAACC TACCAACTGA CGGGAGATGA GCTCATCTTC
GCCACCAAGC AGGCCTGGCG CAATGCCCCA CGCTGCATTG GGAGGATCCA GTGGTCCAAC CTGCAGGTCT
TCGATGCCCG CAGCTGTTCC ACTGCCCGGG AAATGTTTGA ACACATCTGC AGACACGTGC GTTACTCCAC
CAACAATGGC AACATCAGGT CGGCCATCAC CGTGTTCCCC CAGCGGAGTG ATGGCAAGCA CGACTTCCGG
GTGTGGAATG CTCAGCTCAT CCGCTATGCT GGCTACCAGA TGCCAGATGG CAGCATCAGA GGGGACCCTG
CCAACGTGGA ATTCACTCAG CTGTGCATCG ACCTGGGCTG GAAGCCCAAG TACGGCCGCT TCGATGTGGT
CCCCCTGGTC CTGCAGGCCA ATGGCCGTGA CCCTGAGCTC TTCGAAATCC CACCTGACCT TGTGCTTGAG
GTGGCCATGG AACATCCCAA ATACGAGTGG TTTCGGGAAC TGGAGCTAAA GTGGTACGCC CTGCCTGCAG
TGGCCAACAT GCTGCTTGAG GTGGGCGCC TGGAGTTCCC AGGGTGCCCC TTCAATGCT GGTACATGGG
CACAGAGATC GGAGTCCGGG ACTTCTGTGA CGTCCAGCGC TACAACATCC TGGAGGAAGT GGGCAGGAGA
ATGGGCCTGG AAACGCACAA GCTGGCCTCG CTCTGGAAAG ACCAGGCTGT CGTTGAGATC AACATTGCTG
TGATCCATAG TTTTCAGAAG CAGAATGTGA CCATCATGGA CCACCACTCG GCTGCAGAAT CCTTCATGAA
```

-continued

```
GTACATGCAG AATGAATACC GGTCCCGTGG GGGCTGCCCG GCAGACTGGA TTTGGCTGGT CCCTCCCATG
TCTGGGAGCA TCACCCCCGT GTTTCACCAG GAGATGCTGA ACTACGTCCT GTCCCCTTTC TACTACTATC
AGGTAGAGGC CTGGAAAACC CATGTCTGGC AGGACGAGAA GCGGAGACCC AAGAGAAGAG AGATTCCATT
GAAAGTCTTG GTCAAAGCTG TGCTCTTTGC CTGTATGCTG ATGCGCAAGA CAATGGCGTC CCGAGTCAGA
GTCACCATCC TCTTTGCGAC AGAGACAGGA AAATCAGAGG CGCTGGCCTG GACCTGGGG GCCTTATTCA
GCTGTGCCTT CAACCCCAAG GTTGTCTGCA TGGATAAGTA CAGGCTGAGC TGCCTGGAGG AGGAACGGCT
GCTGTTGGTG GTGACCAGTA CGTTTGGCAA TGGAGACTGC CCTGGCAATG GAGAGAAACT GAAGAAATCG
CTCTTCATGC TGAAAGAGCT CAACAACAAA TTCAGGTACG CTGTGTTTGG CCTCGGCTCC AGCATGTACC
CTCGGTTCTG CGCCTTTGCT CATGACATTG ATCAGAAGCT GTCCCACCTG GGGCCTCTC AGCTCACCCC
GATGGGAGAA GGGGATGAGC TCAGTGGGCA GGAGGACGCC TTCCGCAGCT GGGCCGTGCA AACCTTCAAG
GCAGCCTGTG AGACGTTTGA TGTCCGAGGC AAACAGCACA TTCAGATCCC CAAGCTCTAC ACCTCCAATG
TGACCTGGGA CCCGCACCAC TACAGGCTCG TGCAGGACTC ACAGCCTTTG GACCTCAGCA AAGCCCTCAG
CAGCATGCAT GCCAAGAACG TGTTCACCAT GAGGCTCAAA TCTCGGCAGA ATCTACAAAG TCCGACATCC
AGCCGTGCCA CCATCCTGGT GGAACTCTCC TGTGAGGATG GCCAAGGCCT GAACTACCTG CCGGGGGAGC
ACCTTGGGGT TTGCCCAGGC AACCAGCCGG CCCTGGTCCA AGGCATCCTG GAGCGAGTGG TGGATGGCCC
CACACCCCAC CAGACAGTGC GCCTGGAGGA CCTGGATGAG AGTGGCAGCT ACTGGGTCAG TGACAAGAGG
CTGCCCCCCT GCTCACTCAG CCAGGCCCTC ACCTACTCCC CGGACATCAC CACACCCCCA ACCCAGCTGC
TGCTCCAAAA GCTGGCCCAG GTGGCCACAG AAGAGCCTGA GAGACAGAGG CTGGAGGCCC TGTGCCAGCC
CTCAGAGTAC AGCAAGTGGA AGTTCACCAA CAGCCCCACA TTCCTGGAGG TGCTAGAGGA GTTCCCGTCC
CTGCGGGTGT CTGCTGGCTT CCTGCTTTCC CAGCTCCCCA TTCTGAAGCC CAGGTTCTAC TCCATCAGCT
CCTCCCGGGA TCACACGCCC ACGGAGATCC ACCTGACTGT GGCCGTGGTC ACCTACCACA CCGGAGATGG
CCAGGGTCCC CTGCACCACG GTGTCTGCAG CACATGGCTC AACAGCCTGA AGCCCCAAGA CCCAGTGCCC
TGCTTTGTGC GGAATGCCAG CGCCTTCCAC CTCCCCGAGG ATCCCTCCCA TCCTTGCATC CTCATCGGGC
CTGGCACAGG CATCGTGCCC TTCCGCAGTT TCTGGCAGCA ACGGCTCCAT GACTCCCAGC ACAAGGGAGT
GCGGGGAGGC CGCATGACCT TGGTGTTTGG GTGCCGCCGC CCAGATGAGG ACCACATCTA CCAGGAGGAG
ATGCTGGAGA TGGCCCAGAA GGGGGTGCTG CATGCGGTGC ACACAGCCTA TTCCCGCCTG CCTGGCAAGC
CCAAGGTCTA TGTTCAGGAC ATCCTGCGGC AGCAGCTGGC CAGCGAGGTG CTCCGTGTGC TCCACAAGGA
GCCAGGCCAC CTCTATGTTT GCGGGGATGT GCGCATGGCC CGGACGTGG CCCACACCCT GAAGCAGCTG
GTGGCTGCCA AGCTGAAATT GAATGAGGAG CAGGTCGAGG ACTATTTCTT TCAGCTCAAG AGCCAGAAGC
GCTATCACGA AGATATCTTC GGTGCTGTAT TTCCTTACGA GGCGAAGAAG GACAGGGTGG CGGTGCAGCC
CAGCAGCCTG GAGATGTCAG CGCTCTGAGG GCCTACAGGA GGGGTTAAAG CTGCCGGCAC AGAACTTAAG
GATGGAGCCA GCTCTGCATT ATCTGAGGTC ACAGGGCCTG GGGAGATGGA GGAAAGTGAT ATCCCCCAGC
CTCAAGTCTT ATTTCCTCAA CGTTGCTCCC CATCAAGCCC TTTACTTGAC CTCCTAACAA GTAGCACCCT
GGATTGATCG GAGCCTCCTC TCTCAAACTG GGGCCTCCCT GGTCCCTTGG AGACAAAATC TTAAATGCCA
GGCCTGGCGA GTGGGTGAAA GATGGAACTT GCTGCTGAGT GCACCACTTC AAGTGACCAC CAGGAGGTGC
TATCGCACCA CTGTGTATTT AACTGCCTTG TGTACAGTTA TTTATGCCTC TGTATTTAAA AAACTAACAC
CCAGTCTGTT CCCCATGGCC ACTTGGGTCT TCCCTGTATG ATTCCTTGAT GGAGATATTT ACATGAATTG
CATTTTACTT TAATC GAATTCCCAC TCTGCTGCCT GCTCCAGCAG ACGGACGCAC AGTAACATGG GCAACTTGAA
GAGCGTGGCC CAGGAGCCTG GGCCACCCTG CGGCCTGGGG CTGGGCTGG GCCTTGGGCT GTGCGGCAAG
```

-continued

```
CAGGGCCCAG CCACCCCGGC CCCTGAGCCC AGCCGGGCCC CAGCATCCCT ACTCCCACCA GCGCCAGAAC
ACAGCCCCCC GAGCTCCCCG CTAACCCAGC CCCCAGAGGG GCCCAAGTTC CCTCGTGTGA AGAACTGGGA
GGTGGGGAGC ATCACCTATG ACACCCTCAG CGCCCAGGCG CAGCAGGATG GGCCCTGCAC CCCAAGACGC
TGCCTGGGCT CCCTGGTATT TCCACGGAAA CTACAGGGCC GGCCCTCCCC CGGCCCCCCG GCCCCTGAGC
AGCTGCTGAG TCAGGCCCGG GACTTCATCA ACCAGTACTA CAGCTCCATT AAGAGGAGCG GCTCCCAGGC
CCACGAACAG CGGCTTCAAG AGGTGGAAGC CGAGGTGGCA GCCACAGGCA CCTACCAGCT TAGGGAGAGC
GAGCTGGTGT TCGGGGCTAA GCAGGCCTGG CGCAACGCTC CCCGCTGCGT GGGCCGGATC CAGTGGGGGA
AGCTGCAGGT GTTCGATGCC CGGGACTGCA GGTCTGCACA GGAAATGTTC ACCTACATCT GCAACCACAT
CAAGTATGCC ACCAACCGGG GCAACCTTCG CTCGGCCATC ACAGTGTTCC CGCAGCGCTG CCCTGGCCGA
GGAGACTTCC GAATCTGGAA CAGCCAGCTG GTGCGCTACG CGGGCTACCG GCAGCAGGAC GGCTCTGTGC
GGGGGGACCC AGCCAACGTG GAGATCACCG AGCTCTGCAT TCAGCACGGC TGGACCCCAG GAAACGGTCG
CTTCGACGTG CTGCCCCTGC TGCTGCAGGC CCCAGATGAG CCCCCAGAAC TCTTCCTTCT GCCCCCCGAG
CTGGTCCTTG AGGTGCCCCT GGAGCACCCC ACGCTGGAGT GGTTTGCAGC CCTGGGCCTG CGCTGGTACG
CCCTCCCGGC AGTGTCCAAC ATGCTGCTGG AAATTGGGGG CCTGGAGTTC CCCGCAGCCC CCTTCAGTGG
CTGGTACATG AGCACTGAGA TCGGCACGAG GAACCTGTGT GACCCTCACC GCTACAACAT CCTGGAGGAT
GTGGCTGTCT GCATGGACCT GGATACCCGG ACCACCTCGT CCCTGTGGAA AGACAAGGCA GCAGTGGAAA
TCAACGTGGC CGTGCTGCAC AGTTACCAGC TAGCCAAAGT CACCATCGTG GACCACCACG CCGCCACGGC
CTCTTTCATG AAGCACCTGG AGAATGAGCA GAAGGCCAGG GGGGGCTGCC CTGCAGACTG GGCCTGGATC
GTGCCCCCCA TCTCGGGCAG CCTCACTCCT GTTTTCCATC AGGAGATGGT CAACTATTTC CTGTCCCCGG
CCTTCCGCTA CCAGCCAGAC CCCTGGAAGG GGAGTGCCGC CAAGGGCACC GGCATCACCA GGAAGAAGAC
CTTTAAAGAA GTGGCCAACG CCGTGAAGAT CTCCGCCTCG CTCATGGGCA CGGTGATGGC GAAGCGAGTG
AAGGCGACAA TCCTGTATGG CTCCGAGACC GGCCGGGCCC AGAGCTACGC ACAGCAGCTG GGGAGACTCT
TCCGGAAGGC TTTTGATCCC CGGGTCCTGT GTATGGATGA GTATGACGTG GTGTCCCTCG AACACGAGAC
GCTGGTGCTG GTGGTAACCA GCACATTTGG GAATGGGGAT CCCCCGGAGA ATGGAGAGAG CTTTGCAGCT
GCCCTGATGG AGATGTCCGG CCCCTACAAC AGCTCCCCTC GGCCGGAACA GCACAAGAGT TATAAGATCC
GCTTCAACAG CATCTCCTGC TCAGACCCAC TGGTGTCCTC TTGGCGGCGG AAGAGGAAGG AGTCCAGTAA
CACAGACAGT GCAGGGCCCC TGGGCACCCT CAGGTTCTGT GTGTTCGGGC TCGGCTCCCG GGCATACCCC
CACTTCTGCG CCTTTGCTCG TGCCGTGGAC ACACGGCTGG AGGAACTGGG CGGGGAGCGG CTGCTGCAGC
TGGGCCAGGG CGACGAGCTG TGCGGCCAGG AGGAGGCCTT CCGAGGCTGG GCCCAGGCTG CCTTCCAGGC
CGCCTGTGAG ACCTTCTGTG TGGGAGAGGA TGCCAAGGCC GCCGCCCGAG ACATCTTCAG CCCCAAACGG
AGCTGGAAGC GCCAGAGGTA CCGGCTGAGC GCCCAGGCCG AGGGCCTGCA GTTGCTGCCA GGTCTGATCC
ACGTGCACAG GCGGAAGATG TTCCAGGCTA CAATCCGCTC AGTGGAAAAC CTGCAAAGCA GCAAGTCCAC
GAGGGCCACC ATCCTGGTGC GCCTGGACAC CGGAGGCCAG GAGGGGCTGC AGTACCAGCC GGGGGACCAC
ATAGGTGTCT GCCCGCCCAA CCGGCCCGGC CTTGTGGAGG CGCTGCTGAG CCGCGTGGAG GACCCGCCGG
CGCCCACTGA GCCCGTGGCA GTAGAGCAGC TGGAGAAGGG CAGCCCTGGT GGCCCTCCCC CCGGCTGGGT
GCGGGACCCC CGGCTGCCCC CGTGCACGCT GCGCCAGGCT CTCACCTTCT TCCTGGACAT CACCTCCCCA
CCCAGCCCTC AGCTCTTGCG GCTGCTCAGC ACCTTGGCAG AAGAGCCCAG GGAACAGCAG GAGCTGGAGG
CCCTCAGCCA GGATCCCCGA CGCTACGAGG AGTGGAAGTG GTTCCGCTGC CCCACGCTGC TGGAGGTGCT
GGAGCAGTTC CCGTCGGTGG CGCTGCCCTG CCCCACTGCT CTCACCCAGC TGCCTCTGCT CCAGCCCCGG
TACTACTCAG TCAGCTCGGC ACCCAGCACC CACCCAGGAG AGATCCACCT CACTGTAGCT GTGCTGGCAT
```

ACAGGACTCA GGATGGGCTG GGCCCCCTGC ACTATGGAGT CTGCTCCACG TGGCTAAGCC AGCTCAAGCC

CGGAGACCCT GTGCCCTGCT TCATCCGGGG GGCTCCCTCC TTCCGGCTGC CACCCGATCC CAGCTTGCCC

TGCATCCTGG TGGGTCCAGG CACTGGCATT GCCCCCTTCC GGGGATTCTG GCAGGAGCGG CTGCATGACA

TTGAGAGCAA AGGGCTGCAG CCCACTCCCA TGACTTTGGT GTTCGGCTGC CGATGCTCCC AACTTGACCA

TCTCTACCGC GACGAGGTGC AGAACGCCCA GCAGCGCGGG GTGTTTGGCC GAGTCCTCAC CGCCTTCTCC

CGGGAACCTG ACAACCCCAA GACCTACGTG CAGGACATCC TGAGGACGGA GCTGGCTGCG GAGGTGCACC

GCGTGCTGTG CCTCGAGCGG GGCCACATGT TTGTCTGCGG CGATGTTACC ATGGCAACCA ACGTCCTGCA

GACCGTGCAG CGCATCCTGG CGACGGAGGG CGACATGGAG CTGGACGAGG CCGGCGACGT CATCGGCGTG

CTGCGGGATC AGCAACGCTA CCACGAAGAC ATTTTCGGGC TCACGCTGCG CACCCAGGAG GTGACAAGCC

GCATACGCAC CCAGAGCTTT TCCTTGCAGG AGCGTCAGTT GCGGGCGCA GTGCCCTGGG CGTTCGACCC

TCCCGGCTCA GACACCAACA GCCCCTGAGA GCCGCCTGGC TTTCCCTTCC AGTTCCGGGA GAGCGGCTGC

CCGACTCAGG TCCGCCCGAC CAGGATCAGC CCCGCTCCTC CCCTCTTGAG GTGGTGCCTT CTCACATCTG

TCCAGAGGCT GCAAGGATTC AGCATTATTC CTCCAGGAAG GAGCAAAACG CCTCTTTTCC CTCTCTAGGC

CTGTTGCCTC GGGCCTGGGT CCGCCTTAAT CTGGAAGGCC CCTCCCAGCA GCGGTACCCC AGGGCCTACT

GCCACCCGCT TCCTGTTTCT TAGTCCGAAT GTTAGATTCC TCTTGCCTCT CTCAGGAGTA TCTTACCTGT

AAAGTCTAAT CTCTAAATCA GTATTTATT ATTGAAGATT TACCATAAGG GACTGTGCCA GATGTTAGGA

GAACTACTAA AGTGCCTACC CCAGCTC-3' (FRAG. NO:1897) (SEQ. ID NO: 3017)

5'-CATATGTATG GGAATACTGT ATTTCAGGCA TTATAAGGAA TGAAATTATA GGCCGGGCAT TGTGGCTAAC

CCTTGTAATC CTAGCACTTT GAGAGGCTGA AGTGGGCAGA TCACTTGAGC TTCAGAGTTC GAGACCAGCA

TGGACAACAT GGTGAAACCC AGTCTCTACC AAAAACACAA AAATATTAGC TGGGTGTGGT GGTGCATGCC

TGTAGTCCCA GCTACTCAGG AGGCTGAGGT GGGAGGATCG CTTGAGCCTG GGAGGCAGAA GTTGCAATGA

GCAGAGATCG TGCCACTCCG CTCCAGTCTT GGTGACAGAA TGAGACTCCA TCTCAAAAAT AAATAAATAA

ATAAATAAAA TAAATGAAAT GAAATTATAA GAAATTACCA CTTTTTCATG TAAGAAGTGA TCATTTCCAT

TATAAGGGAA GGAATTTAAT CCTACCTGCC ATTCCACCAA AGCTTACCTA GTGCTAAAGG ATGAGGTGTT

AGTAAGACCA ACATCTCAGA GGCCTCTCTG TGCCAATAGC CTTCCTTCCT TTCCCTTCCA AAAACCTCAA

GTGACTAGTT CAGAGGCCTG TCTGGAATAA TGGCATCATC TAATATCACT GGCCTTCTGG AACCTGGGCA

TTTTCCAGTG TGTTCCATAC TGTCAATATT CCCCCAGCTT CCTGGACTCC TGTCACAAGC TGGAAAAGTG

AGAGGATGGA CAGGGATTAA CCAGAGAGCT CCCTGCTGAG GAAAAAATCT CCCAGATGCT GAAAGTGAGG

CCATGTGGCT TGGCCAAATA AAACCTGGCT CCGTGGTGCC TCTGTCTTAG CAGCCACCCT GCTGATGAAC

TGCCACCTTG GACTTGGGAC CAGAAAGAGG TGGGTTGGGT GAAGAGGCAC CACACAGAGT GATGTAACAG

CAAGATCAGG TCACCCACAG GCCCTGGCAG TCACAGTCAT AAATTAGCTA ACTGTACACA AGCTGGGGAC

ACTCCCTTTG GAAACCAAAA AAAAAAAAAA AAAAAGAGA CCTTTATGCA AAACAACTC TCTGGATGGC

ATGGGGTGAG TATAAATACT TCTTGGCTGC CAGTGTGTTC ATAACTTTGT AGCGAGTCGA AAACTGAGGC

TCCGGCCGCA GAGAACTCAG CCTCATTCCT GCTTTAAAAT CTCTCGGCCA CCTTTGATGA GGGGACTGGG

CAGTTCTAGA CAGTCCCGAA GTTCTCAAGG CACAGGTCTC TTCCTGGTTT GACTGTCCTT ACCCCGGGGA

GGCAGTGCAG CCAGCTGCAA GGTGAGTTGC C-3' (FRAG. NO:_)(SEQ. ID NO: 2506)

5'-CTGCTTTAAA ATCTCTCGGC CACCTTTGAT GAGGGGACTG GGCAGTTCTA GACAGTCCCG AAGTTCTCAA

GGCACAGGTC TCTTCCTGGT TTGACTGTCC TTACCCCGGG GAGGCAGTGC AGCCAGCTGC AAGCCCCACA

GTGAAGAACA TCTGAGCTCA AATCCAGATA AGTGACATAA GTGACCTGCT TTGTAAAGCC ATAGAGATGG

```
CCTGTCCTTG GAAATTTCTG TTCAAGACCA AATTCCACCA GTATGCAATG AATGGGAAA AAGACATCAA
CAACAATGTG GAGAAAGCCC CCTGTGCCAC CTCCAGTCCA GTGACACAGG ATGACCTTCA GTATCACAAC
CTCAGCAAGC AGCAGAATGA GTCCCCGCAG CCCCTCGTGG AGACGGGAAA GAAGTCTCCA GAATCTCTGG
TCAAGCTGGA TGCAACCCCA TTGTCCTCCC CACGGCATGT GAGGATCAAA ACTGGGGCA GCGGGATGAC
TTTCCAAGAC ACACTTCACC ATAAGGCCAA AGGGATTTTA ACTTGCAGGT CCAAATCTTG CCTGGGGTCC
ATTATGACTC CCAAAAGTTT GACCAGAGGA CCCAGGGACA AGCCTACCCC TCCAGATGAG CTTCTACCTC
AAGCTATCGA ATTTGTCAAC CAATATTACG GCTCCTTCAA AGAGGCAAAA ATAGAGGAAC ATCTGGCCAG
GGTGGAAGCG GTAACAAAGG AGATAGAAAC AACAGGAACC TACCAACTGA CGGGAGATGA GCTCATCTTC
GCCACCAAGC AGGCCTGGCG CAATGCCCCA CGCTGCATTG GGAGGATCCA GTGGTCCAAC CTGCAGGTCT
TCGATGCCCG CAGCTGTTCC ACTGCCCGGG AAATGTTTGA ACACATCGC AGACACGTGC GTTACTCCAC
CAACAATGGC AACATCAGGT CGGCCATCAC CGTGTTCCCC CAGCGGAGTG ATGGCAAGCA CGACTTCCGG
GTGTGGAATG CTCAGCTCAT CCGCTATGCT GGCTACCAGA TGCCAGATGG CAGCATCAGA GGGGACCCTG
CCAACGTGGA ATTCACTCAG CTGTGCATCG ACCTGGGCTG GAAGCCCAAG TACGGCCGCT TCGATGTGGT
CCCCCTGGTC CTGCAGGCCA ATGGCCGTGA CCCTGAGCTC TTCGAAATCC CACCTGACCT TGTGCTTGAG
GTGGCCATGG AACATCCCAA ATACGAGTGG TTTCGGGAAC TGGAGCTAAA GTGGTACGCC CTGCCTGCAG
TGGCCAACAT GCTGCTTGAG GTGGGCGGCC TGGAGTTCCC AGGGTGCCCC TTCAATGGCT GGTACATGGG
CACAGAGATC GGAGTCCGGG ACTTCTGTGA CGTCCAGCGC TACAACATCC TGGAGGAAGT GGGCAGGAGA
ATGGGCCTGG AAACGCACAA GCTGGCCTCG CTCTGGAAAG ACCAGGCTGT CGTTGAGATC AACATTGCTG
TGATCCATAG TTTTCAGAAG CAGAATGTGA CCATCATGGA CCACCACTCG GCTGCAGAAT CCTTCATGAA
GTACATGCAG AATGAATACC GGTCCCGTGG GGGCTGCCCG GCAGACTGGA TTTGGCTGGT CCCTCCCATG
TCTGGGAGCA TCACCCCCGT GTTTCACCAG GAGATGCTGA ACTACGTCCT GTCCCCTTTC TACTACTATC
AGGTAGAGGC CTGGAAAACC CATGTCTGGC AGGACGAGAA GCGGAGACCC AAGAGAAGAG AGATTCCATT
GAAAGTCTTG GTCAAAGCTG TGCTCTTTGC CTGTATGCTG ATGCGCAAGA CAATGGCGTC CCGAGTCAGA
GTCACCATCC TCTTTGCGAC AGAGACAGGA AAATCAGAGG CGCTGGCCTG GGACCTGGGG GCCTTATTCA
GCTGTGCCTT CAACCCCAAG GTTGTCTGCA TGGATAAGTA CAGGCTGAGC TGCCTGGAGG AGGAACGGCT
GCTGTTGGTG GTGACCAGTA CGTTTGGCAA TGGAGACTGC CCTGGCAATG GAGAGAAACT GAAGAAATCG
CTCTTCATGC TGAAAGAGCT CAACAACAAA TTCAGGTACG CTGTGTTTGG CCTCGGCTCC AGCATGTACC
CTCGGTTCTG CGCCTTTGCT CATGACATTG ATCAGAAGCT GTCCCACCTG GGGGCCTCTC AGCTCACCCC
GATGGGAGAA GGGGATGAGC TCAGTGGGCA GGAGGACGCC TTCCGCAGCT GGGCCGTGCA AACCTTCAAG
GCAGCCTGTG AGACGTTTGA TGTCCGAGGC AAACAGCACA TTCAGATCCC CAAGCTCTAC ACCTCCAATG
TGACCTGGGA CCCGCACCAC TACAGGCTCG TGCAGGACTC ACAGCTTTTG GACCTCAGCA AAGCCCTCAG
CAGCATGCAT GCCAAGAACG TGTTCACCAT GAGGCTCAAA TCTCGGCAGA ATCTACAAAG TCCGACATCC
AGCCGTGCCA CCATCCTGGT GGAACTCTCC TGTGAGGATG CCAAGGCCT GAACTACCTG CCGGGGGAGC
ACCTTGGGGT TTGCCCAGGC AACCAGCCGG CCCTGGTCCA AGGCATCCTG GAGCGAGTGG TGGATGGCCC
CACACCCCAC CAGACAGTGC GCCTGGAGGA CCTGGATGAG AGTGGCAGCT ACTGGGTCAG TGACAAGAGG
CTGCCCCCCT GCTCACTCAG CCAGGCCCTC ACCTACTCCC GGACATCAC CACACCCCA ACCCAGCTGC
TGCTCCAAAA GCTGGCCCAG GTGGCCACAG AAGAGCCTGA GAGACAGAGG CTGGAGGCCC TGTGCCAGCC
CTCAGAGTAC AGCAAGTGGA AGTTCACCAA CAGCCCCACA TTCCTGGAGG TGCTAGAGGA GTTCCCGTCC
CTGCGGGTGT CTGCTGGCTT CCTGCTTTCC CAGCTCCCCA TTCTGAAGCC CAGGTTCTAC TCCATCAGCT
CCTCCCGGGA TCACACGCCC ACGGAGATCC ACCTGACTGT GGCCGTGGTC ACCTACCACA CCGGAGATGG
```

```
CCAGGGTCCC CTGCACCACG GTGTCTGCAG CACATGGCTC AACAGCCTGA AGCCCCAAGA CCCAGTGCCC
TGCTTTGTGC GGAATGCCAG CGCCTTCCAC CTCCCCGAGG ATCCCTCCCA TCCTTGCATC CTCATCGGGC
CTGGCACAGG CATCGTGCCC TTCCGCAGTT TCTGGCAGCA ACGGCTCCAT GACTCCCAGC ACAAGGGAGT
GCGGGGAGGC CGCATGACCT TGGTGTTTGG GTGCCGCCGC CCAGATGAGG ACCACATCTA CCAGGAGGAG
ATGCTGGAGA TGGCCCAGAA GGGGGTGCTG CATGCGGTGC ACACAGCCTA TTCCCGCCTG CCTGGCAAGC
CCAAGGTCTA TGTTCAGGAC ATCCTGCGGC AGCAGCTGGC CAGCGAGGTG CTCCGTGTGC TCCACAAGGA
GCCAGGCCAC CTCTATGTTT GCGGGGATGT GCGCATGGCC CGGGACGTGG CCCACACCCT GAAGCAGCTG
GTGGCTGCCA AGCTGAAATT GAATGAGGAG CAGGTCGAGG ACTATTTCTT TCAGCTCAAG AGCCAGAAGC
GCTATCACGA AGATATCTTC GGTGCTGTAT TTCCTTACGA GGCGAAGAAG ACAGGGTGG CGGTGCAGCC
CAGCAGCCTG GAGATGTCAG CGCTCTGAGG GCCTACAGGA GGGGTTAAAG CTGCCGGCAC AGAACTTAAG
GATGGAGCCA GCTCTGCATT ATCTGAGGTC ACAGGGCCTG GGGAGATGGA GGAAAGTGAT ATCCCCCAGC
CTCAAGTCTT ATTTCCTCAA CGTTGCTCCC CATCAAGCCC TTTACTTGAC CTCCTAACAA GTAGCACCCT
GGATTGATCG GAGCCTCCTC TCTCAAACTG GGGCCTCCCT GGTCCCTTGG AGACAAAATC TTAAATGCCA
GGCCTGGCGA GTGGGTGAAA GATGGAACTT GCTGCTGAGT GCACCACTTC AAGTGACCAC CAGGAGGTGC
TATCGCACCA CTGTGTATTT AACTGCCTTG TGTACAGTTA TTTATGCCTC TGTATTTAAA AAACTAACAC
CCAGTCTGTT CCCCATGGCC ACTTGGGTCT TCCCTGTATG ATTCCTTGAT GGAGATATTT ACATGAATTG
CATTTTACTT TAATC-3' (FRAG. NO:_)(SEQ. ID NO:2507)
5'-GAATTCCCAC TCTGCTGCCT GCTCCAGCAG ACGGACGCAC AGTAACATGG GCAACTTGAA GAGCGTGGCC
CAGGAGCCTG GGCCACCCTG CGGCCTGGGG CTGGGGCTGG GCCTTGGGCT GTGCGGCAAG CAGGGCCCAG
CCACCCCGGC CCCTGAGCCC AGCCGGGCCC CAGCATCCCT ACTCCCACCA GCGCCAGAAC ACAGCCCCCC
GAGCTCCCCG CTAACCCAGC CCCCAGAGGG GCCCAAGTTC CCTCGTGTGA AGAACTGGGA GGTGGGGAGC
ATCACCTATG ACACCCTCAG CGCCCAGGCG CAGCAGGATG GGCCCTGCAC CCCAAGACGG TGCCTGGGCT
CCCTGGTATT TCCACGGAAA CTACAGGGCC GGCCCTCCCC CGGCCCCCCG GCCCCTGAGC AGCTGCTGAG
TCAGGCCCGG GACTTCATCA ACCAGTACTA CAGCTCCATT AAGAGGAGCG GCTCCCAGGC CCACGAACAG
CGGCTTCAAG AGGTGGAAGC CGAGGTGGCA GCCACAGGCA CCTACCAGCT TAGGGAGAGC GAGCTGGTGT
TCGGGGCTAA GCAGGCCTGG CGCAACGCTC CCCGCTGCGT GGGCCGGATC CAGTGGGGGA AGCTGCAGGT
GTTCGATGCC CGGGACTGCA GGTCTGCACA GGAAATGTTC ACCTACATCT GCAACCACAT CAAGTATGCC
ACCAACCGGG GCAACCTTCG CTCGGCCATC ACAGTGTTCC CGCAGCGCTG CCCTGGCCGA GGAGACTTCC
GAATCTGGAA CAGCCAGCTG GTGCGCTACG CGGGCTACCG GCAGCAGGAC GGCTCTGTGC GGGGGGACCC
AGCCAACGTG GAGATCACCG AGCTCTGCAT TCAGCACGGC TGGACCCCAG GAAACGGTCG CTTCGACGTG
CTGCCCCTGC TGCTGCAGGC CCCAGATGAG CCCCCAGAAC TCTTCCTTCT GCCCCCCGAG CTGGTCCTTG
AGGTGCCCCT GGAGCACCCC ACGCTGGAGT GGTTTGCAGC CCTGGGCCTG CGCTGGTACG CCCTCCCGGC
AGTGTCCAAC ATGCTGCTGG AAATTGGGGG CCTGGAGTTC CCCGCAGCCC CCTTCAGTGG CTGGTACATG
AGCACTGAGA TCGGCACGAG GAACCTGTGT GACCCTCACC GCTACAACAT CCTGGAGGAT GTGGCTGTCT
GCATGGACCT GGATACCCGG ACCACCTCGT CCCTGTGGAA AGACAAGGCA GCAGTGGAAA TCAACGTGGC
CGTGCTGCAC AGTTACCAGC TAGCCAAAGT CACCATCGTG GACCACCACG CCGCCACGGC CTCTTTCATG
AAGCACCTGG AGAATGAGCA GAAGGCCAGG GGGGCTGCC CTGCAGACTG GCCTGGATC GTGCCCCCCA
TCTCGGGCAG CCTCACTCCT GTTTTCCATC AGGAGATGGT CAACTATTTC CTGTCCCCGG CCTTCCGCTA
CCAGCCAGAC CCCTGGAAGG GGAGTGCCGC CAAGGGCACC GGCATCACCA GGAAGAAGAC CTTTAAAGAA
```

```
GTGGCCAACG CCGTGAAGAT CTCCGCCTCG CTCATGGGCA CGGTGATGGC GAAGCGAGTG AAGGCGACAA
TCCTGTATGG CTCCGAGACC GGCCGGGCCC AGAGCTACGC ACAGCAGCTG GGGAGACTCT TCCGGAAGGC
TTTTGATCCC CGGGTCCTGT GTATGGATGA GTATGACGTG GTGTCCCTCG AACACGAGAC GCTGGTGCTG
GTGGTAACCA GCACATTTGG GAATGGGGAT CCCCCGGAGA ATGGAGAGAG CTTTGCAGCT GCCCTGATGG
AGATGTCCGG CCCCTACAAC AGCTCCCCTC GGCCGGAACA GCACAAGAGT TATAAGATCC GCTTCAACAG
CATCTCCTGC TCAGACCCAC TGGTGTCCTC TTGGCGGCGG AAGAGGAAGG AGTCCAGTAA CACAGACAGT
GCAGGGGCCC TGGGCACCCT CAGGTTCTGT GTGTTCGGGC TCGGCTCCCG GCATACCCC CACTTCTGCG
CCTTTGCTCG TGCCGTGGAC ACACGGCTGG AGGAACTGGG CGGGGAGCGG CTGCTGCAGC TGGGCCAGGG
CGACGAGCTG TGCGGCCAGG AGGAGGCCTT CCGAGGCTGG GCCCAGGCTG CCTTCCAGGC CGCCTGTGAG
ACCTTCTGTG TGGGAGAGGA TGCCAAGGCC GCCGCCCGAG ACATCTTCAG CCCCAAACGG AGCTGGAAGC
GCCAGAGGTA CCGGCTGAGC GCCCAGGCCG AGGGCCTGCA GTTGCTGCCA GGTCTGATCC ACGTGCACAG
GCGGAAGATG TTCCAGGCTA CAATCCGCTC AGTGGAAAAC CTGCAAAGCA GCAAGTCCAC GAGGGCCACC
ATCCTGGTGC GCCTGGACAC CGGAGGCCAG GAGGGGCTGC AGTACCAGCC GGGGGACCAC ATAGGTGTCT
GCCCGCCCAA CCGGCCCGGC CTTGTGGAGG CGCTGCTGAG CCGCGTGGAG GACCCGCCGG CGCCCACTGA
GCCCGTGGCA GTAGAGCAGC TGGAGAAGGG CAGCCCTGGT GGCCCTCCCC CCGGCTGGGT GCGGGACCCC
CGGCTGCCCC CGTGCACGCT GCGCCAGGCT CTCACCTTCT TCCTGGACAT CACCTCCCCA CCCAGCCCTC
AGCTCTTGCG GCTGCTCAGC ACCTTGGCAG AAGAGCCCAG GGAACAGCAG GAGCTGGAGG CCCTCAGCCA
GGATCCCCGA CGCTACGAGG AGTGGAAGTG GTTCCGCTGC CCCACGCTGC TGGAGGTGCT GGAGCAGTTC
CCGTCGGTGG CGCTGCCTGC CCCACTGCTC CTCACCCAGC TGCCTCTGCT CCAGCCCCGG TACTACTCAG
TCAGCTCGGC ACCCAGCACC CACCCAGGAG AGATCCACCT CACTGTAGCT GTGCTGGCAT ACAGGACTCA
GGATGGGCTG GGCCCCCTGC ACTATGGAGT CTGCTCCACG TGGCTAAGCC AGCTCAAGCC CGGAGACCCT
GTGCCCTGCT TCATCCGGGG GGCTCCCTCC TTCCGGCTGC CACCCGATCC CAGCTTGCCC TGCATCCTGG
TGGGTCCAGG CACTGGCATT GCCCCCTTCC GGGGATTCTG GCAGGAGCGG CTGCATGACA TTGAGAGCAA
AGGGCTGCAG CCCACTCCCA TGACTTTGGT GTTCGGCTGC CGATGCTCCC AACTTGACCA TCTCTACCGC
GACGAGGTGC AGAACGCCCA GCAGCGCGGG GTGTTTGGCC GAGTCCTCAC CGCCTTCTCC CGGGAACCTG
ACAACCCCAA GACCTACGTG CAGGACATCC TGAGGACGGA GCTGGCTGCG GAGGTGCACC GCGTGCTGTG
CCTCGAGCGG GGCCACATGT TGTCTGCGG CGATGTTACC ATGGCAACCA ACGTCCTGCA GACCGTGCAG
CGCATCCTGG CGACGGAGGG CGACATGGAG CTGGACGAGG CCGGCGACGT CATCGGCGTG CTGCGGGATC
AGCAACGCTA CCACGAAGAC ATTTTCGGGC TCACGCTGCG CACCCAGGAG GTGACAAGCC GCATACGCAC
CCAGAGCTTT TCCTTGCAGG AGCGTCAGTT GCGGGGCGCA GTGCCCTGGG CGTTCGACCC TCCCGGCTCA
GACACCAACA GCCCCTGAGA GCCGCCTGGC TTTCCCTTCC AGTTCCGGGA GAGCGGCTGC CCGACTCAGG
TCCGCCCGAC CAGGATCAGC CCCGCTCCTC CCCTCTTGAG GTGGTGCCTT CTCACATCTG TCCAGAGGCT
GCAAGGATTC AGCATTATTC CTCCAGGAAG GAGCAAAACG CCTCTTTTCC CTCTCTAGGC CTGTTGCCTC
GGGCCTGGGT CCGCCTTAAT CTGGAAGGCC CCTCCCAGCA GCGGTACCCC AGGGCCTACT GCCACCCGCT
TCCTGTTTCT TAGTCCGAAT GTTAGATTCC TCTTGCCTCT CTCAGGAGTA TCTTACCTGT AAAGTCTAAT
CTCTAAATCA AGTATTTATT ATTGAAGATT TACCATAAGG GACTGTGCCA GATGTTAGGA GAACTACTAA
AGTGCCTACC CCAGCTC-3' (FRAG. NO:_) (SEQ. ID NO:2508)
5'-CCCCGGGG-3' (FRAG. NO:1898) (SEQ. ID NO: 1911)
5'-GGGGCCGCTGGG-3' (FRAG. NO:1899) (SEQ. ID NO:1912)
5'-GGGGGTGTGG-3' (FRAG. NO:1900) (SEQ. ID NO: 1913)
```

-continued

5'-CTGCCTCCCCGGGGT-3' (FRAG. NO:1442)(SEQ. ID NO:1451)

5'-TTCTGCTGCTTGCTG-3' (FRAG. NO:1443)(SEQ. ID NO:1452)

5'-CTTCTTTCCCGTCTCC-3' (FRAG. NO:1444)(SEQ. ID NO:1453)

5'-CTTCTTTCCCGTCTCC-3' (FRAG. NO:1445)(SEQ. ID NO:1454)

5'-TTTTTGCCTCTTTG-3' (FRAG. NO:1446)(SEQ. ID NO:1455)

5'-GGTTCCTGTTGTTTCT-3' (FRAG. NO:1447)(SEQ. ID NO:1456)

5'-GGCCTGCTTGGTGGCG-3' (FRAG. NO:1448)(SEQ. ID NO:1457)

5'-GCTTGTGCGTTTCC-3' (FRAG. NO:1449)(SEQ. ID NO:1458)

5'-TCTCTCTTCTCTTGGGTCTCCGCTTCTCGTCCTGCC-3' (FRAG. NO:1450)(SEQ. ID NO:1459)

5'-TTTTCCTGTCTCTGTCGC-3' (FRAG. NO:1451)(SEQ. ID NO:1460)

5'-GCCGTTCCTCCTCC-3' (FRAG. NO:1452)(SEQ. ID NO:1461)

5'-GGCGTCCTCCTGCCC-3' (FRAG. NO:1453)(SEQ. ID NO:1462)

5'-TGTGCTGTTTGCCTCGG-3' (FRAG. NO:1454)(SEQ. ID NO:1463)

5'-GTGGTGCGGGTCCC-3' (FRAG. NO:1455)(SEQ. ID NO:1464)

5'-GGTGCTCCCCCGGC-3' (FRAG. NO:1456)(SEQ. ID NO:1465)

5'-GGGCCGGCTGGTTGCCTGGGC-3' (FRAG. NO:1457)(SEQ. ID NO:1466)

5'-CTGTCTGGTGGGGTGTGGGGCC-3' (FRAG. NO:1458)(SEQ. ID NO:1467)

5'-GCTGGGTTGGGGGTGTGGTG-3' (FRAG. NO:1459)(SEQ. ID NO:1468)

5'-GGCTCTTCTGTGGCC-3' (FRAG. NO:1460)(SEQ. ID NO:1469)

5'-TGTGGGCTGTTGGTG-3' (FRAG. NO:1461)(SEQ. ID NO:1470)

5'-TCTCTGTGGGCGTGTG-3' (FRAG. NO:1462)(SEQ. ID NO:1471)

5'-CTGGGTCTTGGGGCTTC-3' (FRAG. NO:1463)(SEQ. ID NO:1472)

5'-CTCCCTTGTGCTGGG-3' (FRAG. NO:1464)(SEQ. ID NO:1473)

5'-TGCGGCCTCCCCGC-3' (FRAG. NO:1465)(SEQ. ID NO:1474)

5'-CCCCCTTCTGGGCC-3' (FRAG. NO:1466)(SEQ. ID NO:1475)

5'-GTGGCCTGGCTCCTTGTGG-3' (FRAG. NO:1467)(SEQ. ID NO:1476)

5'-GCGCTTCTGGCTCTTG-3' (FRAG. NO:1468)(SEQ. ID NO:1477)

5'-CCCTGTCCTTCTTCGCCTCGT-3' (FRAG. NO:1469)(SEQ. ID NO:1478)

5'-GGCTGCTGGGCTGC-3' (FRAG. NO:1470)(SEQ. ID NO:1479)

5'-CTGCCCCBGTTTTTGBTCCTCBCBTGCCGTGGGGBGGBCBBTGG-3'(FRAG. NO:1901) (SEQ. ID NO: 1914)

NF-kB Nucleic Acids and
Antisense Oligonucleotide Fragments

5'-CGGCCCTTCT CACTGGAGGC ACCGGGCAGT CCTCCATGGG AGGGTTGGGC TTGGCCGGGG CTGCCCGGTG

CCTCCTCTTG GCTGGTCCCT CGTTGTCCTT GGGCCCCGC TCCCGCTGCT CGGCCTCCGT GTTCTTTGGC

CTCTTGCTCC GCCTGCTGTC TTGTCCCGTC CCCTCCTCGC TTGCGTTTCC CTCTTCCTTG TCTTCCAGGC

CTTCCTCCGC TTCCGCTGCT GGGGCCCGCG CCGGGGGGGC GCTCGGCTCC GCGGCTTCCT CCCCGGCTGG

GGGGTCCTGG TCTCCGGGGC CTGCGGCTCG CGGGCTCGGG GCTGCGTGCG CCGCGCGCGG CGTCCGCGGT

GGGTGGCGCT GTCCCGCCGT GGTGTGTCTC CGTTCTCGTC CTGCGCCGTC CTGGTCTGCC CGTGGGGTCC

TGGGCGTGGT GGGGGGCGTC TGGTGCCTCG TCTGCCCCGT GGGGCTTCGG GCTCGGGGCT GTTCGTCCCC

-continued

```
CCTGCCGCTC TGTGGCCTCC GGGGCTCCTC GTTTTCGCTG CTTCGGGTGT CCTTCTCGGC GTGTGGCCCC

GGGTCCCGGC CCTGCTGGGC TGGGCGGGGT CGCTGCCCTG GGCTTCTGGC CCGTCTGGTT GTCTGTCGGT

GCTTGTCTCG GGTTTCTGGC CTCTGTGCTG GGCGCTTCTC TGCCTCCTGC TCCGCCCTCC TGGTGGCTCG

GCTGGGGGTG CCCGTGCGGG GGTGGGTGTG GGGTGTTTTC GGGGTCCTCC CCTTCCC-3' (FRAG. NO:1902) (SEQ.
```

ID NO:1915)

5'-GGGCGGGGTCGC-3' (FRAG. NO:1903) (SEQ. ID NO:1916)

5'-GCGCCGTCC-3' (FRAG. NO:1904) (SEQ. ID NO:1917)

5'-GGGCGTGGTGG-3' (FRAG. NO:1905) (SEQ. ID NO:1918)

5'-GTTGGGCTTGGCCGGGG-3' (FRAG. NO:1471)(SEQ. ID NO:1480)

5'-CTGCCCGGTGCCTCC-3' (FRAG. NO:1472)(SEQ. ID NO:1481)

5'-TCTTGGCTGGTCCCTCGT-3' (FRAG. NO:1473)(SEQ. ID NO:1482)

5'-TGTCCTTGGGCCCC-3' FRAG. NO:1474)(SEQ. ID NO:1483)

5'-GCTCCCGCTGCTCGGCCTCCGT-3' (FRAG. NO:1475)(SEQ. ID NO:1484)

5'-GTTCTTTGGCCTCTTGCTCC-3' (FRAG. NO:1476)(SEQ. ID NO:1485)

5'-GCCTGCTGTCTTGTCC-3' (FRAG. NO:1477)(SEQ. ID NO:1486)

5'-CGTCCCTCCTCGCTTGCGTTTC-3' (FRAG. NO:1478)(SEQ. ID NO:1487)

5'-CCTCTTCCTTGTCTTCCA-3' (FRAG. NO:1479)(SEQ. ID NO:1488)

5'-GGCCTTCCTCCGCTTCCGCTGC-3' (FRAG. NO:1480)(SEQ. ID NO:1489)

5'-TGGGGCCCGCGCCGG-3' (FRAG. NO:1481)(SEQ. ID NO:1490)

5'-GGGGGCGCTCGGCTCCGCGGCTTCCTCCCCGG-3' (FRAG. NO:1482)(SEQ. ID NO:1491)

5'-CTGGGGGGTCCTGG-3' (FRAG. NO:1483)(SEQ. ID NO:1492)

5'-TCTCCGGGGCCTGCGGCTCGC-3' (FRAG. NO:1484)(SEQ. ID NO:1493)

5'-GGGCTCGGGGCTGCGTGCGCC-3' (FRAG. NO:1485)(SEQ. ID NO:1494)

5'-GCGCGCGGCGTCCGCGGTG-3' (FRAG. NO:1486)(SEQ. ID NO:1495)

5'-GGTGGCGCTGTCCCGCC-3' (FRAG. NO:1487)(SEQ. ID NO:1496)

5'-GTGGTGTGTCTCCGTTCTCGTCCTGCGCCGTC-3' (FRAG. NO:1488)(SEQ. ID NO:1497)

5'-CTGGTCTGCCCGTGG-3' (FRAG. NO:1489)(SEQ. ID NO:1498)

5'-GGTCCTGGGCGTGGTGG-3' (FRAG. NO:1490)(SEQ. ID NO:1499)

5'-GGGGCGTCTGGTGC-3' (FRAG. NO:1491)(SEQ. ID NO:1500)

5'-CTCGTCTGCCCCGTG-3' (FRAG. NO:1492)(SEQ. ID NO:1501)

5'-GGGCTTCGGGCTCGG-3' (FRAG. NO:1493)(SEQ. ID NO:1502)

5'-GGCTGTTCGTCCCCCCTGCCGCTCTGTGGCCTCC-3' (FRAG. NO:1494)(SEQ. ID NO:1503)

5'-GGGGCTCCTCGTTTTC-3' (FRAG. NO:1495)(SEQ. ID NO:1504)

5'-GCTGCTTCGGGTGTCCTTCTC-3' (FRAG. NO:1496)(SEQ. ID NO:1505)

5'-GGCGTGTGGCCCCGG-3' (FRAG. NO:1497)(SEQ. ID NO:1506)

5'-GTCCCGGCCCTGCTGGGCTGGGCGGGTC-3' (FRAG. NO:1498)(SEQ. ID NO:1507)

5'-GCTGCCCTGGGCTTCTGGCCCGTCT-3' (FRAG. NO:1499)(SEQ. ID NO:1508)

5'-GGTTGTCTGTCGGT-3' (FRAG. NO:1500)(SEQ. ID NO:1509)

5'-GCTTGTCTCGGTTTCTGG-3' (FRAG. NO:1501)(SEQ. ID NO:1510)

5'-CCTCTGTGCTGGGC-3' (FRAG. NO:1502)(SEQ. ID NO:1511)

-continued

5'-GCTTCTCTGCCTCCTGCTCC-3' (FRAG. NO:1503)(SEQ. ID NO:1512)

5'-GCCCTCCTGGTGGCTC-3' (FRAG. NO:1504)(SEQ. ID NO:1513)

5'-GGCTGGGGGTGCCCGTGCG-3' (FRAG. NO:1505)(SEQ. ID NO:1514)

5'-GGGGTGGGTGTGGGTGTT-3' (FRAG. NO:1506)(SEQ. ID NO:1515)

5'-TTCGGGGTCCTCCCCTTCCC-3' (FRAG. NO:1507)(SEQ. ID NO:1516)

5'-CGGCCCTTCTCACTGGAGGCACCGGGCAGTCCTCCATGGGAGG-3' (FRAG.NO:1906)(SEQ.ID NO:1919)

Human Major Basic Protein Nucleic Acids and
Antisense Oligonucleotide Fragments

5'-GTT TCA TCT TGG CTT TAT CCTCT CCC CTT GTT CCT CCC CTCT CCT GCT CTG GRG TCT CCT C TTC CCT CCC TCC CCT GCC GTG TTG TCT GTG GGT GTC GTT TCG CTC TTG TTG CCC TGG GCC CTT CCC TGC TGG GGG GGA GTT TCA TCT TGG CTT TCB TCT TGG CTT TBT CCTCT CCC CTT GTT CCT CCC CTCT CCT GCT CTG GRG TCT CCT C TTC CCT CCC TCC CCT GCC GTG TTG TCT GTG GGT GTC GTT TCG CTC TTG TTG CCC TGG GCC CTT CCC TGC TGG GGG GGB GTT TCB TCT TGG-3' (FRAG. ID:1907) (SEQ. ID NO:1920)

5'-GGG GGA GTT-3' (FRAG. ID:1908) (SEQ. ID NO:1921)

5'-G CCC TGG GCC C-3' (FRAG. ID:1909) (SEQ. ID NO:1922)

5'-GTT TCA TCT TGG CTT TAT CC-3' (FRAG. NO:1508) (SEQ. ID NO:1517)

5'-TCT CCC CTT GTT CCT CCC C-3' (FRAG. NO:1509)(SEQ. ID NO:1518)

5'-TCT CCT GCT CTG GRG TCT CCT C-3' (FRAG. NO:1510)(SEQ. ID NO:1519)

5'-TTC CCT CCC TCC GCT GCC-3' (FRAG. NO:1511)(SEQ. ID NO:1520)

5'-GTG TTG TCT GTG GGT GTC C-3' (FRAG. NO:1512)(SEQ. ID NO:1521)

5'-GTT TCG CTC TTG TTG CCC-3' (FRAG. NO:1513)(SEQ. ID NO:1522)

5'-TGG GCC CTT CCC TGC TGG-3' (FRAG. NO:1514)(SEQ. ID NO:1523)

5'-GGG GGA GTT TCA TCT TGG-3' (FRAG. NO:1515)(SEQ. ID NO:1524)

5'-GTT TCA TCT TGG CTT TAT CCTCT CCC CTT GTT CCT CCC CTCT CCT GCT CTG GRG TCT CCT C TTC CCT CCC TCC CCT GCC GTG TTG TCT GTG GGT GTC GTT TCG CTC TTG TTG CCC TGG GCC CTT CCC TGC TGG GGG GGA GTT TCA TCT TCG-3' (FRAG. ID:1910) (SEQ. ID NO:1923)

5'-GTT TCB TCT TGG CTT TBT CCTCT CCC CTT GTT CCT CCC CTCT CCT GCT CTG GRG TCT CCT C TTC CCT CCC TCC CCT GCC GTG TTG TCT GTG GGT GTC GTT TCG CTC TTG TTG CCC TGG GCC CTT CCC TGC TGG GGG GGB GTT TCB TCT TGG-3' (FRAG. ID:1911) (SEQ. ID NO:1924)

Human Eosinophil Major Basic Protein Nucleic Acids and
Antisense Oligonucleotide Fragments

5'-GGG GGB GTT TCB TCT TGG CTT T-3' (FRAG. NO:1516)(SEQ ID NO:1525)

5'-GGG GGB GTT TCB TCT TGG CTT-3' (FRAG. NO:1517)(SEQ. ID NO: 1526)

5'-GGG GGB GTT TCB TCT TGG CT-3' (FRAG. NO:1518)(SEQ. ID NO:1527)

5'-GGG GGB GTT TCB TCT TGG C-3' (FRAG. NO:1519)(SEQ. ID NO: 1528)

5'-GGG GGB GTT TCB TCT TGG-3' (FRAG. NO:1520)(SEQ. ID NO: 1529)

5'-GGG GGB GTT TCB TCT TG-3' (FRAG. NO:1521)(SEQ. ID NO: 1530)

5'-GGG GGB GTT TCB TCT T-3' (FRAG. NO:1522)(SEQ. ID NO: 1531)

5'-GGG GGB GTT TCB TCT-3' (FRAG. NO:1523)(SEQ. ID NO: 1532)

-continued

5'-GGG GGB GTT TCB TC-3' (FRAG. NO:1524)(SEQ. ID NO: 1533)

5'-GGG GGB GTT TCB T-3' (FRAG. NO:1525)(SEQ. ID NO: 1534)

5'-GGG GGB GTT TCB-3' (FRAG. NO:1526)(SEQ. ID NO: 1535)

5'-GG GGB GTT TCB TCT TGG CTT T-3' (FRAG. NO:1527)(SEQ. ID NO: 1536)

5'-GG GGB GTT TCB TCT TGG CTT-3' (FRAG. NO:1528)(SEQ. ID NO: 1537)

5'-GG GGB GTT TCB TCT TGG CT-3' (FRAG. NO:1529)(SEQ. ID NO: 1538)

5'-GG GGB GTT TCB TCT TGG C-3' (FRAG. NO:1530)(SEQ. ID NO: 1539)

5'-GG GGB GTT TCB TCT TGG-3' (FRAG. NO:1531)(SEQ. ID NO: 1540)

5'-GG GGB GTT TCB TCT TG-3' (FRAG. NO:1532)(SEQ. ID NO: 1541)

5'-GG GGB GTT TCB TCT T-3' (FRAG. NO:1533)(SEQ. ID NO: 1542)

5'-GG GGB GTT TCB TCT-3' (FRAG. NO:1534)(SEQ. ID NO: 1543)

5'-GG GGB GTT TCB TC-3' (FRAG. NO:1535)(SEQ. ID NO: 1544)

5'-GG GGB GTT TCB T-3' (FRAG. NO:1536)(SEQ. ID NO: 1545)

5'-G GGB GTT TCB TCT TGG CTT T-3' (FRAG. NO:1537)(SEQ. ID NO: 1546)

5'-G GGB GTT TCB TCT TGG CTT-3' (FRAG. NO:1538)(SEQ. ID NO: 1547)

5'-G GGB GTT TCB TCT TGG CT-3' (FRAG. NO:1539)(SEQ. ID NO: 1548)

5'-G GGB GTT TCB TCT TGG C-3' (FRAG. NO:1540)(SEQ. ID NO: 1549)

5'-G GGB GTT TCB TCT TGG-3' (FRAG. NO:1541)(SEQ. ID NO: 1550)

5'-G GGB GTT TCB TCT TG-3' (FRAG. NO:1542)(SEQ. ID NO: 1551)

5'-G GGB GTT TCB TCT T-3' (FRAG. NO:1543)(SEQ. ID NO: 1552)

5'-G GGB GTT TCB TCT-3' (FRAG. NO:1544)(SEQ. ID NO: 1553)

5'-G GGB GTT TCB TC-3' (FRAG. NO:1545)(SEQ. ID NO: 1554)

5'-GGB GTT TCB TCT TGG CTT T-3' (FRAG. NO:1546)(SEQ. ID NO: 1555)

5'-GGB GTT TCB TCT TGG CTT-3' (FRAG. NO:1547)(SEQ. ID NO: 1556)

5'-GGB GTT TCB TCT TGG CT-3' (FRAG. NO:1548)(SEQ. ID NO: 1557)

5'-GGB GTT TCB TCT TGG C-3' (FRAG. NO:1549)(SEQ. ID NO: 1558)

5'-GGB GTT TCB TCT TGG-3' (FRAG. NO:1550)(SEQ. ID NO: 1559)

5'-GGB GTT TCB TCT TG-3' (FRAG. NO:1551)(SEQ. ID NO: 1560)

5'-GGB GTT TCB TCT T-3' (FRAG. NO:1552)(SEQ. ID NO: 1561)

5'-GGB GTT TCB TCT-3' (FRAG. NO:1553)(SEQ. ID NO: 1562)

5'-GB GTT TCB TCT TGG CTT T-3' (FRAG. NO:1554)(SEQ. ID NO: 1563)

5'-GB GTT TCB TCT TGG CTT-3' (FRAG. NO:1555)(SEQ. ID NO: 1564)

5'-GB GTT TCB TCT TGG CT-3' (FRAG. NO:1556)(SEQ. ID NO: 1565)

5'-GB GTT TCB TCT TGG C-3' (FRAG. NO:1557)(SEQ. ID NO: 1566)

5'-GB GTT TCB TCT TGG-3' (FRAG. NO:1558)(SEQ. ID NO: 1567)

5'-GB GTT TCB TCT TG-3' (FRAG. NO:1559)(SEQ. ID NO: 1568)

5'-GB GTT TCB TCT T-3' (FRAG. NO:1560)(SEQ. ID NO: 1569)

5'-B GTT TCB TCT TGG CTT T-3' (FRAG. NO:1561)(SEQ. ID NO: 1570)

5'-B GTT TCB TCT TGG CTT-3' (FRAG. NO:1562)(SEQ. ID NO: 1571)

5'-B GTT TCB TCT TGG CTT-3' (FRAG. NO:1563)(SEQ. ID NO: 1572)

-continued

5'-B GTT TCB TCT TGG CT-3' (FRAG. NO:1564)(SEQ. ID NO: 1573)

5'-B GTT TCB TCT TGG C-3' (FRAG. NO:1565)(SEQ. ID NO: 1574)

5'-B GTT TCB TCT TGG-3' (FRAG. NO:1565)(SEQ. ID NO: 1575)

5'-B GTT TCB TCT TG-3' (FRAG. NO:1567)(SEQ. ID NO: 1576)

5'-GTT TCB TCT TGG CTT T-3' (FRAG. NO:1568)(SEQ. ID NO: 1577)

5'-GTT TCB TCT TGG CTT-3' (FRAG. NO:1569)(SEQ. ID NO: 1578)

5'-GTT TCB TCT TGG CT-3' (FRAG. NO:1570)(SEQ. ID NO: 1579)

5'-GTT TCB TCT TGG C-3' (FRAG. NO:1571)(SEQ. ID NO: 1580)

5'-GTT TCB TCT TGG-3' (FRAG. NO:1572)(SEQ. ID NO: 1581)

5'-TT TCB TCT TGG CTT T-3' (FRAG. NO:1573)(SEQ. ID NO: 1582)

5'-TT TCB TCT TGG CTT-3' (FRAG. NO:1574)(SEQ. ID NO: 1583)

5'-TT TCB TCT TGG CT-3' (FRAG. NO:1575)(SEQ. ID NO: 1584)

5'-TT TCB TCT TGG C-3' (FRAG. NO:1576)(SEQ. ID NO: 1585)

5'-T TCB TCT TGG CTT T-3' (FRAG. NO:1577)(SEQ. ID NO: 1586)

5'-T TCB TCT TGG CTT-3' (FRAG. NO:1578)(SEQ. ID NO: 1587)

5'-T TCB TCT TGG CT-3' (FRAG. NO:1579)(SEQ. ID NO: 1588)

5'-TCB TCT TGG CTT T-3' (FRAG. NO:1580)(SEQ. ID NO: 1589)

5'-TCB TCT TGG CTT-3' (FRAG. NO:1581)(SEQ. ID NO: 1590)

5'-GGG GGB GTT TCB TCT TGG CTT T-3' (FRAG. NO:1582)(SEQ. ID NO: 1591)

5'-GG GGB GTT TCB TCT TGG CTT T-3' (FRAG. NO:1583)(SEQ. ID NO: 1592)

5'-G GGB GTT TCB TCT TGG CTT T-3' (FRAG. NO:1584)(SEQ. ID NO: 1593)

5'-GGB GTT TCB TCT TGG CTT T-3' (FRAG. NO:1585)(SEQ. ID NO: 1594)

5'-GB GTT TCB TCT TGG CTT T-3' (FRAG. NO:1586)(SEQ. ID NO: 1595)

5'-B GTT TCB TCT TGG CTT T-3' (FRAG. NO:1587)(SEQ. ID NO: 1596)

5'-GTT TCB TCT TGG CTT T-3' (FRAG. NO:1588)(SEQ. ID NO: 1597)

5'-TT TCB TCT TGG CTT T-3' (FRAG. NO:1589)(SEQ. ID NO: 1598)

5'-T TCB TCT TGG CTT T-3' (FRAG. NO:1590)(SEQ. ID NO: 1599)

5'-TCB TCT TGG CTT T-3' (FRAG. NO:1591)(SEQ. ID NO: 1600)

5'-CB TCT TGG CTT T-3' (FRAG. NO:1592)(SEQ. ID NO: 1601)

5'-GGG GGB GTT TCB TCT TGG CTT-3' (FRAG. NO:1593)(SEQ. ID NO: 1602)

5'-GG GGB GTT TCB TCT TGG CTT-3' (FRAG. NO:1594)(SEQ. ID NO: 1603)

5'-G GGB GTT TCB TCT TGG CTT-3' (FRAG. NO:1595)(SEQ. ID NO: 1604)

5'-GGB GTT TCB TCT TGG CTT-3' (FRAG. NO:1596)(SEQ. ID NO: 1605)

5'-GB GTT TCB TCT TGG CTT-3' (FRAG. NO:1597)(SEQ. ID NO: 1606)

5'-B GTT TCB TCT TGG CTT-3' (FRAG. NO:1598)(SEQ. ID NO: 1607)

5'-GTT TCB TCT TGG CTT-3' (FRAG. NO:1599)(SEQ. ID NO: 1608)

5'-TT TCB TCT TGG CTT-3' (FRAG. NO:1600)(SEQ. ID NO: 1609)

5'-T TCB TCT TGG CTT-3' (FRAG. NO:1601)(SEQ. ID NO: 1610)

5'-TCB TCT TGG CTT-3' (FRAG. NO:1602)(SEQ. ID NO: 1611)

-continued

5'-GGG GGB GTT TCB TCT TGG CT-3' (FRAG. NO:1603)(SEQ. ID NO: 1612)

5'-GG GGB GTT TCB TCT TGG CT-3' (FRAG. NO:1604)(SEQ. ID NO: 1613)

5'-G GGB GTT TCB TCT TGG CT-3' (FRAG. NO:1605)(SEQ. ID NO: 1614)

5'-GGB GTT TCB TCT TGG CT-3' (FRAG. NO:1606)(SEQ. ID NO: 1615)

5'-GB GTT TCB TCT TGG CT-3' (FRAG. NO:1607)(SEQ. ID NO: 1616)

5'-B GTT TCB TCT TGG CT-3' (FRAG. NO:1608)(SEQ. ID NO: 1617)

5'-GTT TCB TCT TGG CT-3' (FRAG. NO:1609)(SEQ. ID NO: 1618)

5'-TT TCB TCT TGG CT-3' (FRAG. NO:1610)(SEQ. ID NO: 1619)

5'-T TCB TCT TGG CT-3' (FRAG. NO:1611)(SEQ. ID NO: 1620)

5'-GGG GGB GTT TCB TCT TGG C-3' (FRAG. NO:1612)(SEQ. ID NO: 1621)

5'-GG GGB GTT TCB TCT TGG C-3' (FRAG. NO:1613)(SEQ. ID NO: 1622)

5'-G GGB GTT TCB TCT TGG C-3' (FRAG. NO:1614)(SEQ. ID NO: 1623)

5'-GGB GTT TCB TCT TGG C-3' (FRAG. NO:1615)(SEQ. ID NO: 1624)

5'-GB GTT TCB TCT TGG C-3' (FRAG. NO:1616)(SEQ. ID NO: 1625)

5'-B GTT TCB TCT TGG C-3' (FRAG. NO:1617)(SEQ. ID NO: 1626)

5'-GTT TCB TCT TGG C-3' (FRAG. NO:1618)(SEQ. ID NO: 1627)

5'-TT TCB TCT TGG C-3' (FRAG. NO:1619)(SEQ. ID NO: 1628)

5'-GGG GGB GTT TCB TCT TGG-3' (FRAG. NO:1620)(SEQ. ID NO: 1629)

5'-GG GGB GTT TCB TCT TGG-3' (FRAG. NO:1621)(SEQ. ID NO: 1630)

5'-G GGB GTT TCB TCT TGG-3' (FRAG. NO:1622)(SEQ. ID NO: 1631)

5'-GGB GTT TCB TCT TGG-3' (FRAG. NO:1623)(SEQ. ID NO: 1632)

5'-GB GTT TCB TCT TGG-3' (FRAG. NO:1624)(SEQ. ID NO: 1633)

5'-B GTT TCB TCT TGG-3' (FRAG. NO:1625)(SEQ. ID NO: 1634)

5'-GTT TCB TCT TGG-3' (FRAG. NO:1626)(SEQ. ID NO: 1635)

5'-GGG GGB GTT TCB TCT TG-3' (FRAG. NO:1627)(SEQ. ID NO: 1636)

5'-GG GGB GTT TCB TCT TG-3' (FRAG. NO:1628)(SEQ. ID NO: 1637)

5'-G GGB GTT TCB TCT TG-3' (FRAG. NO:1629)(SEQ. ID NO: 1638)

5'-GGB GTT TCB TCT TG-3' (FRAG. NO:1630)(SEQ. ID NO: 1639)

5'-GB GTT TCB TCT TG-3' (FRAG. NO:1631)(SEQ. ID NO: 1640)

5'-B GTT TCB TCT TG-3' (FRAG. NO:1632)(SEQ. ID NO: 1641)

5'-GGG GGB GTT TCB TCT T-3' (FRAG. NO:1633)(SEQ. ID NO: 1642)

5'-GG GGB GTT TCB TCT T-3' (FRAG. NO:1634)(SEQ. ID NO: 1643)

5'-G GGB GTT TCB TCT T-3' (FRAG. NO:1635)(SEQ. ID NO: 1644)

5'-G GGB GTT TCB TCT T-3' (FRAG. NO:1636)(SEQ. ID NO: 1645)

5'-GGB GTT TCB TCT T-3' (FRAG. NO:1637)(SEQ. ID NO: 1646)

5'-GB GTT TCB TCT T-3' (FRAG. NO:1638)(SEQ. ID NO: 1647)

5'-GGG GGB GTT TCB TCT-3' (FRAG. NO:1639)(SEQ. ID NO: 1648)

5'-GG GGB GTT TCB TCT-3' (FRAG. NO:1640)(SEQ. ID NO: 1649)

5'-G GGB GTT TCB TCT-3' (FRAG. NO:1641)(SEQ. ID NO: 1650)

5'-GGB GTT TCB TCT-3' (FRAG. NO:1642)(SEQ. ID NO: 1651)

-continued

5'-GGG GGB GTT TCB TC-3' (FRAG. NO:1643)(SEQ. ID NO: 1652)

5'-GG GGB GTT TCB TC-3' (FRAG. NO:1644)(SEQ. ID NO: 1653)

5'-G GGB GTT TCB TC-3' (FRAG. NO:1645)(SEQ. ID NO: 1654)

5'-GGG GGB GTT TCB T-3' (FRAG. NO:1646)(SEQ. ID NO: 1655)

5'-GG GGB GTT TCB T-3' (FRAG. NO:1647)(SEQ. ID NO: 1656)

5'-GGG GGB GTT TCB-3' (FRAG. NO:1648)(SEQ. ID NO: 1657)

5'-TCT CCC CTT GTT CCT CCC C-3' (FRAG. NO:1649)(SEQ. ID NO: 1658)

5'-TCT CCT GCT CTG GTG TCT CCT C-3' (FRAG. NO:1650)(SEQ. ID NO: 1659)

5'-TTC CCT CCC TCC CCT GCC-3' (FRAG. NO:1651)(SEQ. ID NO:1660)

5'-GTG TTG TCT GTG GGT GTC C-3' (FRAG. NO:1652)(SEQ. ID NO: 1661)

5'-GTT TCG CTC TTG TTG CCC-3'-3' (FRAG. NO:1653)(SEQ. ID NO: 1661)

5'-TGG GCC CTT CCC TGC TGG-3' (FRAG. NO:1654)(SEQ. ID NO: 1663)

5'-GGG GGB G-3' (FRAG. NO:1912)(SEQ. ID NO:1925)

5'-GTG GGT GTC C-3' (FRAG. NO:1913) (SEQ. ID NO: 1926)

BP-1 Nucleic Acids and
Antisense Oligonucleotide Fragments

5'-CCGTGTTGTC BGTGGTGCTG CCCGTTTGBG GTBTGGCGCT CCBCCBBTTC CCTTTTCTCC TTGTTTTCCG TTTCTCTTGC CGTCTGTGGT T-3' (FRAG. NO:1914) (SEQ. ID NO: 1927)

5'-CCCGTTTGBGGTBTGCC-3'(FRAG. NO:1915) (SEQ. ID NO: 1928)

5'-GCTCCBCCBBTTCCCTTTTCTCC-3'(FRAG. NO:1916) (SEQ. ID NO: 1929)

5'-TTGTTTTCCGTTTCTCTTG-3'(FRAG. NO:1917) (SEQ. ID NO: 1930)

5'-CCGTCTGTGGTT-3'(FRAG. NO:1918) (SEQ. ID NO: 1931)

5'-CCCGTTTGAGGTATGGC-3'(FRAG. NO:1919) (SEQ. ID NO: 1932)

5'-GCTCCBCCAATTCCCTTTTCTCC-3'(FRAG. NO:1920) (SEQ. ID NO: 1933)

C/EBPNucleic Acids and Antisense Oligonucleotide
Antisense Oligonucleotide Fragments

5'-GGGCCCBGCCCCGCCGCCTTTTCTBGCCCC GGCC-3' (FRAG. NO:1921) (SEQ. ID NO: 1934)

5'-GGGCCCBGCCCCGCCGCCTTTTCTBGCCCC GGC-3' (FRAG. NO:1922) (SEQ. ID NO: 1935)

5'-GGGCCCB GCCCCGCCGCCTTTTCTBGCCCCGG-3' (FRAG. NO:1923) (SEQ. ID NO: 1936)

5'-GGGCCCBGCCCCGCCGCCTTTTCTBGCCCCG-3' (FRAG. NO:1924) (SEQ. ID NO: 1937)

5'-GGGCCCBGCCCCGCCGCCTTTTCTBGCCCC-3' (FRAG. NO:1925) (SEQ. ID NO: 1938)

5'-GGGCCCBGCCCCGCCGCCTTTTCTBGCCC-3' (FRAG. NO:1926) (SEQ. ID NO: 1939)

5'-GGGCCCBGCCCCGCCGCCTTTTCTBGCC-3' (FRAG. NO:1927) (SEQ. ID NO: 1940)

5'-GGGCCCBGCCCCGCCGCCTTTTCTBGC-3' (FRAG. NO:1928) (SEQ. ID NO: 1941)

5'-GGGCCCBGCCCCGCCGCCTTTTCTBG-3' (FRAG. NO:1929) (SEQ. ID NO: 1942)

5'-GGGCCCBGCCCCGCCGCCTTTTCTB-3' (FRAG. NO:1930) (SEQ. ID NO: 1943)

5'-GGGCCCBGCCCCGCCGCCTTTTCT-3' (FRAG. NO:1931) (SEQ. ID NO:1942) 1944)

5'-GGGCCCBGCCCCGCCGCCTTTTC-3' (FRAG. NO:1932) (SEQ. ID NO: 1945)

5'-GGGCCCBGCCCCGCCGCCTTTT-3' (FRAG. NO:1933) (SEQ. ID NO: 1946)

-continued

5'-GGGCCCBGCCCCGCCGCCTTT-3' (FRAG. NO:1934) (SEQ. ID NO: 1947) [1945)]

5'-GGGCCCBGCCCCGCCGCCTT-3' (FRAG. NO:1935) (SEQ. ID NO: 1948)

5'-GGGCCCBGCCCCGCCGCCT-3' (FRAG. NO:1936) (SEQ. ID NO: 1949)

5'-GGGCCCBGCCCCGCCGCC-3' (FRAG. NO:1937) (SEQ. ID NO: 1950)

5'-GGGCCCBGCCCCGCCGC-3' (FRAG. NO:1938) (SEQ. ID NO: 1951)

5'-GGGCCCBGCCCCGCCG-3' (FRAG. NO:1939) (SEQ. ID NO: 1952)

5'-GGGCCCBGCCCCGCC-3' (FRAG. NO:1940) (SEQ. ID NO: 1953)

5'-GGGCCCBGCCCCGC-3' (FRAG. NO:1941) (SEQ. ID NO: 1954)

5'-GGGCCCBGCCCCG-3' (FRAG. NO:1942) (SEQ. ID NO: 1955)

5'-GGGCCCBGCCCC-3' (FRAG. NO:1943) (SEQ. ID NO: 1956)

5'-GGGCCCBGCCC-3' (FRAG. NO:1944) (SEQ. ID NO: 1957)

5'-GGCCCBGCCCCGCCGCCTTTTCTBGCCCCGGC-3' (FRAG. NO:1945) (SEQ. ID NO: 1958)

5'-GCCCBGCCCCGCCGCCTTTTCTBGCCCCGGC-3' (FRAG. NO:1946) (SEQ. ID NO: 1959)

5'-CCCBGCCCCGCCGCCTTTTCTBGCCCCGGC-3' (FRAG. NO:1947) (SEQ. ID NO: 1960)

5'-CCBGCCCCGCCGCCTTTTCTBGCCCCGGC-3' (FRAG. NO:1948) (SEQ. ID NO: 1961)

5'-CBGCCCCGCCGCCTTTTCTBGCCCCGGC-3' (FRAG. NO:1948) (SEQ. ID NO: 1962)

5'-BGCCCCGCCGCCTTTTCTBGCCCCGGC-3' (FRAG. NO:1950) (SEQ. ID NO: 1963)

5'-GCCCCGCCGCCTTTTCTBGCCCCGGC-3' (FRAG. NO:1951) (SEQ. ID NO: 1964)

5'-CCCCGCCGCCTTTTCTBGCCCCGGC-3' (FRAG. NO:1952) (SEQ. ID NO: 1965)

5'-CCCGCCGCCTTTTCTBGCCCCGGC-3' (FRAG. NO:1953) (SEQ. ID NO: 1966)

5'-CCGCCGCCTTTTCTBGCCCCGGC-3' (FRAG. NO:1954) (SEQ. ID NO: 1967)

5'-CGCCGCCTTTTCTBGCCCCGGC-3' (FRAG. NO:1955) (SEQ. ID NO: 1968)

5'-GCCGCCTTTTCTBGCCCCGGC-3' (FRAG. NO:1956) (SEQ. ID NO: 1969)

5'-CCGCCTTTTCTBGCCCCGGC-3' (FRAG. NO:1957) (SEQ. ID NO: 1970)

5'-CGCCTTTTCTBGCCCCGGC-3' (FRAG. NO:1958) (SEQ. ID NO: 1971)

5'-GCCTTTTCTBGCCCCGGC-3' (FRAG. NO:1959) (SEQ. ID NO: 1972)

5'-CCTTTTCTBGCCCCGGC-3' (FRAG. NO:1960) (SEQ. ID NO: 1973)

5'-CTTTTCTBGCCCCGGC-3' (FRAG. NO:1961) (SEQ. ID NO: 1974)

5'-TTTTCTBGCCCCGGC-3' (FRAG. NO:1962) (SEQ. ID NO: 1975)

5'-TTTCTBGCCCCGGC-3' (FRAG. NO:1963) (SEQ. ID NO: 1976)

5'-TTCTBGCCCCGGC-3' (FRAG. NO:1964) (SEQ. ID NO: 1977)

5'-TCTBGCCCCGGC-3' (FRAG. NO:1965) (SEQ. ID NO: 1978)

5'-CTBGCCCCGGC-3' (FRAG. NO:1966) (SEQ. ID NO: 1979)

5'-GCGBGGCTGTCBCCTCGCTGGGCCC-3' (FRAG. NO:1967) (SEQ. ID NO: 1980)

5'-GCGBGGCTGTCBCCTCGCTGGGCC-3' (FRAG. NO:1968) (SEQ. ID NO: 1981)

5'-GCGBGGCTGTCBCCTCGCTGGGC-3' (FRAG. NO:1969) (SEQ. ID NO: 1982)

5'-GCGBGGCTGTCBCCTCGCTGGG-3' (FRAG. NO:1970) (SEQ. ID NO:1983)

5'-GCGBGGCTGTCBCCTCGCTGG-3' (FRAG. NO:1971) (SEQ. ID NO:1984)

5'-GCGBGGCTGTCBCCTCGCTG-3' (FRAG. NO:1972) (SEQ. ID NO:1985)

5'-GCGBGGCTGTCBCCTCGCT-3' (FRAG. NO:1973) (SEQ. ID NO:1986)

5'-GCGBGGCTGTCBCCTCGC-3' (FRAG. NO:1974) (SEQ. ID NO:1987)

5'-GCGBGGCTGTCBCCTCG-3' (FRAG. NO:1975) (SEQ. ID NO:1988)

5'-GCGBGGCTGTCBCCTC-3' (FRAG. NO:1976) (SEQ. ID NO:1989)

5'-GCGBGGCTGTCBCCT-3' (FRAG. NO:1977) (SEQ. ID NO:1990)

5'-GCGBGGCTGTCBCC-3' (FRAG. NO:1978) (SEQ. ID NO:1991)

5'-GCGBGGCTGTCBC-3' (FRAG. NO:1979) (SEQ. ID NO:1992)

5'-GCGBGGCTGTCB-3' (FRAG. NO:1980) (SEQ. ID NO:1993)

5'-GCGBGGCTGTC-3' (FRAG. NO:1981) (SEQ. ID NO:1994)

5'-GCGBGGCTGT-3' (FRAG. NO:1982) (SEQ. ID NO:1995)

5'-CGBGGCTGTCBCCTCGCTGGGCCC-3' (FRAG. NO:1983) (SEQ. ID NO:1996)

5'-GBGGCTGTCBCCTCGCTGGGCCC-3' (FRAG. NO:1984) (SEQ. ID NO:1997)

5'-BGGCTGTCBCCTCGCTGGGCCC-3' (FRAG. NO:1985) (SEQ. ID NO:1998)

5'-GGCTGTCBCCTCGCTGGGCCC-3' (FRAG. NO:1986) (SEQ. ID NO:1999)

5'-GCTGTCBCCTCGCTGGGCCC-3' (FRAG. NO:1987) (SEQ. ID NO:2000)

5'-CTGTCBCCTCGCTGGGCCC-3' (FRAG. NO:1988) (SEQ. ID NO:2001)

5'-TGTCBCCTCGCTGGGCCC-3' (FRAG. NO:1989) (SEQ. ID NO:2002)

5'-GTCBCCTCGCTGGGCCC-3' (FRAG. NO:1990) (SEQ. ID NO:2003)

5'-TCBCCTCGCTGGGCCC-3' (FRAG. NO:1991) (SEQ. ID NO:2004)

5'-CBCCTCGCTGGGCCC-3' (FRAG. NO:1992) (SEQ. ID NO:2005)

5'-BCCTCGCTGGGCCC-3' (FRAG. NO:1993) (SEQ. ID NO:2006)

5'-CCTCGCTGGGCCC-3' (FRAG. NO:1994) (SEQ. ID NO:2007)

5'-CTCGCTGGGCCC-3' (FRAG. NO:1995) (SEQ. ID NO:2008)

5'-TCGCTGGGCCC-3' (FRAG. NO:1996) (SEQ. ID NO:2009)

5'-CGCTGGGCCC-3' (FRAG. NO:1997) (SEQ. ID NO:2010)

5'-GCGCGGCCGTCBTGGCGGCGTCGGGCCGGGC-3' (FRAG. NO:1998) (SEQ. ID NO:2011)

5'-GCGCGGCCGTCBTGGCGGCGTCGGGCCGGG-3' (FRAG. NO:1999) (SEQ. ID NO:2012)

5'-GCGCGGCCGTCBTGGCGGCGTCGGGCCGG-3' (FRAG. NO:2000) (SEQ. ID NO:2013)

5'-GCGCGGCCGTCBTGGCGGCGTCGGGCCG-3' (FRAG. NO:2001) (SEQ. ID NO:2014)

5'-GCGCGGCCGTCBTGGCGGCGTCGGGCC-3' (FRAG. NO:2002) (SEQ. ID NO:2015)

5'-GCGCGGCCGTCBTGGCGGCGTCGGGC-3' (FRAG. NO:2003) (SEQ. ID NO:2016)

5'-GCGCGGCCGTCBTGGCGGCGTCGGG-3' (FRAG. NO:2004) (SEQ. ID NO:2017)

5'-GCGCGGCCGTCBTGGCGGCGTCGG-3' (FRAG. NO:2005) (SEQ. ID NO:2018)

5'-GCGCGGCCGTCBTGGCGGCGTCG-3' (FRAG. NO:2006) (SEQ. ID NO:2019)

5'-GCGCGGCCGTCBTGGCGGCGTC-3' (FRAG. NO:2007) (SEQ. ID NO:2020)

5'-GCGCGGCCGTCBTGGCGGCGT-3' (FRAG. NO:2008) (SEQ. ID NO:2021)

5'-GCGCGGCCGTCBTGGCGGCG-3' (FRAG. NO:2009) (SEQ. ID NO:2022)

5'-GCGCGGCCGTCBTGGCGGC-3' (FRAG. NO:2010) (SEQ. ID NO:2023)

5'-GCGCGGCCGTCBTGGCGG-3' (FRAG. NO:2011) (SEQ. ID NO:2024)

5'-GCGCGGCCGTCBTGGCG-3' (FRAG. NO:2012) (SEQ. ID NO:2025)

-continued

5'-GCGCGGCCGTCBTGGC-3' (FRAG. NO:2013) (SEQ. ID NO:2026)

5'-GCGCGGCCGTCBTGG-3' (FRAG. NO:2014) (SEQ. ID NO:2027)

5'-GCGCGGCCGTCBTG-3' (FRAG. NO:2015) (SEQ. ID NO:2028)

5'-GCGCGGCCGTCBT-3' (FRAG NO:2016) (SEQ. ID NO:2029)

5'-GCGCGGCCGTCB-3' (FRAG. NO:2017) (SEQ. ID NO:2030)

5'-GCGCGGCCGTC-3' (FRAG. NO:2018) (SEQ. ID NO:2031)

5'-GCGCGGCCGT-3' (FRAG. NO:2019) (SEQ. ID NO:2032)

5'-CGCGGCCGTCBTGGCGGCGTCGGGCCGGGC-3' (FRAG. NO:2020) (SEQ. ID NO:2033)

5'-GCGGCCGTCBTGGCGGCGTCGGGCCGGGC-3' (FRAG. NO:2021) (SEQ. ID NO:2034)

5'-CGGCCGTCBTGGCGGCGTCGGGCCGGGC-3' (FRAG. NO:2022) (SEQ. ID NO:2035)

5'-GGCCGTCBTGGCGGCGTCGGGCCGGGC-3' (FRAG. NO:2023) (SEQ. ID NO:2036)

5'-GCCGTCBTGGCGGCGTCGGGCCGGGC-3' (FRAG. NO:2024) (SEQ. ID NO:2037)

5'-CCGTCBTGGCGGCGTCGGGCCGGGC-3' (FRAG. NO:2025) (SEQ. ID NO:2038)

5'-CGTCBTGGCGGCGTCGGGCCGGGC-3' (FRAG. NO:2026) (SEQ. ID NO:2039)

5'-GTCBTGGCGGCGTCGGGCCGGGC-3' (FRAG. NO:2027) (SEQ. ID NO:2540)

5'-TCBTGGCGGCGTCGGGCCGGGC-3' (FRAG. NO:2028) (SEQ. ID NO:2041)

5'-CBTGGCGGCGTCGGGCCGGGC-3' (FRAG. NO:2029) (SEQ. ID NO:2042)

5'-BTGGCGGCGTCGGGCCGGGC-3' (FRAG. NO:2030) (SEQ. ID NO:2043)

5'-TGGCGGCGTCGGGCCGGGC-3' (FRAG. NO:2531) (SEQ. ID NO:2044)

5'-GGCGGCGTCGGGCCGGGC-3' (FRAG. NO:2032) (SEQ. ID NO:2045)

5'-GCGGCGTCGGGCCGGGC-3' (FRAG. NO:2033) (SEQ. ID NO:2046)

5'-CGGCGTCGGGCCGGGC-3' (FRAG. NO:2034) (SEQ. ID NO:2047)

5'-GGCGTCGGGCCGGGC-3' (FRAG. NO:2035) (SEQ. ID NO:2048)

5'-GCGTCGGGCCGGGC-3' (FRAG. NO:2036) (SEQ. ID NO:2049)

5'-CGTCGGGCCGGGC-3' (FRAG. NO:2037) (SEQ. ID NO:2050)

5'-GTCGGGCCGGGC-3' (FRAG. NO:2038) (SEQ. ID NO:2051)

5'-TCGGGCCGGGC-3' (FRAG. NO:2039) (SEQ. ID NO:2052)

5'-CGGGCCGGGC-3' (FRAG. NO:2040) (SEQ. ID NO:2053)

5'-CCGCBGGCCBGGGCGCGCCGCCGGCCGGGCCG-3' (FRAG. NO:2041) (SEQ. ID NO:2054)

5'-CCGCBGGCCBGGGCGCGCCGCCGGCCGGGCC-3' (FRAG. NO:2042) (SEQ. ID NO:2055)

5'-CCGCBGGCCBGGGCGCGCCGCCGGCCGGGC-3' (FRAG. NO:2043) (SEQ. ID NO:2056)

5'-CCGCBGGCCBGGGCGCGCCGCCGGCCGGG-3' (FRAG. NO:2044) (SEQ. ID NO:2057)

5'-CCGCBGGCCBGGGCGCGCCGCCGGCCGG-3' (FRAG. NO:2545) (SEQ. ID NO:2058)

5'-CCGCBGGCCBGGGCGCGCCGCCGGCCG-3' (FRAG. NO:2546) (SEQ. ID NO:2059)

5'-CCGCBGGCCBGGGCGCGCCGCCGGCC-3' (FRAG. NO:2047) (SEQ. ID NO:2060)

5'-CCGCBGGCCBGGGCGCGCCGCCGGC-3' (FRAG. NO:2048) (SEQ. ID NO:2061)

5'-CCGCBGGCCBGGGCGCGCCGCCGG-3' (FRAG. NO:2049) (SEQ. ID NO:2062)

5'-CCGCBGGCCBGGGCGCGCCGCCG-3' (FRAG. NO:2050) (SEQ. ID NO:2063)

5'-CCGCBGGCCBGGGCGCGCCGCC-3' (FRAG. NO:2051) (SEQ. ID NO:2064)

5'-CCGCBGGCCBGGGCGCGCCGC-3' (FRAG. NO:2052) (SEQ. ID NO:2065)

5'-CCGCBGGCCBGGGCGCGCCG-3' (FRAG. NO:2053) (SEQ. ID NO:2066)

5'-CCGCBGGCCBGGGCGCGCC-3' (FRAG. NO:2054) (SEQ. ID NO:2067)

5'-CCGCBGGCCBGGGCGCGC-3' (FRAG. NO:2055) (SEQ. ID NO:2068)

5'-CCGCBGGCCBGGGCGCG-3' (FRAG. NO:2056) (SEQ. ID NO:2069)

5'-CCGCBGGCCBGGGCGC-3' (FRAG. NO:2057) (SEQ. ID NO:2070)

5'-CCGCBGGCCBGGGCG-3' (FRAG. NO:2058) (SEQ. ID NO:2071)

5'-CCGCBGGCCBGGGC-3' (FRAG. NO:2059) (SEQ. ID NO:2072)

5'-CCGCBGGCCBGGG-3' (FRAG. NO:2060) (SEQ. ID NO:2073)

5'-CCGCBGGCCBGG-3' (FRAG. NO:2061) (SEQ. ID NO:2074)

5'-CCGCBGGCCBG-3' (FRAG. NO:2062) (SEQ. ID NO:2075)

5'-CCGCBGGCCB-3' (FRAG. NO:2063) (SEQ. ID NO:2076)

5'-CCGCBGGCC-3' (FRAG. NO:2064) (SEQ. ID NO:2077)

5'-CGCBGGCCBGGGCGCGCCGCCGGCCGGGCCG-3' (FRAG. NO:2065) (SEQ. ID NO:2078)

5'-GCBGGCCBGGGCGCGCCGCCGGCCGGGCCG-3' (FRAG. NO:2066) (SEQ. ID NO:2079)

5'-CBGGCCBGGGCGCGCCGCCGGCCGGGCCG-3' (FRAG. NO:2067) (SEQ. ID NO:2080)

5'-BGGCCBGGGCGCGCCGCCGGCCGGGCCG-3' (FRAG. NO:2068) (SEQ. ID NO:2081)

5'-GGCCBGGGCGCGCCGCCGGCCGGGCCG-3' (FRAG. NO:2069) (SEQ. ID NO:2082)

5'-GCCBGGGCGCGCCGCCGGCCGGGCCG-3' (FRAG. NO:2070) (SEQ. ID NO:2083)

5'-CCBGGGCGCGCCGCCGGCCGGGCCG-3' (FRAG. NO:2071) (SEQ. ID NO:2084)

5'-CBGGGCGCGCCGCCGGCCGGGCCG-3' (FRAG. NO:2072) (SEQ. ID NO:2085)

5'-BGGGCGCGCCGCCGGCCGGGCCG-3' (FRAG. NO:2073) (SEQ. ID NO:2086)

5'-GGGCGCGCCGCCGGCCGGGCCG-3' (FRAG. NO:2074) (SEQ. ID NO:2087)

5'-GGCGCGCCGCCGGCCGGGCCG-3' (FRAG. NO:2075) (SEQ. ID NO:2088)

5'-GCGCGCCGCCGGCCGGGCCG-3' (FRAG. NO:2076) (SEQ. ID NO:2089)

5'-CGCGCCGCCGGCCGGGCCG-3' (FRAG. NO:2077) (SEQ. ID NO:2090)

5'-GCGCCGCCGGCCGGGCCG-3' (FRAG. NO:2078) (SEQ. ID NO:2091)

5'-CGCCGCCGGCCGGGCCG-3' (FRAG. NO:2079) (SEQ. ID NO:2092)

5'-GCCGCCGGCCGGGCCG-3' (FRAG. NO:2080) (SEQ. ID NO:2093)

5'-CCGCCGGCCGGGCCG-3' (FRAG. NO:2081) (SEQ. ID NO:2094)

5'-CGCCGGCCGGGCCG-3' (FRAG. NO:2082) (SEQ. ID NO:2095)

5'-GCCGGCCGGGCCG-3' (FRAG. NO:2083) (SEQ. ID NO:2096)

5'-CCGGCCGGGCCG-3' (FRAG. NO:2084) (SEQ. ID NO:2097)

5'-CGGCCGGGCCG-3' (FRAG. NO:2085) (SEQ. ID NO:2098)

5'-GGCCGGGCCG-3' (FRAG. NO:2086) (SEQ. ID NO:2099)

5'-GGGCGCBGGCTCCGCB-3' (FRAG. NO:2087) (SEQ. ID NO:2100)

5'-GGGCCCCTGGCTCGGCCCCGCGGCCCGGCTTGCCCGCCCGGCCGG-3' (FRAG.NO:2088)(SEQ.ID NO:2101)

5'-GGGCCCCTGGCTCGGCCCCGCGGCCCGGCTTGCCCGCCCGGCCCG-3' (FRAG.NO:2089)(SEQ.ID NO:2102)

5'-GGGCCCCTGGCTCGGCCCCGCGGCCCGGCTTGCCCGCCCGGCC-3' (FRAG.NO:2090)(SEQ.ID NO:2103)

5'-GGGCCCCTGGCTCGGCCCCGCGGCCCGGCTTGCCCGCCCGGC-3' (FRAG. NO:2091) (SEQ. ID NO:2104)

-continued

5'-GGGCCCCTGGCTCGGCCCCGCGGCCCGGCTTGCCCGCCCGGC-3' (FRAG. NO:2092) (SEQ. ID NO:2105)

5'-GGGCCCCTGGCTCGGCCCCGCGGCCCGGCTTGCCCGCCCGG-3' (FRAG. NO:2093) (SEQ. ID NO:2106)

5'-GGGCCCCTGGCTCGGCCCCGCGGCCCGGCTTGCCCGCCCG-3' (FRAG. NO:2094) (SEQ. ID NO:2107)

5'-GGGCCCCTGGCTCGGCCCCGCGGCCCGGCTTGCCCGCCC-3' (FRAG. NO:2095) (SEQ. ID NO:2108)

5'-GGGCCCCTGGCTCGGCCCCGCGGCCCGGCTTGCCCGCC-3' (FRAG. NO:2096) (SEQ. ID NO:2109)

5'-GGGCCCCTGGCTCGGCCCCGCGGCCCGGCTTGCCCGC-3' (FRAG. NO:2097) (SEQ. ID NO:2110)

5'-GGGCCCCTGGCTCGGCCCCGCGGCCCGGCTTGCCCG-3' (FRAG. NO:2098) (SEQ. ID NO:2111)

5'-GGGCCCCTGGCTCGGCCCCGCGGCCCGGCTTGCCC-3' (FRAG. NO:2099) (SEQ. ID NO:2112)

5'-GGGCCCCTGGCTCGGCCCCGCGGCCCGGCTTGCC-3' (FRAG. NO:2100) (SEQ. ID NO:2113)

5'-GGGCCCCTGGCTCGGCCCCGCGGCCCGGCTTGC-3' (FRAG. NO:2101) (SEQ. ID NO:2114)

5'-GGGCCCCTGGCTCGGCCCCGCGGCCCGGCTTG-3' (FRAG. NO:2102) (SEQ. ID NO:2115)

5'-GGGCCCCTGGCTCGGCCCCGCGGCCCGGCTT-3' (FRAG. NO:2103) (SEQ. ID NO:2116)

5'-GGGCCCCTGGCTCGGCCCCGCGGCCCGGCT-3' (FRAG. NO:2104) (SEQ. ID NO:2117)

5'-GGGCCCCTGGCTCGGCCCCGCGGCCCGGC-3' (FRAG. NO:2105) (SEQ. ID NO:2118)

5'-GGGCCCCTGGCTCGGCCCCGCGGCCCGG-3' (FRAG. NO:2106) (SEQ. ID NO:2119)

5'-GGGCCCCTGGCTCGGCCCCGCGGCCCG-3' (FRAG. NO:2107) (SEQ. ID NO:2120)

5'-GGGCCCCTGGCTCGGCCCCGCGGCCC-3' (FRAG. NO:2108) (SEQ. ID NO:2121)

5'-GGGCCCCTGGCTCGGCCCCGCGGCC-3' (FRAG. NO:2109) (SEQ. ID NO:2122)

5'-GGGCCCCTGGCTCGGCCCCGCGGC-3' (FRAG. NO:2110) (SEQ. ID NO:2123)

5'-GGGCCCCTGGCTCGGCCCCGCGG-3' (FRAG. NO:2111) (SEQ. ID NO:2124)

5'-GGGCCCCTGGCTCGGCCCCGCG-3' (FRAG. NO:2112) (SEQ. ID NO:2125)

5'-GGGCCCCTGGCTCGGCCCCGC-3' (FRAG. NO:2113) (SEQ. ID NO:2126)

5'-GGGCCCCTGGCTCGGCCCCG-3' (FRAG. NO:2114) (SEQ. ID NO:2127)

5'-GGGCCCCTGGCTCGGCCCC-3' (FRAG. NO:2115) (SEQ. ID NO:2128)

5'-GGGCCCCTGGCTCGGCCC-3' (FRAG. NO:2116) (SEQ. ID NO:2129)

5'-GGGCCCCTGGCTCGGCC-3' (FRAG. NO:2117) (SEQ. ID NO:2130)

5'-GGGCCCCTGGCTCGGC-3' (FRAG. NO:2118) (SEQ. ID NO:2131)

5'-GGGCCCCTGGCTCGG-3' (FRAG. NO:2119) (SEQ. ID NO:2132)

5'-GGGCCCCTGGCTCG-3' (FRAG. NO:2120) (SEQ. ID NO:2133)

5'-GGGCCCCTGGCTC-3' (FRAG. NO:2121) (SEQ. ID NO:2134)

5'-GGGCCCCTGGCT-3' (FRAG. NO:2122) (SEQ. ID NO:2135)

5'-GGCCCCTGGCTCGGCCCCGCGGCCCGGCTTGCCCGCCCGGCCCGG-3'(FRAG.NO:2123)(SEQ.ID NO:2136)

5'-GCCCCTGGCTCGGCCCCGCGGCCCGGCTTGCCCGCCCGGCCCGG-3' (FRAG. NO:2124) (SEQ. ID NO:2137)

5'-CCCCTGGCTCGGCCCCGCGGCCCGGCTTGCCCGCCCGGCCCGG-3' (FRAG. NO:2125) (SEQ. ID NO:2138)

5'-CCCTGGCTCGGCCCCGCGGCCCGGCTTGCCCGCCCGGCCCGG-3' (FRAG. NO:2126) (SEQ. ID NO:2139)

5'-CCTGGCTCGGCCCCGCGGCCCGGCTTGCCCGCCCGGCCCGG-3' (FRAG. NO:2127) (SEQ. ID NO:2140)

5'-CTGGCTCGGCCCCGCGGCCCGGCTTGCCCGCCCGGCCCGG-3' (FRAG. NO:2128) (SEQ. ID NO:2141)

5'-TGGCTCGGCCCCGCGGCCCGGCTTGCCCGCCCGGCCCGG-3' (FRAG. NO:2129) (SEQ. ID NO:2142)

5'-GGCTCGGCCCCGCGGCCCGGCTTGCCCGCCCGGCCCGG-3' (FRAG. NO:2130) (SEQ. ID NO:2143)

5'-GCTCGGCCCCGCGGCCCGGCTTGCCCGCCCGGCCCGG-3' (FRAG. NO:2131) (SEQ. ID NO:2144)

5'-CTCGGCCCCGCGGCCCGGCTTGCCCGCCCGGCCCGG-3' (FRAG. NO:2132) (SEQ. ID NO:2145)

5'-TCGGCCCCGCGGCCCGGCTTGCCCGCCCGGCCCGG-3' (FRAG. NO:2133) (SEQ. ID NO:2146)

5'-CGGCCCCGCGGCCCGGCTTGCCCGCCCGGCCCGG-3' (FRAG. NO:2134) (SEQ. ID NO:2147)

5'-GGCCCCGCGGCCCGGCTTGCCCGCCCGGCCCGG-3' (FRAG. NO:2135) (SEQ. ID NO:2148)

5'-GCCCCGCGGCCCGGCTTGCCCGCCCGGCCCGG-3' (FRAG. NO:2136) (SEQ. ID NO:2149)

5'-CCCCGCGGCCCGGCTTGCCCGCCCGGCCCGG-3' (FRAG. NO:2137) (SEQ. ID NO:2150)

5'-CCCGCGGCCCGGCTTGCCCGCCCGGCCCGG-3' (FRAG. NO:2138) (SEQ. ID NO:2151)

5'-CCGCGGCCCGGCTTGCCCGCCCGGCCCGG-3' (FRAG. NO:2139) (SEQ. ID NO:2152)

5'-CGCGGCCCGGCTTGCCCGCCCGGCCCGG-3' (FRAG. NO:2140) (SEQ. ID NO:2153)

5'-GCGGCCCGGCTTGCCCGCCCGGCCCGG-3' (FRAG. NO:2141) (SEQ. ID NO:2154)

5'-CGGCCCGGCTTGCCCGCCCGGCCCGG-3' (FRAG. NO:2142) (SEQ. ID NO:2155)

5'-GGCCCGGCTTGCCCGCCCGGCCCGG-3' (FRAG. NO:2143) (SEQ. ID NO:2156)

5'-GCCCGGCTTGCCCGCCCGGCCCGG-3' (FRAG. NO:2144) (SEQ. ID NO:2157)

5'-CCCGGCTTGCCCGCCCGGCCCGG-3' (FRAG. NO:2145) (SEQ. ID NO:2158)

5'-CCGGCTTGCCCGCCCGGCCCGG-3' (FRAG. NO:2146) (SEQ. ID NO:2159)

5'-CGGCTTGCCCGCCCGGCCCGG-3' (FRAG. NO:2147) (SEQ. ID NO:2160)

5'-GGCTTGCCCGCCCGGCCCGG-3' (FRAG. NO:2148) (SEQ. ID NO:2161)

5'-GCTTGCCCGCCCGGCCCGG-3' (FRAG. NO:2149) (SEQ. ID NO:2162)

5'-CTTGCCCGCCCGGCCCGG-3' (FRAG. NO:2150) (SEQ. ID NO:2163)

5'-TTGCCCGCCCGGCCCGG-3' (FRAG. NO:2151) (SEQ. ID NO:2164)

5'-TGCCCGCCCGGCCCGG-3' (FRAG. NO:2152) (SEQ. ID NO:2165)

5'-GCCCGCCCGGCCCGG-3' (FRAG. NO:2153) (SEQ. ID NO:2166)

5'-CCCGCCCGGCCCGG-3' (FRAG. NO:2154) (SEQ. ID NO:2167)

5'-CCGCCCGGCCCGG-3' (FRAG. NO:2155) (SEQ. ID NO:2168)

5'-CGCCCGGCCCGG-3' (FRAG. NO:2156) (SEQ. ID NO:2169)

5'-GCCCGGCCCGG-3' (FRAG. NO:2157) (SEQ. ID NO:2170)

5'-GGCGGGGGCGGCGGCGCCTGGCTCGCCTBGGGCCCC-3' (FRAG. NO:2158) (SEQ. ID NO:2171)

5'-GGCGGGGGCGGCGGCGCCTGGCTCGCCTBGGGCCC-3' (FRAG. NO:2159) (SEQ. ID NO:2172)

5'-GGCGGGGGCGGCGGCGCCTGGCTCGCCTBGGGCC-3' (FRAG. NO:2160) (SEQ. ID NO:2173)

5'-GGCGGGGGCGGCGGCGCCTGGCTCGCCTBGGGC-3' (FRAG. NO:2161) (SEQ. ID NO:2174)

5'-GGCGGGGGCGGCGGCGCCTGGCTCGCCTBGGG-3' (FRAG. NO:2162) (SEQ. ID NO:2175)

5'-GGCGGGGGCGGCGGCGCCTGGCTCGCCTBGG-3' (FRAG. NO:2163) (SEQ. ID NO:2176)

5'-GGCGGGGGCGGCGGCGCCTGGCTCGCCTBG-3' (FRAG. NO:2164) (SEQ. ID NO:2177)

5'-GGCGGGGGCGGCGGCGCCTGGCTCGCCTB-3' (FRAG. NO:2165) (SEQ. ID NO:2178)

5'-GGCGGGGGCGGCGGCGCCTGGCTCGCCT-3' (FRAG. NO:2166) (SEQ. ID NO:2179)

5'-GGCGGGGGCGGCGGCGCCTGGCTCGCC-3' (FRAG. NO:2167) (SEQ. ID NO:2180)

5'-GGCGGGGGCGGCGGCGCCTGGCTCGC-3' (FRAG. NO:2168) (SEQ. ID NO:2181)

5'-GGCGGGGGCGGCGGCGCCTGGCTCG-3' (FRAG. NO:2169) (SEQ. ID NO:2182)

5'-GGCGGGGGCGGCGGCGCCTGGCTC-3' (FRAG. NO:2170) (SEQ. ID NO:2183)

```
5'-GGCGGGGGCGGCGGCGCCTGGCT-3' (FRAG. NO:2171) (SEQ. ID NO:2184)

5'-GGCGGGGGCGGCGGCGCCTGGC-3' (FRAG. NO:2172) (SEQ. ID NO:2185)

5'-GGCGGGGGCGGCGGCGCCTGG-3' (FRAG. NO:2173) (SEQ. ID NO:2186)

5'-GGCGGGGGCGGCGGCGCCTG-3' (FRAG. NO:2174) (SEQ. ID NO:2187)

5'-GGCGGGGGCGGCGGCGCCT-3' (FRAG. NO:2175) (SEQ. ID NO:2188)

5'-GGCGGGGGCGGCGGCGCC-3' (FRAG. NO:2176) (SEQ. ID NO:2189)

5'-GGCGGGGGCGGCGGCGC-3' (FRAG. NO:2177) (SEQ. ID NO:2190)

5'-GGCGGGGGCGGCGGCG-3' (FRAG. NO:2178) (SEQ. ID NO:2191)

5'-GGCGGGGGCGGCGGC-3' (FRAG. NO:2179) (SEQ. ID NO:2192)

5'-GGCGGGGGCGGCGG-3' (FRAG. NO:2180) (SEQ. ID NO:2193)

5'-GGCGGGGGCGGCG-3' (FRAG. NO:2181) (SEQ. ID NO:2194)

5'-GGCGGGGGCGGC-3' (FRAG. NO:2182) (SEQ. ID NO:2195)

5'-GGCGGGGGCGG-3' (FRAG. NO:2183) (SEQ. ID NO:2196)

5'-GCGGGGGCGGCGGCGCCTGGCTCGCCTBGGGCCCC-3' (FRAG. NO:2184) (SEQ. ID NO:2197)

5'-CGGGGGCGGCGGCGCCTGGCTCGCCTBGGGCCCC-3' (FRAG. NO:2185) (SEQ. ID NO:2198)

5'-GGGGGCGGCGGCGCCTGGCTCGCCTBGGGCCCC-3' (FRAG. NO:2186) (SEQ. ID NO:2199)

5'-GGGGCGGCGGCGCCTGGCTCGCCTBGGGCCCC-3' (FRAG. NO:2187) (SEQ. ID NO:2200)

5'-GGGCGGCGGCGCCTGGCTCGCCTBGGGCCCC-3' (FRAG. NO:2188) (SEQ. ID NO:2201)

5'-GGCGGCGGCGCCTGGCTCGCCTBGGGCCCC-3' (FRAG. NO:2189) (SEQ. ID NO:2202)

5'-GCGGCGGCGCCTGGCTCGCCTBGGGCCCC-3' (FRAG. NO:2190) (SEQ. ID NO:2203)

5'-CGGCGGCGCCTGGCTCGCCTBGGGCCCC-3' (FRAG. NO:2191) (SEQ. ID NO:2204)

5'-GGCGGCGCCTGGCTCGCCTBGGGCCCC-3' (FRAG. NO:2192) (SEQ. ID NO:2205)

5'-GCGGCGCCTGGCTCGCCTBGGGCCCC-3' (FRAG. NO:2193) (SEQ. ID NO:2206)

5'-CGGCGCCTGGCTCGCCTBGGGCCCC-3' (FRAG. NO:2194) (SEQ. ID NO:2207)

5'-GGCGCCTGGCTCGCCTBGGGCCCC-3' (FRAG. NO:2195) (SEQ. ID NO:2208)

5'-GCGCCTGGCTCGCCTBGGGCCCC-3' (FRAG. NO:2196) (SEQ. ID NO:2209)

5'-CGCCTGGCTCGCCTBGGGCCCC-3' (FRAG. NO:2197) (SEQ. ID NO:2210)

5'-GCCTGGCTCGCCTBGGGCCCC-3' (FRAG. NO:2198) (SEQ. ID NO:2211)

5'-CCTGGCTCGCCTBGGGCCCC-3' (FRAG. NO:2199) (SEQ. ID NO:2212)

5'-CTGGCTCGCCTBGGGCCCC-3' (FRAG. NO:2200) (SEQ. ID NO:2213)

5'-TGGCTCGCCTBGGGCCCC-3' (FRAG. NO:2201) (SEQ. ID NO:2214)

5'-GGCTCGCCTBGGGCCCC-3' (FRAG. NO:2202) (SEQ. ID NO:2215)

5'-GCTCGCCTBGGGCCCC-3' (FRAG. NO:2203) (SEQ. ID NO:2216)

5'-CTCGCCTBGGGCCCC-3' (FRAG. NO:2204) (SEQ. ID NO:2217)

5'-TCGCCTBGGGCCCC-3' (FRAG. NO:2205) (SEQ. ID NO:2218)

5'-CGCCTBGGGCCCC-3' (FRAG. NO:2206) (SEQ. ID NO:2219)

5'-GCCTBGGGCCCC-3' (FRAG. NO:2207) (SEQ. ID NO:2220)

5'-CCTBGGGCCCC-3' (FRAG. NO:2208) (SEQ. ID NO:2221)

5'-CTBGGGCCCC-3' (FRAG. NO:2209) (SEQ. ID NO:2222)

5'-GGGTGGGCBCGGCGGCC-3' (FRAG. NO:2210) (SEQ. ID NO:2223)
```

-continued

5'-GGTCGGCGBBGBGCTCGTCGTGGC-3' (FRAG. NO:2211) (SEQ. ID NO:2224)

5'-GGTCGGCGBBGBGCTCGTCGTGG-3' (FRAG. NO:2212) (SEQ. ID NO:2225)

5'-GGTCGGCGBBGBGCTCGTCGTG-3' (FRAG. NO:2213) (SEQ. ID NO:2226)

5'-GGTCGGCGBBGBGCTCGTCGT-3' (FRAG. NO:2214) (SEQ. ID NO:2227)

5'-GGTCGGCGBBGBGCTCGTCG-3' (FRAG. NO:2215) (SEQ. ID NO:2228)

5'-GGTCGGCGBBGBGCTCGTC-3' (FRAG. NO:2216) (SEQ. ID NO:2229)

5'-GGTCGGCGBBGBGCTCGT-3' (FRAG. NO:2217) (SEQ. ID NO:2230)

5'-GGTCGGCGBBGBGCTCG-3' (FRAG. NO:2218) (SEQ. ID NO:2231)

5'-GGTCGGCGBBGBGCTC-3' (FRAG. NO:2219) (SEQ. ID NO:2232)

5'-GGTCGGCGBBGBGCT-3' (FRAG. NO:2220) (SEQ. ID NO:2233)

5'-GGTCGGCGBBGBGC-3' (FRAG. NO:2221) (SEQ. ID NO:2234)

5'-GGTCGGCGBBGBG-3' (FRAG. NO:2222) (SEQ. ID NO:2235)

5'-GGTCGGCGBBGB-3' (FRAG. NO:2223) (SEQ. ID NO:2236)

5'-GGTCGGCGBBG-3' (FRAG. NO:2224) (SEQ. ID NO:2237)

5'-GTCGGCGBBGBGCTCGTCGTGGC-3' (FRAG. NO:2225) (SEQ. ID NO:2238)

5'-TCGGCGBBGBGCTCGTCGTGGC-3' (FRAG. NO:2226) (SEQ. ID NO:2239)

5'-CGGCGBBGBGCTCGTCGTGGC-3' (FRAG. NO:2227) (SEQ. ID NO:2240)

5'-GGCGBBGBGCTCGTCGTGGC-3' (FRAG. NO:2228) (SEQ. ID NO:2241)

5'-GCGBBGBGCTCGTCGTGGC-3' (FRAG. NO:2229) (SEQ. ID NO:2242)

5'-CGBBGBGCTCGTCGTGGC-3' (FRAG. NO:2230) (SEQ. ID NO:2243)

5'-GBBGBGCTCGTCGTGGC-3' (FRAG. NO:2231) (SEQ. ID NO:2244)

5'-BBGBGCTCGTCGTGGC-3' (FRAG. NO:2232) (SEQ. ID NO:2245)

5'-BGBGCTCGTCGTGGC-3' (FRAG. NO:2233) (SEQ. ID NO:2246)

5'-GBGCTCGTCGTGGC-3' (FRAG. NO:2234) (SEQ. ID NO:2247)

5'-BGCTCGTCGTGGC-3' (FRAG. NO:2235) (SEQ. ID NO:2248)

5'-GCTCGTCGTGGC-3' (FRAG. NO:2236) (SEQ. ID NO:2249)

5'-CTCGTCGTGGC-3' (FRAG. NO:2237) (SEQ. ID NO:2250)

5'-TCGTCGTGGC-3' (FRAG. NO:2238) (SEQ. ID NO:2251)

5'-GGGGCCCCGCGCCGCCCGCC-3' (FRAG. NO:2239) (SEQ. ID NO:2252)

5'-GGGGCCCCGCGCCGCCCGC-3' (FRAG. NO:2240) (SEQ. ID NO:2253)

5'-GGGGCCCCGCGCCGCCCG-3' (FRAG. NO:2241) (SEQ. ID NO:2254)

5'-GGGGCCCCGCGCCGCCC-3' (FRAG. NO:2242) (SEQ. ID NO:2255)

5'-GGGGCCCCGCGCCGCC-3' (FRAG. NO:2243) (SEQ. ID NO:2256)

5'-GGGGCCCCGCGCCGC-3' (FRAG. NO:2244) (SEQ. ID NO:2257)

5'-GGGGCCCCGCGCCG-3' (FRAG. NO:2245) (SEQ. ID NO:2258)

5'-GGGGCCCCGCGCC-3' (FRAG. NO:2246) (SEQ. ID NO:2259)

5'-GGGGCCCCGCGC-3' (FRAG. NO:2247) (SEQ. ID NO:2260)

5'-GGGCCCCGCGCCGCCCGCC-3' (FRAG. NO:2248) (SEQ. ID NO:2261)

5'-GGCCCCGCGCCGCCCGCC-3' (FRAG. NO:2249) (SEQ. ID NO:2262)

-continued

5'-GCCCCGCGCCGCCCGCC-3' (FRAG. NO:2250) (SEQ. ID NO:2263)

5'-CCCCGCGCCGCCCGCC-3' (FRAG. NO:2251) (SEQ. ID NO:2264)

5'-CCCGCGCCGCCCGCC-3' (FRAG. NO:2252) (SEQ. ID NO:2265)

5'-CCGCGCCGCCCGCC-3' (FRAG. NO:2253) (SEQ. ID NO:2266)

5'-CGCGCCGCCCGCC-3' (FRAG. NO:2254) (SEQ. ID NO:2267)

5'-GCGCCGCCCGCC-3' (FRAG. NO:2255) (SEQ. ID NO:2268)

5'-CGCCGCCCGCC-3' (FRAG. NO:2256) (SEQ. ID NO:2269)

5'-GCCGCCCGCC-3' (FRAG. NO:2257) (SEQ. ID NO:2270)

5'-GGGGCGCGCGGCGCCGCCGGG-3' (FRAG. NO:2258) (SEQ. ID NO:2271)

5'-GGCGGGGBGCGGCBGGGCCCGGGCCC-3' (FRAG. NO:2259) (SEQ. ID NO:2272)

5'-GGCGCGTCGCCGTCGCCCCBGTCGGGCTCGCGC-3' (FRAG. NO:2260) (SEQ. ID NO:2273)

5'-GCGCGGGCBBCBGCGBGCCGGGCGCG-3' (FRAG. NO:2261) (SEQ. ID NO:2274)

5'-GCGCBCGGGCCCBCCTGCGCGGGC-3' (FRAG. NO:2262)(SEQ. ID NO:2275)

5'-GGGCGGGGTGGGCTGCCCTGCGGCCGCC-3' (FRAG. NO:2263) (SEQ. ID NO:2276)

5'-GGGCTGCTGCGCGGCGGCTCCGGCGA-3' (FRAG. NO:2264) (SEQ. ID NO:2277)

5'-CTCCCGGGCGGGGCCGGGCGCGGGG-3' (FRAG. NO:2265) (SEQ. ID NO:2278)

5'-GGGCTGCCGCGGTCCGGGCCCCTCTTGCCGGCG-3' (FRAG. NO:2266) (SEQ. ID NO:2279)

5'-GCGCTCGCGCCGCTGCCGG-3' (FRAG. NO:2267) (SEQ ID NO:2280)

5'-GCGCCGCTTGGCCTTGTCGCGGC-3' (FRAG. NO:2268) (SEQ. ID NO:2281)

5'-GCTGCTCCBCGCGCTGG-3' (FRAG. NO:2269) (SEQ. ID NO:2282)

5'-GCCGGBGGCCGGCCBGGTCCCGCG-3' (FRAG NO:2270) (SEQ. ID NO:2283)

5'-CCCGGCGGCCGGCBGGBBGGGCGGGCTGGGC-3' (FRAG. NO:2271) (SEQ. ID NO:2284)

5'-GTCTCTCCCGCCCCGGCCGCGCG-3' (FRAG. NO:2272) (SEQ. ID NO:2285)

5'-GGGCGTCCGCTCCGGGCCGTCGGG-3' (FRAG. NO:2273) (SEQ. ID NO:2286)

5'-GCGGGCACGCGGCGGCTCTGGCGTCGGC-3' (FRAG. NO:2274) (SEQ. ID NO:2287)

Bradykinin Receptor Nucleic Acids and
Antisense Oligonucleotide Fragments

```
5'-GGTGBCBTTG BGCBTGTCGG CGCGGTCCCG TTBBGBGTGG GCCCGCCAGC CCAGCCACTC CACTTGGGGG
CGGGTGGCCA GCACGAACAG CACCCAGAGG AAGGGGGGCG GCCCAGAAGG GCAGCCCGCA GGCCAGGATC
AGGTCTGCTG CGGCCGGAGA TAATGGCATT CACCACGCGG CGGCCCAGCG CACGCCGCGC ATCCGGCCCG
GGTTCTGACC TGCAGCCCCC GTCTCCTTGG CATTCCTGGG CCCCAGTCAC TCCTCTCCCT GCCCCCCTTG
CTGGGGCAGG GACGGGGTG BCBTTGBGCB TGTCGGCGCG GTCCCGTTBB GBGTGGGCCC GCCAGCCCAG
CCACTCCACT TGGGGCGGG TGGCCAGCAC GAACAGCACC CAGAGGAAGG GGGCGGCCC AGAAGGGCAG
CCCGCAGGCC AGGATCAGGT CTGCTGCGGC CGGAGATAAT GGCATTCACC ACGCGGCGGC CCAGCGCACG
CCGCGCATCC GGCCCGGGTT CTGACCTGCA GCCCCCGTCT CCTTGGCATT CCTGGGCCCC AGTCACTCCT
CTCCCTGCCC CCCTTGCTGG GGCAGGGACG GCCGTGTTGT CBGTGGTGCT GCCCGTTTGB GGTBTGGCGC
TCCBCCBBTT CCCTTTTCTC CTTGTTTTCC GTTTCTCTTG CCGTCTGTGG TT CAGATTCACA AACTGCAGGA
CTGGGCAGGG AGCAGACAGT GAGCAAACGC CAGCAGGGCT GCTGTGAATT TGTGTAAGGA TTGAGGGACA
GTTGCTTTTC AGCATGGGCC CAGGAATGCC AAGGAGACAT CTATGCACGA CCTTGGGAAA TGAGTTGATG
TCTCCGGTAA AACACCGGAG ACTAATTCCT GCCCTGCCCA ATTTTGCAGG GAGCATGGCT GTGAGGATGG
```

-continued

```
GGTGAACTCA CGCACAGCCA AGGACTCCAA AATCACAACA GCATTACTGT TCTTATTTGC TGCCACACCT
GAGCCAGCCT GCTCCTTCCC AGGAGTGGAG GAGGCCTGGG GGGAGGGAGA GGAGTGACTG AGCTTCCCTC
CCGTGTGTTC TCCGTCCCTG CCCCAGCAAG ACAACTTAGA TCTCCAGGAG AACTGCCATC CAGCTTTGGT
GCAATGGCTG AGTGCACAAG TGAGTTGTTG CCCTGGGTTT CTTTAATCTA TTCAGCTAGA ACTTTGAAGG
ACAATTTCTT GCATTAATAA AGGTTAAGCC CTGAGGGGTC CCTGATAACA ACCTGGGGAC CAGGATTTTA
TGGCTCCCCT CACTGATGGA CAAGGAGGTC TGTGCCAAAG AAGAATCCAA TAAGCACATA TTGAGCACTT
GCTGTATATG CAGTATTGAG CACTGTAGGC AAGACCCAAG AAAGAGAAGG AGCCATCTCC ATCTTGAAGG
AACTCAAAGA CTCAAGTGGG AACGACTGGG CACTGCCACC ACCAGAAAGC TGTTCGACGA GACGGTCGAG
CAGGGTGCTG TGGCTGATAT GGACAGCAGA AGGGGGAGAC CAAGGTTCCA GCTCAACCAA TAACTATTGC
ACAACCACCT GTCCCTGCCT CAGTTCCCTT TTATGTAACA TGAAGTCGTT GTGAGGGTTA AAGGCAGTAA
CAGGTATAAA GTACTTAGAA AAGCAAAGGG TGCTACGTAC ATGTGAGGCA TCATTACGCA GACGTAACTG
GGATATGTTT ACTATAAGGA AAAGACACTG AGGTCTAGAA ATAGCTCCGT GGAGCAGAAT CAGTATTGGG
AGCCGGTGGC GGTGTGAAGC ACCAGTGTCT GGCACACAGT AGGTGCTCAT TGGCTCCCTT CCACCTGTCA
TTCCCACCAC CCTGAGGCCC CAACCGCCAC ACACACAGGA GCATTTGGAG AGAAGGCCAT GTCTTCAAAG
TCTGATTTGT GATGAGGCAG AGGAAGATAT TTCTAATCGG TCTTGCCCAG AGGATCACAG TGCTGAGACC
CCCCACCACC AGCCGGTACC TGGGAAGGGG GAGAGTGCAG GCCTGCTCAG GGACTGTTCC TGTCTCAGCA
ACCAAGGGAT TGTTCCTGTC AATCAATGGT TTATTGGAAG GTGGCCCAGT ATGAGCCCTA GAAGAGTGTG
AAAAGGAATG GCAATGGTGT TCACCATCGG CAGTGCCAGG GCAGCACTCA TTCACTTGAT AAATGAATAT
TTATTAGCTG GTTGGAGAGC TAGAACCTGG AGAGCTAGAA CCTGGAGAAC TAGAACCTGG AGGGCTAGAA
CCTGGAGAGG CTAGAACCAA GAAGGGCTAG AACCTGGAGG GGCTAGAACC TAGAGAAGCT AAAACCTGAG
CTAGAAGCTG GAGGACTAGA ACCTGGAGGG CTGGAATCTG AAGGGCTAGA ACCTGGAGGG CTGGAATCTG
GAGAGCTAGA ACCTGGAGGG CTAGAACCTG GAGGGCTAGA ACCTAGAAGG GCTAGAACCT GGAGGGCTGG
AATCTGGAGA GCTAGAACCT GGAGGGCTAG AACCTGGAGG GCTAGAACCT GAAGGGCTA GAACCTGGAG
GGCTAGAACC TGGCAGGTTA GAACCTAGAA GGGCTAGAAC CTGGAGAGCC AGAACCTGGA GGGCTAGAAC
CTGGAAGGGC TAGAACCTGT AGAGCTAGAA CATGGAGAGC TAGAACCCGG CAGGCTAGAA CCTGGCAAGC
TAGAACCTGG AGGGAATGAA CCTGGAGGGC TAGAACCTGG AGAATGAGAA AAATTTACAT GGCAAAGAGC
CCATAAATCC TGACCAATCC AACTCTGAAT TTTAAAGCAA AAGCGTGAAA AAAAAGATTC CCTCCTTACC
CCCAACCCAC TCTTTTTTCC CACCACCCAC TCTCCTCTGC CTCAGTAAGT ATCTGGAGGA AGAAAACAGG
TGAAAGAAGA AGTAAAAACC ATTTAGTATT AGTATTAGAA TGAAGTCAAA CTGTGCCACA CATGGTGAAT
GAAAAAAAAA AAAAAGAGGC TGTGTTTTGT CACACAGGGC AGTCATTCAG CACCAGAGCA CGTGATGGTC
TGAGACTCTC TTAGGAGCAG AGCTCTGCCG CAATGGCCAT GTGGGATCC ACACCTGGTC TGAGGGCAA
CTGAGTCTGC GGGAGAAGAG CGGCCCTATG CATGGTGTAG ATGCCCTGAT AAAGAACATC TGTCCTGTGA
AAGACTCAAT GAGCTGTTAT GTTGTAAACA GGAAGCATTT CACATCCAAA CGAGAAAATC ATGTAAACAT
GTGTCTTTTC TGTAGAGCAT AATAAATGGA TGAGGTTTTT GCAAAAAAAA AAAAAAAAA AAATGATAGA
CCGTCAATAA TTTGTTAAAT GCTTTTTAAA ATGAATGCTT TAAGCCGGGT GCAGTGCCTC ACATCTGTAA
TCCCAGCACT TTGGAGCCGA GCGGGTGGAT TGTGTGAGGT CAGGAGTTCG AGACCAACCT GGCCAACATG
GCAAAACCTC ACTCTCTACC AAAAATACAA AAATTAGCCA GGCATGGTGG CAGGCACCTG TGATCCCAGC
TACTCAGGAG GCTGAGACAG GAGAATCGCT TGAACCCGGG AGGCAAGGTT GCAGTGAGCC AAGATTACGC
CATTGTACTC CAGCCTGGGT GACAGAGAGA GACTCCGTCT CAAAAAAAAA AAAAAAAAA AAAAATTAC
```

```
GCTTCAAACA CATGATCTCT CACCACTGTT GAATTTTCTT TCTATGAGCC CAGGAGGGCC TCTCAGAGAG
GAAAGCTCCT AGGTCTTCCT TTCCCTCTGC AAACTCCCTG CCTTGAAGGT TCAGAAGGAC TGTGCGTGCT
CGTTGCATCC TTTGCAAGTG TCCAAACCCT GATCCCAGCT GTGCTTAGGG GTTCCTGCAA ACCTTTTCCA
GGTGTTAATT ACCTCCCACT TCATTTCCTG TTTACCAACT CAGCTTTTTG TTTTAGTGTG TTTGAATTCC
CTGAACTGAC CGTTGTCTGA TCTCCACCTC CCAACTGAAT TAGGGGAGCT GGGCTTCTGG AAACCCAGGT
GCCGGGTGTT GCAGAGTGGC TGAAAGCTGG GATGTGGCAG ATCCGTGGCT ACATTCATGC ACACACACAC
ACCCACATAC CCACACATGC ACACACACAC ACACACCCGC ACTCACACAC TTGGACATGC ATAGACCACA
GCTTTCCACA CCCTTCCTAG ACAGGGGTCA CTTGGTATCC TGGAGAGAGT GTGAAGTCCT GGAATGGAAA
GAGGGGGGAT TAAGCCCCAC CTCTAGCCAT GGGACTGAGA CAAGTCACCA CCAACCCATC TGCGCCTTGT
TTACCTCCTC TGTGAGGCAA GCACAGAGCC CATGCCTGCC CCCCTGGATG GGAGTGATGT GAAACTTGAA
GGGCGGTCAG AGCAAGGGTC GGGAATGGAA GGCCCTTGGG AAAAAAGGCC CTTTCAACTA GGGGCACAGA
GGAGGCCCTG GGCTGAGAAC TTGACAGCAC CTTGTAATTG GTAAGCCAAG CCCGAAGGGA CTGGAAATAC
TCAGATGTGT CTGTCTCCCT TATTAGGTTC AAAGTCCCTC AAGACCCTGT CTCCATCACA GTGCTCCAGT
CCAGACCCCT CCTCTGAGCT CCAGACCCTG CTGGACCCAA CCAGCCCTAT GGGGTCGCAT CCCCACCTGC
CTGGAATTCT CCAAAGAACC TCCCCTTTAA CAGTTCCAGC CTTTAACAGT TCCAGTCTAA ACACATGACC
TTTCTCCTCT AAATCAGCCC CCCATCTCTG CCTTTGCAGG AGATGGAAGC CATGACACCT GCCTCGCCCC
TGTCCTCACC CCATCCATGT CCAATCAAGC ACTAGGCATG TCAGGTTTAC CCTCTAAACT CCTCTGGAAT
CCAGTCTCTC AGTCTCCATC ATCCCAGGTC GAAGCTAATG GGCTAACTGG TCCTTGCTTC CACTCTACCC
CCACTGCAGT CCTGACTTCC TGAGCAGCAG CCAGGGCCTA ATCGATATTC ACACCAAGCG CCAACCTGAC
TGAGATATCC TCCTGCACCA TCATCCCTCC ACCCTGTTTA GTTCTGCTCA CCCTCAGTGT TCTCATCAAT
AATCCACTCC CCTCACAGGC GCGTTTGGGA CCCCATGTTC TATGCTCTCA CAGGACCTTT TGCTTGATTT
TTCACTGTAC TTAGGTCAGT TTGCAGTTAT TAAGTGACTG AGCAATGTCT GGCTTCTCCA GTAGACTGTC
AGCTCCTAGC CATTGTATAC CTAGCACCGC TGTGTGGGAG CACGTGACAA ACGTCCAGTG AGTCAGGGAC
TCAGCAGTCT CCATTTCTCC GCCCTGCTGG AGAATGCGTG TATTTGGCAA TCCCCAGCCC CTGTGCCATC
TAACCATCTT TTCTTCTCTG TTCAGCCCAG GTGTGGCCTC ACTCACATCC CACTCTGAGT CCAAATGTTC
TCTCCCTGGA AGATATCAAT GTTTCTGTCT GTTCGTGAGG ACTCCGTGCC CACCACGGCC TCTTTCAGGT
GAGTCAAAGG GATTCCTCAG TTCACTAGTT AGGGGAGGTG GGCAGACACC CTGGAGAACT CCCTGGAAAG
CTCAACTCTC ATGCCCCGGA CAACAGTTGA AGGAACCATG GTGATGTTAA GCCCAAAGAC AAAACCTCTC
AGGTGTCCAA GTCCCTGTTG GAATCTTGGG AGCAGAGGGA ATGTTCTGTG GTCTAGAGGA AGAGGGCTC
AGGGAGGAGA AGGGCACATT CCTGGTTGTT ATATGTTTCT ATCTATCCCA GATGAACTTG GAAGTGAAGG
GAAGAGAGTT AAACATTAAA GTAAATACCC AGTGGATCAG ACAGCAATGT GCCAGATTGC CTTGGAAACA
AAATATCTCC AACACATGGC TGACATTTGG TGGGAGATCA GAACACCCTA AAGAGAGAAT TTAAGGGGAG
GGGGAGGAGG ACCTGAGCCA GAGTAGAAGC AGAGGATAGG GAGATCTGTT CTTGGGGACA GCATTTGCAA
GAAACAAGGC TGAGGGGTCC ACTCCAACCT CTCCACCCTG CTGCAGGTGC TGCCTATGAT GAAGATGAGC
AGATGGCCAT CTCAGCTGGG GCCACAGTGC ACTGGACCTA TAGTTTCCAA TTCCGCACTC AGCAGGCATC
TTTCTGATGA TCCGATGGCT TCTCAGAGCC AGGGATGGGC CAGGATCCAT CCCCTTGGCT ACTGTCTTGC
TGAGAAATTT ATAAGCAGCA TCTGGTGCTA TACTTTGGTC TCTAGTGAGT TAGCTCATGA AAGATGATAG
ACTCTCCAAG CCAGGGGTAT GCAGGAAATG GGTTTTCTGT AGCTACAGAA ATGGGGTTGA GGGTTGGACC
AAGGGACTAC CCAGGGGAAG TCTTACCTTC AGAGGACTCT GGAAAGGAGG CTGCAAGTTT TCATGGGTCA
AGAATTCAGA GCCCAGTAGA GACAGCTTAT CTCTGTTCCA AGATGTCTGG GGCCTTGGTT GGAAGATTCA
```

-continued

```
AAGGCTAGGA AACCAGGAGC CACCAAAAGC GTAACTGGGG CCAGAGGATC CACTTTCAAG GTGGCAAGTT

GGTTCCCCCC ATGTGGCTGC TTGAGTATCC TCACATGGCG GCTCACATCC TTCCAAGTAA GCAATGCAAA

AGGCCAAGAA AGATGCTGCA AAGATGTTAT GACCTAGCCT CAGAAATCAC ACACCATCCC TGCCACCATT

AGTAAGAAGT CCAGCCCACG TCCAGGAGAA GAGGAAGCAG ATTCCTCCTT TTGAAATGAA GAATATCAAG

TAATTCGGGG GGCATATGAA AGCCACCACA CACCACAGGG ATCTTTTTAG AGCATACTTC TTATACCATC

ACTGTAGTTC CTTAAGACTC AGGGGCAAAG CCTCACTTCC TTAGCACCCA GTGAAGACCA CGCTTACTCC

CTCACTCAAC CTCTTGCTAC TTCCCACCTC TCCTGTCCAA CATCTAGTGT CACTTTCCAG AACATACCAA

CAGCTTCCCC AGTTCTGTGC CTCTGCTCAG GCTGTTCCCC CTGCCTGGTC CACTTGTCCT CCTTCTTGTC

CGGTCAAAAT GCTTCTTATC CTTCAAGACC CAGCTCTAGA GTCACCTCCA ACCCCTTACC CACCAGCCCC

CTCTCCAAGT CTGTGTCCCA CAACCCCCCT GCTCCCTCCA GGGCACCCTC CACCCTCTGG GCCACAGTTG

TCAGGAGTCA GGCAGGGCAG GGGCCGGGTG GTGTCTTCTT TGTGTTCTTG CACTCAGGGC AGAGCTCAGC

ACAGAGCAGA CGCTCAAAAA ACATTTAAAG GATAGAAGCA TTGATTTGTG GGTCCCCCAG TCTGGCTCCA

GGATGCCAGC CAGCTGCTCC TAGAAGCAAA CGGACTTTTC CTGGGAAATC CCAGAGGTGA TGATCAGTAA

TCTCTCCCGT GACTCGTAGT TCAGCTCTTC CTCCATGAGC CTGACTATCA GTGGACCTTC CAGAAAGAGC

CCCTTTTCCT TCTCTCACCC ACAGCACAGG GCACTGGGAA AATGCCCAAT GAGTCCTGCC TCTGGGTTGT

GCTTTGGACT TTTCAGTGTG TCTCGCATCC ACTCTTCAAC TTGAATGTTG CAACAGCCAT GAAAAAGAA

ATGCAAAGCG ATTCAGGATG AGAGCAATAC CCTACTCCAA AGAAGCAAC ATAGAAGCTC AGAGAGATCA

AGCAATTTGC CCAAGACCAC ACAGCTAGGA GTGGAACTCA TGGCTGTCCA AGCCCCATGC CTCTGCTGAA

GGTAGAGATG AATTACAGCA ACAAGTCTAG AAAGGTGCCT GCCCTATGGT CTGTGAGTCT TGCCTAAGAA

TGAAAGAGGA GCCAGTGGGT TAAAGATGAG GTCACCAACA ACGGTGGTGT TGGAGTTTAC CACTGATAAT

AAGGGTGCAA AATGTAAATT ACTAATGTTT ATTGAGCCTA GTGCAGTGCG TGGGGCATTT TGCACATTGT

CTCTGATCCC TATGACAACC CTGAGAGGTA GTGGTTTTAA CTGCCATGTT ACAGGTGAGG TCATTGTGGT

TCAAGGACGT TAAGTAACTT CCCCAGCGTG ACACGGCTTA TAAGTAAGGC AGCCAGGATG TGAACCCAGT

AGGACTATCT GGCTGCAAAG TCCCCACCCC CCTCGCCATC TGTATCCTCC AATCACTTCA GTGCTTTGCT

GCATAGAAGG TAACGGAAAT CACGATGCCA CAGACTGTCC AGGAAGACAG AAACTAGGCA GATGGGCTGG

CCATGGTCTC CAAGCCAGAC TGGAATCTCC AGGTCTGGAA TGATATCATT TTTCTCTTTT AATAAATTAA

CTCACCCACC ACACGGCTTT GAGAGGCTCA AAGTTGACCA ACTCCCTTGG GAGGGCCCCG GTTGATAAGG

AAGGAACGTG AATCCTCCCA TCACGGAAGC TTCAAGGAGG TCAAGGGTCC AACACTTGAG ATTGTTAGTG

CTGTTGGTGG ATACTGGCCA AGGAAATATC CCAGTGGAGC CTCGAGATGA AGAACATGAG GCCCCCGTTT

AGAACCAAGG ATCAGAGGGG GCTCTGTAAG ACCCAGGGGA GTCAGGTGCA CTGGAGCGCG GGCATGCAGA

AAACAGCCTG AGCTCCACCT CGGCTTCTCC TTGTCCTGGC TGGTTGTCCT TAACCCCTGT CTCCTTCTGG

ACCAGTTTTT GTCCTTCCCT TGTGACCGCT GAGGGGTAAC AGCCTCTTTC CACTTTCTTT CAGCGCCGAC

ATGCTCAATG TCACCTTGCA AGGGCCCACT CTTAACGGGA CCTTTGCCCA GAGCAAATGC CCCCAAGTGG

AGTGGCTGGG CTGGCTCAAC ACCATCCAGC CCCCCTTCCT CTGGGTGCTG TTCGTGCTGG CCACCCTAGA

GAACATCTTT GTCCTCAGCG TCTTCTGCCT GCACAAGAGC AGCTGCACGG TGGCAGAGAT CTACCTGGGG

AACCTGGCCG CAGCAGACCT GATCCTGGCC TGCGGGCTGC CCTTCTGGGC CATCACCATC TCCAACAACT

TCGACTGGCT CTTTGGGGAG ACGCTCTGCC GCGTGGTGAA TGCCATTATC TCCATGAACC TGTACAGCAG

CATCTGTTTC CTGATGCTGG TGAGCATCGA CCGCTACCTG GCCCTGGTGA AAACCATGTC CATGGGCCGG

ATGCGCGGCG TGCGCTGGGC CAAGCTCTAC AGCTTGGTGA TCTGGGGGTG TACGCTGCTC CTGAGCTCAC
```

-continued

```
CCATGCTGGT GTTCCGGACC ATGAAGGAGT ACAGCGATGA GGGCCACAAC GTCACCGCTT GTGTCATCAG
CTACCCATCC CTCATCTGGG AAGTGTTCAC CAACATGCTC CTGAATGTCG TGGGCTTCCT GCTGCCCCTG
AGTGTCATCA CCTTCTGCAC GATGCAGATC ATGCAGGTGC TGCGGAACAA CGAGATGCAG AAGTTCAAGG
AGATCCAGAC GGAGAGGAGG GCCACGGTGC TAGTCCTGGT TGTGCTGCTG CTATTCATCA TCTGCTGGCT
GCCCTTCCAG ATCAGCACCT TCCTGGATAC GCTGCATCGC CTCGGCATCC TCTCCAGCTG CCAGGACGAG
CGCATCATCG ATGTAATCAC ACAGATCGCC TCCTTCATGG CCTACAGCAA CAGCTGCCTC AACCCACTGG
TGTACGTGAT CGTGGGCAAG CGCTTCCGAA AGAAGTCTTG GGAGGTGTAC CAGGGAGTGT GCCAGAAAGG
GGGCTGCAGG TCAGAACCCA TTCAGATGGA GAACTCCATG GGCACACTGC GGACCTCCAT CTCCGTGGAA
CGCCAGATTC ACAAACTGCA GGACTGGGCA GGGAGCAGAC AGTGAGCAAA CGCCAGCAGG GCTGCTGTGA
ATTTGTGTAA GGATTGAGGG ACAGTTGCTT TTCAGCATGG GCCCAGGAAT GCCAAGGAGA CATCTATGCA
CGACCTTGGG AAATGAGTTG ATGTCTCCGG TAAAACACCG GAGACTAATT CCTGCCCTGC CAATTTTGC
AGGGAGCATG GCTGTGAGGA TGGGGTGAAC TCACGCACAG CCAAGGACTC CAAAATCACA ACAGCATTAC
TGTTCTTATT TGCTGCCACA CCTGAGCCAG CCTGCTCCTT CCCAGGAGTG GAGGAGGCCT GGGGGCAGGG
AGAGGAGTGA CTGAGCTTCC CTCCCGTGTG TTCTCCGTCC CTGCCCCAGC AAGACAACTT AGATCTCCAG
GAGAACTGCC ATCCAGCTTT GGTGCAATGG CTGAGTGCAC AAGTGAGTTG TTGCCCTGGG TTTCTTTAAT
CTATTCAGCT AGAACTTTGA AGGACAATTT CTTGCATTAA TAAAGGTTAA GCCCTGAGGG GTCCCTGATA
ACAACCTGGA GACCAGGATT TTATGGCTCC CCTCACTGAT GGACAAGGAG GTCTGTGCCA AGAAGAATC
CAATAAGCAC ATATTGAGCA CTTGCTGTAT ATGCAGTATT GAGCACTGTA GGCAAGAGGG AAGAAAGAGA
AGGAGCCATC TCCATCTTGA AGGAACTCAA AGACTCAAGT GGGAACGACT GGGCACTGCC ACCACCAGAA
AGCTGTTCGA TGAGACGGTC GAGCAGGGTG CTGTGGGTGA TATGGACAGC AGAAGGGGGA GCCAGGTTCC
AGCTCACCAA TACTATTGCA CACCACCTGT CCTGCCTC GCCCTTCAAA GATGAGCTGT TCCCGCCGCC
ACTCCAGCTC TGGCTTCTGG GCTCCGAGGA GGGGTGGGGA CGGTGGTGAC GGTGGGGACA TCAGGCTGCC
CCGCAGTACC AGGGAGCGAC TGAAGTGCCC ATGCCGCTTG CTCCGGAGAA GGTGGGTGCC GGGCAGGGGC
TGCTCCAGCC GCCTCACCTC TGCTGGGAGG ACAAACTGTC CCAGCACAGA GGGAGGGAGG GAGGGCAGGC
AGCGGGGAGA AGTTTCCCTG TGGTCGTGGG GAGTT GAGCTCTTCA ATATTTAGT GAAAGCTATA GATGAGGCTC
CATAGGGGAT AAAGCACAGA CACACCTTTT CAGAGGGCTT GTGGACTCTG GCAGCCTGT CCATAGACCT
CTGTCCCCAA CTGGCAAGTC AGGAAACTCC AGATTAAGGA GCCCCAATGT GGTTGAACAG CCAGGTGCAC
AGATGAGTCA ACCACACAGC CAGGCCAGGG AGGGCCTTCA CTCAAGAGCC TACAGCCAGT TCACAGCCAA
GCCAGGGCTA GCGCCAGGCC ACCCATAAAC TGATCTGAGA CTCTGTTTCC CTGTCTCCAT GATGATGGGA
TCAGGCTTGA TTGCTGGTTT GTAGGCTTGT TATGAATCAA GTCACAGGGA AGAGGAGCTG ATGGGCTGGG
GGGACGTCCT CTGGCCCTCC TGTCTCTTCC CCAGATCCAC TGGGCCCACT CTTATCTGTT CTCTTCTGAA
GGAAGGGTTT TAAGGCTTCA AAAAAAAATG TTTTGAAAGT CCCTGCCCTT TCCAGCTCCT ACCGTCTCAG
CCCTGGGAGT GTAAAGTGCT GCAGATAGTT AGTAAGTCTT TGAGCAAAAC TGAGAAAGCC AGCCTGAGCC
TTGACATGGG AGAAACCTCC GCCATACATC TCCGAAGAAA CGGCCGCGTG TCTCAGGGGA GCGCAAACAC
CCGTACCCAG GAAACAGGAC AGCTTCTGCC ACTGTCGCCC TTGGGAGCCG TACGTGGCAT GACAAAGAAA
TCCCAGGACT CCGCCTGCCC ACCTGGCCAC CCTCTGTTTA CACCTTCCGC GTAAACGCCC ACTGTTTACA
TCCAAAACTC AGACACAAAA TAACCACCTC AAGAAGATAA ATAATGATAA GAAATAAATG TTACGCGAGG
CAAATTTATT CACATGGGGC TTCCCAGGCC ACTTTGTGGT CAGCCGGGAG GGACGTTTTT GCCGTCCCAC
GACTCCAACG GGCAGCCGGG CCTACGCAAA CATGGAAATC TTCCAAGAGC CTCCCTGCCC CCCAGGGCTC
AGAGGGTGGC AGAGCGGAGA GCGAAGGTGG CCGCAGCCTT CCCGGCCCCA CAGCCAGCCT GGCTCCAGCT
```

-continued

```
GGGCAGGAGT GCAGAGCTCA GCTGGAGGCG AGGGGGAAGT GCCCAGGAGG CTGATGACAT CACTACCCAG

CCCTTCAAAG ATGAGCTGTT CCCGCCGCCA CTCCAGCTCT GGCTTCTGGG CTCCGAGGAG GGGTGGGGAC

GGTGGTGACG GTGGGGACAT CAGGCTGCCC CGCAGTACCA GGGAGCGACT GAAGTGCCCA TGCCGCTTGC

TCCGGAGAAG GTGGGTGCCG GGCAGGGGCT GCTCCAGCCG CCTCACCTCT GCTGGGAGGA CAAACTGTCC

CAGCACAGAG GGAGGGAGGG AGGGCAGGCA GCGGGGAGAA GTTTCCCTGT GGTCGTGGGG AGTTGGGAAA

AGTTCCCTTC CTTCCGGAGG GAGG CAGATTCACA AACTGCAGGA CTGGGCAGGG AGCAGACAGT GAGCAAACGC

CAGCAGGGCT GCTGTGAATT TGTGTAAGGA TTGAGGGACA GTTGCTTTTC AGCATGGGCC CAGGAATGCC

AAGGAGACAT CTATGCACGA CCTTGGGAAA TGAGTTGATG TCTCCGGTAA ACACCGGAG ACTAATTCCT

GCCCTGCCCA ATTTTGCAGG GAGCATGGCT GTGAGGATGG GGTGAACTCA CGCACAGCCA AGGACTCCAA

AATCACAACA GCATTACTGT TCTTATTTGC TGCCACACCT GAGCCAGCCT GCTCCTTCCC AGGAGTGGAG

GAGGCCTGGG GGGAGGGAGA GGAGTGACTG AGCTTCCCTC CCGTGTGTTC TCCGTCCCTG CCCCAGCAAG

ACAACTTAGA TCTCCAGGAG AACTGCCATC CAGCTTTGGT GCAATGGCTG AGTGCACAAG TGAGTTGTTG

CCCTGGGTTT CTTTAATCTA TTCAGCTAGA ACTTTGAAGG ACAATTTCTT GCATTAATAA AGGTTAAGCC

CTGAGGGGTC CCTGATAACA ACCTGGAGAC CAGGATTTTA TGGCTCCCCT CACTGATGGA CAAGGAGGTC

TGTGCCAAAG AAGAATCCAA TAAGCACATA TTGAGCACTT GCTGTATATG CAGTATTGAG CACTGTAGGC

AAGACCCAAG AAAGAGAAGG AGCCATCTCC ATCTTGAAGG AACTCAAAGA CTCAAGTGGG AACGACTGGG

CACTGCCACC ACCAGAAAGC TGTTCGACGA GACGGTCGAG CAGGGTGCTG TGGGTGATAT GGACAGCAGA

AGGGGGAGAC CAAGGTTCCA GCTCAACCAA TAACTATTGC ACAACCACCT GTCCCTGCCT CAGTTCCCTT

TTATGTAACA TGAAGTCGTT GTGAGGGTTA AAGGCAGTAA CAGGTATAAA GTACTTAGAA AAGCAAAGGG

TGCTACGTAC ATGTGAGGCA TCATTACGCA GACGTAACTG GGATATGTTT ACTATAAGGA AAAGACACTG

AGGTCTAGAA ATAGCTCCGT GGAGCAGAAT CAGTATTGGG AGCCGGTGGC GGTGTGAAGC ACCAGTGTCT

GGCACACAGT AGGTGCTCAT TGGCTCCCTT CCACCTGTCA TTCCCACCAC CCTGAGGCCC CAACCGCCAC

ACACACAGGA GCATTTGGAG AGAAGGCCAT GTCTTCAAAG TCTGATTTGT GATGAGGCAG AGGAAGATAT

TTCTAATCGG TCTTGCCCAG AGGATCACAG TGCTGAGACC CCCCACCACC AGCCGGTACC TGGGAAGGGG

GAGAGTGCAG GCCTGCTCAG GGACTGTTCC TGTCTCAGCA ACCAAGGGAT TGTTCCTGTC AATCAATGGT

TTATTGGAAG GTGGCCCAGT ATGAGCCCTA GAAGAGTGTG AAAAGGAATG GCAATGGTGT TCACCATCGG

CAGTGCCAGG GCAGCACTCA TTCACTTGAT AAATGAATAT TTATTAGCTG GTTGGAGAGC TAGAACCTGG

AGAGCTAGAA CCTGGAGAAC TAGAACCTGG AGGGCTAGAA CCTGGAGAGG CTAGAACCAA GAAGGGCTAG

AACCTGGAGG GGCTAGAACC TAGAGAAGCT AAAACCTGAG CTAGAAGCTG GAGGACTAGA ACCTGGAGGG

CTGGAATCTG AAGGGCTAGA ACCTGGAGGG CTGGAATCTG GAGAGCTAGA ACCTGGAGGG CTAGAACCTG

GAGGGCTAGA ACCTAGAAGG GCTAGAACCT GGAGGGCTGG AATCTGGAGA GCTAGAACCT GGAGGGCTAG

AACCTGGAGG GCTAGAACCT AGAAGGGCTA GAACCTGGAG GCTAGAACC TGGCAGGTTA GAACCTAGAA

GGGCTAGAAC CTGGAGAGCC AGAACCTGGA GGGCTAGAAC CTGGAAGGGC TAGAACCTGT AGAGCTAGAA

CATGGAGAGC TAGAACCCGG CAGGCTAGAA CCTGGCAAGC TAGAACCTGG AGGGAATGAA CCTGGAGGGC

TAGAACCTGG AGAATGAGAA AAATTTACAT GGCAAAGAGC CCATAAATCC TGACCAATCC AACTCTGAAT

TTTAAAGCAA AAGCGTGAAA AAAAAGATTC CCTCCTTACC CCCAACCCAC TCTTTTTTCC CACCACCCAC

TCTCCTCTGC CTCAGTAAGT ATCTGGAGGA AGAAACAGG TGAAAGAAGA AGTAAAAACC ATTTAGTATT

AGTATTAGAA TGAAGTCAAA CTGTGCCACA CATGGTGAAT GAAAAAAAAA AAAAAGAGGC TGTGTTTTGT

CACACAGGGC AGTCATTCAG CACCAGAGCA CGTGATGGTC TGAGACTCTC TTAGGAGCAG AGCTCTGCCG
```

```
CAATGGCCAT GTGGGATCC ACACCTGGTC TGAGGGGCAA CTGAGTCTGC GGGAGAAGAG CGGCCCTATG
CATGGTGTAG ATGCCCTGAT AAAGAACATC TGTCCTGTGA AAGACTCAAT GAGCTGTTAT GTTGTAAACA
GGAAGCATTT CACATCCAAA CGAGAAAATC ATGTAAACAT GTGTCTTTTC TGTAGAGCAT AATAAATGGA
TGAGGTTTTT GCAAAAAAAA AAAAAAAAA AAATGATAGA CCGTCAATAA TTTGTTAAAT GCTTTTTAAA
ATGAATGCTT TAAGCCGGGT GCAGTGCCTC ACATCTGTAA TCCCAGCACT TTGGAGCCGA GCGGGTGGAT
TGTGTGAGGT CAGGAGTTCG AGACCAACCT GGCCAACATG GCAAAACCTC ACTCTCTACC AAAAATACAA
AAATTAGCCA GGCATGGTGG CAGGCACCTG TGATCCCAGC TACTCAGGAG GCTGAGACAG GAGAATCGCT
TGAACCCGGG AGGCAAGGTT GCAGTGAGCC AAGATTACGC CATTGTACTC CAGCCTGGGT GACAGAGAGA
GACTCCGTCT CAAAAAAAAA AAAAAAAAAA AAAAATTAC GCTTCAAACA CATGATCTCT CACCACTGTT
GAATTTTCTT TCTATGAGCC CAGGAGGGCC TCTCAGAGAG GAAAGCTCCT AGGTCTTCCT TTCCCTCTGC
AAACTCCCTG CCTTGAAGGT TCAGAAGGAC TGTGCGTGCT CGTTGCATCC TTTGCAAGTG TCCAAACCCT
GATCCCAGCT GTGCTTAGGG GTTCCTGCAA ACCTTTTCCA GGTGTTAATT ACCTCCCACT TCATTTCCTG
TTTACCAACT CAGCTTTTTG TTTTAGTGTG TTTGAATTCC CTGAACTGAC CGTTGTCTGA TCTCCACCTC
CCAACTGAAT TAGGGGAGCT GGGCTTCTGG AAACCCAGGT GCCGGGTGTT GCAGAGTGGC TGAAAGCTGG
GATGTGGCAG ATCCGTGGCT ACATTCATGC ACACACACAC ACCCACATAC CCACACATGC ACACACACAC
ACACACCCGC ACTCACACAC TTGGACATGC ATAGACCACA GCTTTCCACA CCCTTCCTAG ACAGGGGTCA
CTTGGTATCC TGGAGAGAGT GTGAAGTCCT GGAATGGAAA GAGGGGGAT TAAGCCCCAC CTCTAGCCAT
GGGACTGAGA CAAGTCACCA CCAACCCATC TGCGCCTTGT TTACCTCCTC TGTGAGGCAA GCACAGAGCC
CATGCCTGCC CCCCTGGATG GGAGTGATGT GAAACTTGAA GGGCGGTCAG AGCAAGGGTC GGGAATGGAA
GGCCCTTGGG AAAAAAGGCC CTTTCAACTA GGGGCACAGA GGAGGCCCTG GCTGAGAAC TTGACAGCAC
CTTGTAATTG GTAAGCCAAG CCCGAAGGGA CTGGAAATAC TCAGATGTGT CTGTCTCCCT TATTAGGTTC
AAAGTCCCTC AAGACCCTGT CTCCATCACA GTGCTCCAGT CCAGACCCCT CCTCTGAGCT CCAGACCCTG
CTGGACCCAA CCAGCCCTAT GGGGTCGCAT CCCCACCTGC CTGGAATTCT CCAAAGAACC TCCCCTTTAA
CAGTTCCAGC CTTTAACAGT TCCAGTCTAA CACATGACC TTTCTCCTCT AAATCAGCCC CCCATCTCTG
CCTTTGCAGG AGATGGAAGC CATGACACCT GCCTCGCCCC TGTCCTCACC CCATCCATGT CCAATCAAGC
ACTAGGCATG TCAGGTTTAC CCTCTAAACT CCTCTGGAAT CCAGTCTCTC AGTCTCCATC ATCCCAGGTC
GAAGCTAATG GGCTAACTGG TCCTTGCTTC CACTCTACCC CCACTGCAGT CCTGACTTCC TGAGCAGCAG
CCAGGGCCTA ATCGATATTC ACACCAAGCG CCAACCTGAC TGAGATATCC TCCTGCACCA TCATCCCTCC
ACCCTGTTTA GTTCTGCTCA CCCTCAGTGT TCTCATCAAT AATCCACTCC CCTCACAGGC GCGTTTGGGA
CCCCATGTTC TATGCTCTCA CAGGACCTTT TGCTTGATTT TTCACTGTAC TTAGGTCAGT TTGCAGTTAT
TAAGTGACTG AGCAATGTCT GGCTTCTCCA GTAGACTGTC AGCTCCTAGC CATTGTATAC CTAGCACCGC
TGTGTGGGAG CACGTGACAA ACGTCCAGTG AGTCAGGGAC TCAGCAGTCT CCATTTCTCC GCCCTGCTGG
AGAATGCGTG TATTTGGCAA TCCCCAGCCC CTGTGCCATC TAACCATCTT TTCTTCTCTG TTCAGCCCAG
GTGTGGCCTC ACTCACATCC CACTCTGAGT CCAAATGTTC TCTCCCTGGA AGATATCAAT GTTTCTGTCT
GTTCGTGAGG ACTCCGTGCC CACCACGGCC TCTTTCAGGT GAGTCAAAGG GATTCCTCAG TTCACTAGTT
AGGGGAGGTG GGCAGACACC CTGGAGAACT CCCTGGAAAG CTCAACTCTC ATGCCCCGGA CAACAGTTGA
AGGAACCATG GTGATGTTAA GCCCAAAGAC AAAACCTCTC AGGTGTCCAA GTCCCTGTTG GAATCTTGGG
AGCAGAGGGA ATGTTCTGTG GTCTAGAGGA AGAGGGCTC AGGGAGGAGA AGGGCACATT CCTGGTTGTT
ATATGTTTCT ATCTATCCCA GATGAACTTG GAAGTGAAGG GAAGAGAGTT AAACATTAAA GTAAATACCC
AGTGGATCAG ACAGCAATGT GCCAGATTGC CTTGGAAACA AAATATCTCC AACACATGGC TGACATTTGG
```

```
TGGGAGATCA GAACACCCTA AAGAGAGAAT TTAAGGGGAG GGGGAGGAGG ACCTGAGCCA GAGTAGAAGC

AGAGGATAGG GAGATCTGTT CTTGGGGACA GCATTTGCAA GAAACAAGGC TGAGGGGTCC ACTCCAACCT

CTCCACCCTG CTGCAGGTGC TGCCTATGAT GAAGATGAGC AGATGGCCAT CTCAGCTGGG GCCACAGTGC

ACTGGACCTA TAGTTTCCAA TTCCGCACTC AGCAGGCATC TTTCTGATGA TCCGATGGCT TCTCAGAGCC

AGGGATGGGC CAGGATCCAT CCCCTTGGCT ACTGTCTTGC TGAGAAATTT ATAAGCAGCA TCTGGTGCTA

TACTTTGGTC TCTAGTGAGT TAGCTCATGA AAGATGATAG ACTCTCCAAG CCAGGGGTAT GCAGGAAATG

GGTTTTCTGT AGCTACAGAA ATGGGGTTGA GGGTTGGACC AAGGGACTAC CCAGGGGAAG TCTTACCTTC

AGAGGACTCT GGAAAGGAGG CTGCAAGTTT TCATGGGTCA AGAATTCAGA GCCCAGTAGA GACAGCTTAT

CTCTGTTCCA AGATGTCTGG GGCCTTGGTT GGAAGATTCA AAGGCTAGGA AACCAGGAGC CACCAAAAGC

GTAACTGGGG CCAGAGGATC CACTTTCAAG GTGGCAAGTT GGTTCCCCCC ATGTGGCTGC TTGAGTATCC

TCACATGGCG GCTCACATCC TTCCAAGTAA GCAATGCAAA AGGCCAAGAA AGATGCTGCA AAGATGTTAT

GACCTAGCCT CAGAAATCAC ACACCATCCC TGCCACCATT AGTAAGAAGT CCAGCCCACG TCCAGGAGAA

GAGGAAGCAG ATTCCTCCTT TTGAAATGAA GAATATCAAG TAATTCGGGG GGCATATGAA AGCCACCACA

CACCACAGGG ATCTTTTTAG AGCATACTTC TTATACCATC ACTGTAGTTC CTTAAGACTC AGGGGCAAAG

CCTCACTTCC TTAGCACCCA GTGAAGACCA CGCTTACTCC CTCACTCAAC CTCTTGCTAC TTCCCACCTC

TCCTGTCCAA CATCTAGTGT CACTTTCCAG AACATACCAA CAGCTTCCCC AGTTCTGTGC CTCTGCTCAG

GCTGTTCCCC CTGCCTGGTC CACTTGTCCT CCTTCTTGTC CGGTCAAAAT GCTTCTTATC CTTCAAGACC

CAGCTCTAGA GTCACCTCCA ACCCCTTACC CACCAGCCCC CTCTCCAAGT CTGTGTCCCA CAACCCCCCT

GCTCCCTCCA GGGCACCCTC CACCCTCTGG GCCACAGTTG TCAGGAGTCA GGCAGGGCAG GGGCCGGGTG

GTGTCTTCTT TGTGTTCTTG CACTCAGGGC AGAGCTCAGC ACAGAGCAGA CGCTCAAAAA ACATTTAAAG

GATAGAAGCA TTGATTTGTG GGTCCCCCAG TCTGGCTCCA GGATGCCAGC CAGCTGCTCC TAGAAGCAAA

CGGACTTTTC CTGGGAAATC CCAGAGGTGA TGATCAGTAA TCTCTCCCGT GACTCGTAGT TCAGCTCTTC

CTCCATGAGC CTGACTATCA GTGGACCTTC CAGAAAGAGC CCCTTTTCCT TCTCTCACCC ACAGCACAGG

GCACTGGGAA AATGCCCAAT GAGTCCTGCC TCTGGGTTGT GCTTTGGACT TTTCAGTGTG TCTCGCATCC

ACTCTTCAAC TTGAATGTTG CAACAGCCAT GAAAAAAGAA ATGCAAAGCG ATTCAGGATG AGAGCAATAC

CCTACTCCAA AGAAGGCAAC ATAGAAGCTC AGAGAGATCA AGCAATTTGC CAAGACCAC ACAGCTAGGA

GTGGAACTCA TGGCTGTCCA AGCCCCATGC CTCTGCTGAA GGTAGAGATG AATTACAGCA ACAAGTCTAG

AAAGGTGCCT GCCCTATGGT CTGTGAGTCT TGCCTAAGAA TGAAAGAGGA GCCAGTGGGT TAAAGATGAG

GTCACCAACA ACGGTGGTGT TGGAGTTTAC CACTGATAAT AAGGGTGCAA AATGTAAATT ACTAATGTTT

ATTGAGCCTA GTGCAGTGCG TGGGGCATTT TGCACATTGT CTCTGATCCC TATGACAACC CTGAGAGGTA

GTGGTTTTAA CTGCCATGTT ACAGGTGAGG TCATTGTGGT TCAAGGACGT TAAGTAACTT CCCCAGCGTG

ACACGGCTTA TAAGTAAGGC AGCCAGGATG TGAACCCAGT AGGACTATCT GGCTGCAAAG TCCCCACCCC

CCTCGCCATC TGTATCCTCC AATCACTTCA GTGCTTTGCT GCATAGAAGG TAACGGAAAT CACGATGCCA

CAGACTGTCC AGGAAGACAG AAACTAGGCA GATGGGCTGG CCATGGTCTC AAGCCAGAC TGGAATCTCC

AGGTCTGGAA TGATATCATT TTTCTCTTTT AATAAATTAA CTCACCCACC ACACGGCTTT GAGAGGCTCA

AAGTTGACCA ACTCCCTTGG GAGGGCCCCG GTTGATAAGG AAGGAACGTG AATCCTCCCA TCACGGAAGC

TTCAAGGAGG TCAAGGGTCC AACACTTGAG ATTGTTAGTG CTGTTGGTGG ATACTGGCCA AGGAAATATC

CCAGTGGAGC CTCGAGATGA AGAACATGAG GCCCCCGTTT AGAACCAAGG ATCAGAGGGG GCTCTGTAAG

ACCCAGGGGA GTCAGGTGCA CTGGAGCGCG GGCATGCAGA AAACAGCCTG AGCTCCACCT CGGCTTCTCC
```

```
TTGTCCTGGC TGGTTGTCCT TAACCCCTGT CTCCTTCTGG ACCAGTTTTT GTCCTTCCCT TGTGACCGCT

GAGGGGTAAC AGCCTCTTTC CACTTTCTTT CAGCGCCGAC ATGCTCAATG TCACCTTGCA AGGGCCCACT

CTTAACGGGA CCTTTGCCCA GAGCAAATGC CCCCAAGTGG AGTGGCTGGG CTGGCTCAAC ACCATCCAGC

CCCCCTTCCT CTGGGTGCTG TTCGTGCTGG CCACCCTAGA GAACATCTTT GTCCTCAGCG TCTTCTGCCT

GCACAAGAGC AGCTGCACGG TGGCAGAGAT CTACCTGGGG AACCTGGCCG CAGCAGACCT GATCCTGGCC

TGCGGGCTGC CCTTCTGGGC CATCACCATC TCCAACAACT TCGACTGGCT CTTTGGGGAG ACGCTCTGCC

GCGTGGTGAA TGCCATTATC TCCATGAACC TGTACAGCAG CATCTGTTTC CTGATGCTGG TGAGCATCGA

CCGCTACCTG GCCCTGGTGA AAACCATGTC CATGGGCCGG ATGCGCGGCG TGCGCTGGGC CAAGCTCTAC

AGCTTGGTGA TCTGGGGGTG TACGCTGCTC CTGAGCTCAC CCATGCTGGT GTTCCGGACC ATGAAGGAGT

ACAGCGATGA GGGCCACAAC GTCACCGCTT GTGTCATCAG CTACCCATCC CTCATCTGGG AAGTGTTCAC

CAACATGCTC CTGAATGTCG TGGGCTTCCT GCTGCCCCTG AGTGTCATCA CCTTCTGCAC GATGCAGATC

ATGCAGGTGC TGCGGAACAA CGAGATGCAG AAGTTCAAGG AGATCCAGAC GGAGAGGAGG GCCACGGTGC

TAGTCCTGGT TGTGCTGCTG CTATTCATCA TCTGCTGGCT GCCCTTCCAG ATCAGCACCT TCCTGGATAC

GCTGCATCGC CTCGGCATCC TCTCCAGCTG CCAGGACGAG CGCATCATCG ATGTAATCAC ACAGATCGCC

TCCTTCATGG CCTACAGCAA CAGCTGCCTC AACCCACTGG TGTACGTGAT CGTGGGCAAG CGCTTCCGAA

AGAAGTCTTG GGAGGTGTAC CAGGGAGTGT GCCAGAAAGG GGGCTGCAGG TCAGAACCCA TTCAGATGGA

GAACTCCATG GGCACACTGC GGACCTCCAT CTCCGTGGAA CGCCAGATTC ACAAACTGCA GGACTGGGCA

GGGAGCAGAC AGTGAGCAAA CGCCAGCAGG GCTGCTGTGA ATTTGTGTAA GGATTGAGGG ACAGTTGCTT

TTCAGCATGG GCCCAGGAAT GCCAAGGAGA CATCTATGCA CGACCTTGGG AAATGAGTTG ATGTCTCCGG

TAAAACACCG GAGACTAATT CCTGCCCTGC CCAATTTTGC AGGGAGCATG GCTGTGAGGA TGGGGTGAAC

TCACGCACAG CCAAGGACTC CAAAATCACA ACAGCATTAC TGTTCTTATT GCTGCCACA CCTGAGCCAG

CCTGCTCCTT CCCAGGAGTG GAGGAGGCCT GGGGGCAGGG AGAGGAGTGA CTGAGCTTCC CTCCCGTGTG

TTCTCCGTCC CTGCCCCAGC AAGACAACTT AGATCTCCAG GAGAACTGCC ATCCAGCTTT GGTGCAATGG

CTGAGTGCAC AAGTGAGTTG TTGCCCTGGG TTTCTTTAAT CTATTCAGCT AGAACTTTGA AGGACAATTT

CTTGCATTAA TAAAGGTTAA GCCCTGAGGG GTCCCTGATA CAACCTGGA GACCAGGATT TTATGGCTCC

CCTCACTGAT GGACAAGGAG GTCTGTGCCA AGAAGAATC CAATAAGCAC ATATTGAGCA CTTGCTGTAT

ATGCAGTATT GAGCACTGTA GGCAAGAGGG AAGAAAGAGA AGGAGCCATC TCCATCTTGA AGGAACTCAA

AGACTCAAGT GGGAACGACT GGGCACTGCC ACCACCAGAA AGCTGTTCGA TGAGACGGTC GAGCAGGGTG

CTGTGGGTGA TATGGACAGC AGAAGGGGGA GCCAGGTTCC AGCTCACCAA TACTATTGCA CACCACCTGT

CCTGCCCTC CTGCAGAAAA CAGCCTGAGC TCCACCTCGG CTTCTCCTTG CCCTGGCTGG TTGTCCTTAA

CCCCTGTCTC CTTCTGGACC AGTTTTTGTC CTTCCCTTGT GACCCTGAGG GGTAACAGCC TCTTTTCCAC

TTTCTTTCAG CGCCGACATG CTCAATGTCA CCTTGCAAGG GCCCACTCTT AACGGGACCT TTGCCCAGAG

CAAATGCCCC CAAGTGGAGT GGCTGGGCTG GCTCAACACC ATCCAGCCCC CCTTCCTCTG GGTGCTGTTC

GTGCTGGCCA CCCTAGAGAA CATCTTTGTC CTCAGCGTCT TCTGCCTGCA CAAGAGCAGC TGCACGGTGG

CAGAGATCTA CCTGGGGAAC CTGGCCGCAG CAGACCTGAT CCTGGCCTGC GGGCTGCCCT TCTGGGCCAT

CACCATCTCC AACAACTTCG ACTGGCTCTT TGGGGAGACG CTCTGCCGCG TGGTGAATGC CATTATCTCC

ATGAACCTGT ACAGCAGCAT CTGTTTCCTG ATGCTGGTGA GCATCGACCG CTACCTGGCC CTGGTGAAAA

CCATGTCCAT GGGCCGGATG CGCGGCGTGC GCTGGGCCAA GCTCTACAGC TTGGTGATCT GGGGGTGTAC

GCTGCTCCTG AGCTCACCCA TGCTGGTGTT CCGGACCATG AAGGAGTACA GCGATGAGGG CCACAACGTC

ACCGCTTGTG TCATCAGCTA CCCATCCCTC ATCTGGGAAG TGTTCACCAA CATGCTCCTG AATGTCGTGG
```

```
GCTTCCTGCT GCCCCTGAGT GTCATCACCT TCTGCACGAT GCAGATCATG CAGGTGCTGC GGAACAACGA
GATGCAGAAG TTCAAGGAGA TCCAGACGGA GAGGAGGGCC ACGGTGCTAG TCCTGGTTGT GCTGCTGCTA
TTCATCATCT GCTGGCTGCC CTTCCAGATC AGCACCTTCC TGGATACGCT GCATCGCCTC GGCATCCTCT
CCAGCTGCCA GGACGAGCGC ATCATCGATG TAATCACACA GATCGCCTCC TTCATGGCCT ACAGCAACAG
CTGCCTCAAC CCACTGGTGT ACGTGATCGT GGGCAAGCGC TTCCGAAAGA AGTCTTGGGA GGTGTACCAG
GGAGTGTGCC AGAAAGGGGG CTGCAGGTCA GAACCCATTC AGATGGAGAA CTCCATGGGC ACACTGCGGA
CCTCCATCTC CGTGGAACGC CAGATTCACA AACTGCAGGA CTGGGCAGGG AGCAGACAGT GAGCAAACGC
CAGCAGGGCT GCTGTGAATT TGTGTAAGGA TTGAGGGACA GTTGCTTTTC AGCATGGGCC CAGGAATGCC
AAGGAGACAT CTATGCACGA CCTTGGGAAA TGAGTTGATG TCTCCGGTAA ACACCGGAG ACTAATTCCT
GNCCTGCCCA ATTTTGCAGG GAGCATGGCT GTGAGGATGG GGTGAACTCA CGCACAGCCA AGGACTCCAA
AATCACAACA GCATTACTGT TCTTATTTGC TGCCACACCT GAGCCAGCCT GCTCCTTCCC AGGAGTGGAG
GAGGCCTGGG GGCAGGGAGA GGAGTGACTG AGCTTCCCTC CCGTGTGTTC TCCGTCCCTG CCCCAGCAAG
ACAACTTAGA TCTCCAGGAG AACTGCCATC CAGCTTTGGT GCAATGGCTG AGTGCACAAG TGAGTTGTTG
CCCTGGGTTT CTTTAATCTA TTCAGCTAGA ACTTTGAAGG ACAATTTCTT GCATTAATAA AGGTTAAGCC
CTGAGGGGTC CCTGATAACA ACCTGGAGAC CAGGATTTTA TGGCTCCCCT CACTGATGGA CAAGGGAGGT
CTGTGCCAAA GAAGAATCCA ATAAGCACAT ATTGAGCACT TGCTGTATAT GCAGTATTGA GCACTGTAGG
CAAGAGGGAA GAAAGAGAAG GAGCCATCTC CATCTTGAAG GAACTCAAAG ACTCAAGTGG GAACGACTGG
CACTGCCACC ACCAGAAAGC TGTTCGACGA GACGGTCGAG CAGGGTGCTG TGGGTGATAT GGACAGCAGA
AGGGGGAGAC CAAGGTTCCA GCTCAACCAA TAACTATTGC ACAACCACCT GTCCCTGCCT CAGTTCCCTC
TTCTGTAACA TGAAGTCGTT GTGAGGGTTA AAGGCAGTAA CAGGTATAAA GTACTTAGAA AAGCAAAGGG
TGCTACGTAC ATGTGAGGCA TCATTACGCA GACGTAACTG GGATATGTTT ACTATAAGGA AAAGACACTG
AGGTCTAGA TGATCCTATC ACAACCTGAG AGTAGTTTTT ACTCCATTTA CAGGTGAGGT CATTGTGGTT
CAAGGACGTT AAGTAACTTC CCCAGCTCAC ACGGCTTATA AGTAAGGCAG CCAGGATGTG AACCCAGTAG
GACTATCTGG CTGCAAAGTC CCCACCCTCC CTCGCCATCT GTATCCTCCA ATCATCTTCA GTGCTTTGCT
GATAGAAGGT ACGGAAATAC GATGCCACAG ACTGTCCAGG AAGACAGAAA CTAGGCAGAT GGGCTGGCCA
TGGTCTCCAA GCCAGACTGG AATCTCCAGG TCTGGAATGA TATCATTTTT CTCTTTTAAT AAATTAACTC
ACCCACCACA CGGCTTTGAG AGGCTCAAAG GTGACCAACT CCCTTGGGAG GGCCCCGGTT GATAAGGAAG
GAATGTGAAT CCTCCCATCA CGGAAGCTTC AAGGAGGTCA AGGTCCAAC ACTTGAGATT GTTAGTGCTG
TTGGTGGATA CTGCAGAATA TCCAGTGGAG CCTCAGATGA AGAACATGAG GCCCGTTTA GATCCAAGGA
TCAGAGGGGG CTCTGTAAGA CCCAGGGGAG TCAGGTGCAC TGGAGCGCGG GCTGCAGAAA ACAGCCTGAG
CTCCACCTCG GCTTCTCCTT GCCCTGGCTG GTTGTCCTTA ACCCCTGTCT CCTTCTGGAC CAGTTTTTGT
CCTTCCCTTG TGACCTGAGG GGTAACAGCC TCTTTTCCAC TTTCTTTCAG CGCCGACATG CTCAATGTCA
CCTTGCAAGG GCCCACTCTT AACGGGACCT TTGCCCAGAG CAAATGCCCC CAAGTGGAGT GGCTGGGCTG
GCTCAACACC ATCCAGCCCC CCTTCCTCTG GGTGCTGTTC GTGCTGGCCA CCCTAGAGAA CATCTTTGTC
CTCAGCGTCT TCTGCCTGCA CAAGAGCAGC TGCACGGTGG CAGAGATCTA CCTGGGGAAC CTGGCCGCAG
CAGACCTGAT CCTGGCCTGC GGGCTGCCCT TCTGGGCCAT CACCATCTCC AACAACTTCG ACTGGCTCTT
TGGGGAGACG CTCTGCCGCG TGGTGAATGC CATTATCTCC ATGAACCTGT ACAGCAGCAT CTGTTTCCTG
ATGCTGGTGA GCATCGACCG CTACCTGGCC CTGGTGAAAA CCATGTCCAT GGGCCGGATG CGCGGCGTGC
GCTGGGCCAA GCTCTACAGC TTGGTGATCT GGGGGTGTAC GCTGCTCCTG AGCTCACCCA TGCTGGTGTT
```

-continued

```
CCGGACCATG AAGGAGTACA GCGATGAGGG CCACAACGTC ACCGCTTGTG TCATCAGCTA CCCATCCCTC
ATCTGGGAAG TGTTCACCAA CATGCTCCTG AATGTCGTGG GCTTCCTGCT GCCCCTGAGT GTCATCACCT
TCTGCACGAT GCAGATCATG CAGGTGCTGC GGAACAACGA GATGCAGAAG TTCAAGGAGA TCCAGACGGA
GAGGAGGGCC ACGGTGCTAG TCCTGGTTGT GCTGCTGCTA TTCATCATCT GCTGGCTGCC CTTCCAGATC
AGCACCTTCC TGGATACGCT GCATCGCCTC GGCATCCTCT CCAGCTGCCA GGACGAGCGC ATCATCGATG
TAATCACACA GATCGCCTCC TTCATGGCCT ACAGCAACAG CTGCCTCAAC CCACTGGTGT ACGTGATCGT
GGGCAAGCGC TTCCGAAAGA AGTCTTGGGA GGTGTACCAG GGAGTGTGCC AGAAAGGGGG CTGCAGGTCA
GAACCCATTC AGATGGAGAA CTCCATGGGC ACACTGCGGA CCTCCATCTC CGTGGAACGC AGATTCACA
AACTGCAGGA CTGGGCAGGG AGCAGACAGT GAGCAAACGC CAGCAGGGCT GCTGTGAATT TGTGTAAGGA
TTGAGGGACA GTTGCTTTTC AGCATGGGCC CAGGAATGCC AAGGAGACAT CTATGCACGA CCTTGGGAAA
TGAGTGTTGA TGTCTCCGGT AAAACACCGG AGACTAATTC CTGCCCTGCC CAATTTTCGA GGGAGCATGG
CTGTGAGGAT GGGGTGAACT CACGCACAGC CAAGGACTCC AAAATCACAA CAGCATTACT GTTCTTATTT
GCTGCCACAC CTGAGCCAGC CTGCTCCTTC CCAGGAGTGG AGGAGGCCTG GGGGAGGGAG AGGAGTGACT
GAGCTTCCCT CCCGTGTGTT CTCCGTCCCT GCCCCAGCAA GACAACTTAG ATCTCCAGGA GAACTGCCAT
CCACGTTTGG TGCAATGGCT GAGTGCACAA GTGAGTTGTT GCCCTGGGTT TCTTTAATCT ATCAGCTAGA
ACTTTGAAGG ACAATTTCTT GCATTAATAA AGGTTAAGCC CTGAGGGGTC CCTTGATAAC AACCTGGAGA
CCAGGATTTT ATGGCTCCCC TCACTGATGG ACAAGGAGGT CTGTGCCAAA GAAGAATCAA TAAGCACATA
TGAGCACTTC TGTATATCAG TATTGAGCAC TGTAGGCA ATGTTCTCTC CCTGGAAGAT ATCAATGTTT
CTGTCTGTTT GTGAGGACTC CGTGCCCACC ACGGCCTCTT TCAGCGCCGA CATGCTCAAT GTCACCTTGC
AAGGGCCCAC TCTTAACGGG ACCTTTGCCC AGAGCAAATG CCCCCAAGTG GAGTGGCTGG GCTGGCTCAA
CACCATCCAG CCCCCCTTCC TCTGGGTGCT GTTCGTGCTG GCCACCCTAG AGAACATCTT TGTCCTCAGC
GTCTTCTGCC TGCACAAGAG CAGCTGCACG GTGGCAGAGA TCTACCTGGG GAACCTGGCC GCAGCAGACC
TGATCCTGGC CTGCGGGCTG CCCTTCTGGG CCATCACCAT CTCCAACAAC TTCGACTGGC TCTTTGGGGA
GACGCTCTGC CGCGTGGTGA ATGCCATTAT CTCCATGAAC CTGTACAGCA GCATCTGTTT CCTGATGCTG
GTGAGCATCG ACCGCTACCT GGCCCTGGTG AAAACCATGT CCATGGGCCG GATGCGCGGC GTGCGCTGGG
CCAAGCTCTA CAGCTTGGTG ATCTGGGGGT GTACGCTGCT CCTGAGCTCA CCCATGCTGG TGTTCCGGAC
CATGAAGGAG TACAGCGATG AGGGCCACAA CGTCACCGCT TGTGTCATCA GCTACCCATC CCTCATCTGG
GAAGTGTTCA CCAACATGCT CCTGAATGTC GTGGGCTTCC TGCTGCCCCT GAGTGTCATC ACCTTCTGCA
CGATGCAGAT CATGCAGGTG CTGCGGAACA ACGAGATGCA GAAGTTCAAG GAGATCCAGA CGGAGAGGAG
GGCCACGGTG CTAGTCCTGG TTGTGCTGCT GCTATTCATC ATCTGCTGGC TGCCCTTCCA GATCAGCACC
TTCCTGGATA CGCTGCATCG CCTCGGCATC CTCTCCAGCT GCCAGGACGA GCGCATCATC GATGTAATCA
CACAGATCGC CTCCTTCATG GCCTACAGCA ACAGCTGCCT CAACCCACTG GTGTACGTGA TCGTGGGCAA
GCGCTTCCGA AAGAAGTCTT GGGAGGTGTA CCAGGGAGTG TGCCAGAAAG GGGCTGCAG GTCAGAACCC
ATTCAGATGG AGAACTCCAT GGGCACACTG CGGACCTCCA TCTCCGTGGA ACGCCAGATT CACAAACTGC
AGGACTGGGC AGGGAGCAGA CAGTGAGCAA CGCCAGCAG GCTGCTGTG AATTTGTGTA AGGATTGAGG
GACAGTTGCT T ATGTTCTCTC CCTGGAAGAT ATCAATGTTT CTGTCTGTTC GTGAGGACTC CGTGCCCACC
ACGGCCTCTT TCAGCGCCGA CATGCTCAAT GTCACCTTGC AAGGGCCCAC TCTTAACGGG ACCTTTGCCC
AGAGCAAATG CCCCCAAGTG GAGTGGCTGG GCTGGCTCAA CACCATCCAG CCCCCCTTCC TCTGGGTGCT
GTTCGTGCTG GCCACCCTAG AGAACATCTT TGTCCTCAGC GTCTTCTGCC TGCACAAGAG CAGCTGCACG
GTGGCAGAGA TCTACCTGGG GAACCTGGCC GCAGCAGACC TGATCCTGGC CTGCGGGCTG CCCTTCTGGG
```

```
CCATCACCAT CTCCAACAAC TTCGACTGGC TCTTTGGGGA GACGCTCTGC CGCGTGGTGA ATGCCATTAT

CTCCATGAAC CTGTACAGCA GCATCTGTTT CCTGATGCTG GTGAGCATCG ACCGCTACCT GGCCCTGGTG

AAAACCATGT CCATGGGCCG GATGCGCGGC GTGCGCTGGG CCAAGCTCTA CAGCTTGGTG ATCTGGGGGT

GTACGCTGCT CCTGAGCTCA CCCATGCTGG TGTTCCGGAC CATGAAGGAG TACAGCGATG AGGGCCACAA

CGTCACCGCT TGTGTCATCA GCTACCCATC CCTCATCTGG GAAGTGTTCA CCAACATGCT CCTGAATGTC

GTGGGCTTCC TGCTGCCCCT GAGTGTCATC ACCTTCTGCA CGATGCAGAT CATGCAGGTG CTGCGGAACA

ACGAGATGCA GAAGTTCAAG GAGATCCAGA CGGAGAGGAG GGCCACGGTG CTAGTCCTGG TTGTGCTGCT

GCTATTCATC ATCTGCTGGC TGCCCTTCCA GATCAGCACC TTCCTGGATA CGCTGCATCG CCTCGGCATC

CTCTCCAGCT GCCAGGACGA GCGCATCATC GATGTAATCA CACAGATCGC CTCCTTCATG GCCTACAGCA

ACAGCTGCCT CAACCCACTG GTGTACGTGA TCGTGGGCAA GCGCTTCCGA AAGAAGTCTT GGGAGGTGTA

CCAGGGAGTG TGCCAGAAAG GGGGCTGCAG GTCAGAACCC ATTCAGATGG AGAACTCCAT GGGCACACTG

CGGACCTCCA TCTCCGTGGA ACGCCAGATT CACAAACTGC AGGACTGGGC AGGGAGCAGA CAGTGAGCAA

ACGCCAGCAG GGCTGCTGTG AATTTGTGTA AGGATTGAGG GACAGTTGCT T GCCCTTCAAA GATGAGCTGT

TCCCGCCGCC ACTCCAGCTC TGGCTTCTGG GCTCCGAGGA GGGGTGGGGA CGGTGGGGAC ATCAGGCTGC

CCCGCAGTAC CAGGGAGCGA CTGAAGTGCC CATGCCGCTT GCTCCGGAGA AGGTGGGTGC CGGGCAGGGG

CTGCTCCAGC CGCCTCACCT CTGCTGGGAG GACAAACTGT CCCAGCACAG AGGGAGGGAG GGAGGGCAGG

CAGCGGGGAG AAGTTTCCCT GTGGTCGTGG GGAGTT GCCCTTCAAA GATGAGCTGT TCCCGCCGCC

ACTCCAGCTC TGGCTTCTGG GCTCCGAGGA GGGGTGGGGA CGGTGGTGAC GGTGGGGACA TCAGGCTGCC

CCGCAGTACC AGGGAGCGAC TGAAGTGCCC ATGCCGCTTG CTCCGGAGAA GGTGGGTGCC GGGCAGGGGC

TGCTCCAGCC GCCTCACCTC TGCTGGGAGG ACAAACTGTC CCAGCACAGA GGGAGGGAGG GAGGGCAGGC

AGCGGGGAGA AGTTTCCCTG TGGTCGTGGG GAGTT GAGCTCTTCA ATATTTAGT GAAAGCTATA GATGAGGCTC

CATAGGGGAT AAAGCACAGA CACACCTTTT CAGAGGGCTT GTGGACTCTG GCAGCCTGT CCATAGACCT

CTGTCCCCAA CTGGCAAGTC AGGAAACTCC AGATTAAGGA GCCCCAATGT GGTTGAACAG CCAGGTGCAC

AGATGAGTCA ACCACACAGC CAGGCCAGGG AGGGCCTTCA CTCAAGAGCC TACAGCCAGT TCACAGCCAA

GCCAGGGCTA GCGCCAGGCC ACCCATAAAC TGATCTGAGA CTCTGTTTCC CTGTCTCCAT GATGATGGGA

TCAGGCTTGA TTGCTGGTTT GTAGGCTTGT TATGAATCAA GTCACAGGGA AGAGGAGCTG ATGGGCTGGG

GGGACGTCCT CTGGCCCTCC TGTCTCTTCC CCAGATCCAC TGGGCCCACT CTTATCTGTT CTCTTCTGAA

GGAAGGGTTT TAAGGCTTCA AAAAAAAATG TTTTGAAAGT CCCTGCCCTT TCCAGCTCCT ACCGTCTCAG

CCCTGGGAGT GTAAAGTGCT GCAGATAGTT AGTAAGTCTT TGAGCAAAAC TGAGAAAGCC AGCCTGAGCC

TTGACATGGG AGAAACCTCC GCCATACATC TCCGAAGAAA CGGCCGCGTG TCTCAGGGGA GCGCAAACAC

CCGTACCCAG GAAACAGGAC AGCTTCTGCC ACTGTCGCCC TTGGGAGCCG TACGTGGCAT GACAAAGAAA

TCCCAGGACT CCGCCTGCCC ACCTGGCCAC CCTCTGTTTA CACCTTCCGC GTAAACGCCC ACTGTTTACA

TCCAAAACTC AGACACAAAA TAACCACCTC AAGAAGATAA ATAATGATAA GAAATAAATG TTACGCGAGG

CAAATTTATT CACATGGGGC TTCCCAGGCC ACTTTGTGGT CAGCCGGGAG GGACGTTTTT GCCGTCCCAC

GACTCCAACG GGCAGCCGGG CCTACGCAAA CATGGAAATC TTCCAAGAGC CTCCCTGGCC CCCAGGGCTC

AGAGGGTGGC AGAGCGGAGA GCGAAGGTGG CCGCAGCCTT CCCGGCCCCA CAGCCAGCCT GGCTCCAGCT

GGGCAGGAGT GCAGAGCTCA GCTGGAGGCG AGGGGGAAGT GCCCAGGAGG CTGATGACAT CACTACCCAG

CCCTTCAAAG ATGAGCTGTT CCCGCCGCCA CTCCAGCTCT GGCTTCTGGG CTCCGAGGAG GGGTGGGGAC

GGTGGTGACG GTGGGGACAT CAGGCTGCCC CGCAGTACCA GGGAGCGACT GAAGTGCCCA TGCCGCTTGC
```

```
TCCGGAGAAG GTGGGTGCCG GGCAGGGGCT GCTCCAGCCG CCTCACCTCT GCTGGGAGGA CAAACTGTCC
CAGCACAGAG GGAGGGAGGG AGGGCAGGCA GCGGGGAGAA GTTTCCCTGT GGTCGTGGGG AGTTGGGAAA
AGTTCCCTTC CTTCCGGAGG GAGG CAGATTCACA AACTGCAGGA CTGGGCAGGG AGCAGACAGT GAGCAAACGC
CAGCAGGGCT GCTGTGAATT TGTGTAAGGA TTGAGGGACA GTTGCTTTTC AGCATGGGCC CAGGAATGCC
AAGGAGACAT CTATGCACGA CCTTGGGAAA TGAGTTGATG TCTCCGGTAA ACACCGGAG ACTAATTCCT
GCCCTGCCCA ATTTTGCAGG GAGCATGGCT GTGAGGATGG GGTGAACTCA CGCACAGCCA AGGACTCCAA
AATCACAACA GCATTACTGT TCTTATTTGC TGCCACACCT GAGCCAGCCT GCTCCTTCCC AGGAGTGGAG
GAGGCCTGGG GGGAGGGAGA GGAGTGACTG AGCTTCCCTC CCGTGTGTTC TCCGTCCCTG CCCCAGCAAG
ACAACTTAGA TCTCCAGGAG AACTGCCATC CAGCTTTGGT GCAATGGCTG AGTGCACAAG TGAGTTGTTG
CCCTGGGTTT CTTTAATCTA TTCAGCTAGA ACTTTGAAGG ACAATTTCTT GCATTAATAA AGGTTAAGCC
CTGAGGGGTC CCTGATAACA ACCTGGAGAC CAGGATTTTA TGGCTCCCCT CACTGATGGA CAAGGAGGTC
TGTGCCAAAG AAGAATCCAA TAAGCACATA TTGAGCACTT GCTGTATATG CAGTATTGAG CACTGTAGGC
AAGACCCAAG AAAGAGAAGG AGCCATCTCC ATCTTGAAGG AACTCAAAGA CTCAAGTGGG AACGACTGGG
CACTGCCACC ACCAGAAAGC TGTTCGACGA GACGGTCGAG CAGGGTGCTG TGGGTGATAT GGACAGCAGA
AGGGGGAGAC CAAGGTTCCA GCTCAACCAA TAACTATTGC ACAACCACCT GTCCCTGCCT CAGTTCCCTT
TTATGTAACA TGAAGTCGTT GTGAGGGTTA AAGGCAGTAA CAGGTATAAA GTACTTAGAA AAGCAAAGGG
TGCTACGTAC ATGTGAGGCA TCATTACGCA GACGTAACTG GGATATGTTT ACTATAAGGA AAAGACACTG
AGGTCTAGAA ATAGCTCCGT GGAGCAGAAT CAGTATTGGG AGCCGGTGGC GGTGTGAAGC ACCAGTGTCT
GGCACACAGT AGGTGCTCAT TGGCTCCCTT CCACCTGTCA TTCCCACCAC CCTGAGGCCC CAACCGCCAC
ACACACAGGA GCATTTGGAG AGAAGGCCAT GTCTTCAAAG TCTGATTTGT GATGAGGCAG AGGAAGATAT
TTCTAATCGG TCTTGCCCAG AGGATCACAG TGCTGAGACC CCCCACCACC AGCCGGTACC TGGGAAGGGG
GAGAGTGCAG GCCTGCTCAG GGACTGTTCC TGTCTCAGCA ACCAAGGGAT TGTTCCTGTC AATCAATGGT
TTATTGGAAG GTGGCCCAGT ATGAGCCCTA GAAGAGTGTG AAAAGGAATG GCAATGGTGT TCACCATCGG
CAGTGCCAGG GCAGCACTCA TTCACTTGAT AAATGAATAT TTATTAGCTG GTTGGAGAGC TAGAACCTGG
AGAGCTAGAA CCTGGAGAAC TAGAACCTGG AGGGCTAGAA CCTGGAGAGG CTAGAACCAA GAAGGGCTAG
AACCTGGAGG GGCTAGAACC TAGAGAAGCT AAAACCTGAG CTAGAAGCTG GAGGACTAGA ACCTGGAGGG
CTGGAATCTG AAGGGCTAGA ACCTGGAGGG CTGGAATCTG GAGAGCTAGA ACCTGGAGGG CTAGAACCTG
GAGGGCTAGA ACCTAGAAGG GCTAGAACCT GGAGGGCTGG AATCTGGAGA GCTAGAACCT GGAGGGCTAG
AACCTGGAGG GCTAGAACCT AGAAGGGCTA GAACCTGGAG GGCTAGAACC TGGCAGGTTA GAACCTAGAA
GGGCTAGAAC CTGGAGAGCC AGAACCTGGA GGGCTAGAAC CTGGAAGGGC TAGAACCTGT AGAGCTAGAA
CATGGAGAGC TAGAACCCGG CAGGCTAGAA CCTGGCAAGC TAGAACCTGG AGGGAATGAA CCTGGAGGGC
TAGAACCTGG AGAATGAGAA AAATTTACAT GGCAAAGAGC CCATAAATCC TGACCAATCC AACTCTGAAT
TTTAAAGCAA AAGCGTGAAA AAAAGATTC CCTCCTTACC CCCAACCCAC TCTTTTTTCC CACCACCCAC
TCTCCTCTGC CTCAGTAAGT ATCTGGAGGA AGAAACAGG TGAAAGAAGA AGTAAAAACC ATTTAGTATT
AGTATTAGAA TGAAGTCAAA CTGTGCCACA CATGGTGAAT GAAAAAAAAA AAAAAGAGGC TGTGTTTTGT
CACACAGGGC AGTCATTCAG CACCAGAGCA CGTGATGGTC TGAGACTCTC TTAGGAGCAG AGCTCTGCCG
CAATGGCCAT GTGGGGATCC ACACCTGGTC TGAGGGGCAA CTGAGTCTGC GGGAGAAGAG CGGCCCTATG
CATGGTGTAG ATGCCCTGAT AAAGAACATC TGTCCTGTGA AAGACTCAAT GAGCTGTTAT GTTGTAAACA
GGAAGCATTT CACATCCAAA CGAGAAAATC ATGTAAACAT GTGTCTTTTC TGTAGAGCAT AATAAATGGA
TGAGGTTTTT GCAAAAAAAA AAAAAAAAA AAATGATAGA CCGTCAATAA TTTGTTAAAT GCTTTTTAAA
```

```
ATGAATGCTT TAAGCCGGGT GCAGTGCCTC ACATCTGTAA TCCCAGCACT TTGGAGCCGA GCGGGTGGAT
TGTGTGAGGT CAGGAGTTCG AGACCAACCT GGCCAACATG GCAAAACCTC ACTCTCTACC AAAAATACAA
AAATTAGCCA GGCATGGTGG CAGGCACCTG TGATCCCAGC TACTCAGGAG GCTGAGACAG GAGAATCGCT
TGAACCCGGG AGGCAAGGTT GCAGTGAGCC AAGATTACGC CATTGTACTC CAGCCTGGGT GACAGAGAGA
GACTCCGTCT CAAAAAAAAA AAAAAAAAAA AAAAATTAC GCTTCAAACA CATGATCTCT CACCACTGTT
GAATTTTCTT TCTATGAGCC CAGGAGGGCC TCTCAGAGAG GAAAGCTCCT AGGTCTTCCT TTCCCTCTGC
AAACTCCCTG CCTTGAAGGT TCAGAAGGAC TGTGCGTGCT CGTTGCATCC TTTGCAAGTG TCCAAACCCT
GATCCCAGCT GTGCTTAGGG GTTCCTGCAA ACCTTTTCCA GGTGTTAATT ACCTCCCACT TCATTTCCTG
TTTACCAACT CAGCTTTTTG TTTTAGTGTG TTTGAATTCC CTGAACTGAC CGTTGTCTGA TCTCCACCTC
CCAACTGAAT TAGGGGAGCT GGGCTTCTGG AAACCCAGGT GCCGGGTGTT GCAGAGTGGC TGAAAGCTGG
GATGTGGCAG ATCCGTGGCT ACATTCATGC ACACACACAC ACCCACATAC CCACACATGC ACACACACAC
ACACACCCGC ACTCACACAC TTGGACATGC ATAGACCACA GCTTTCCACA CCCTTCCTAG ACAGGGTCA
CTTGGTATCC TGGAGAGAGT GTGAAGTCCT GGAATGGAAA GAGGGGGGAT TAAGCCCCAC CTCTAGCCAT
GGGACTGAGA CAAGTCACCA CCAACCCATC TGCGCCTTGT TTACCTCCTC TGTGAGGCAA GCACAGAGCC
CATGCCTGCC CCCCTGGATG GGAGTGATGT GAAACTTGAA GGGCGGTCAG AGCAAGGGTC GGGAATGGAA
GGCCCTTGGG AAAAAAGGCC CTTTCAACTA GGGGCACAGA GGAGGCCCTG GGCTGAGAAC TTGACAGCAC
CTTGTAATTG GTAAGCCAAG CCCGAAGGGA CTGGAAATAC TCAGATGTGT CTGTCTCCCT TATTAGGTTC
AAAGTCCCTC AAGACCCTGT CTCCATCACA GTGCTCCAGT CCAGACCCCT CCTCTGAGCT CCAGACCCTG
CTGGACCCAA CCAGCCCTAT GGGGTCGCAT CCCCACCTGC CTGGAATTCT CCAAAGAACC TCCCCTTTAA
CAGTTCCAGC CTTTAACAGT TCCAGTCTAA ACACATGACC TTTCTCCTCT AAATCAGCCC CCATCTCTG
CCTTTGCAGG AGATGGAAGC CATGACACCT GCCTCGCCCC TGTCCTCACC CCATCCATGT CCAATCAAGC
ACTAGGCATG TCAGGTTTAC CCTCTAAACT CCTCTGGAAT CCAGTCTCTC AGTCTCCATC ATCCCAGGTC
GAAGCTAATG GGCTAACTGG TCCTTGCTTC CACTCTACCC CCACTGCAGT CCTGACTTCC TGAGCAGCAG
CCAGGGCCTA ATCGATATTC ACACCAAGCG CCAACCTGAC TGAGATATCC TCCTGCACCA TCATCCCTCC
ACCCTGTTTA GTTCTGCTCA CCCTCAGTGT TCTCATCAAT AATCCACTCC CCTCACAGGC GCGTTTGGGA
CCCCATGTTC TATGCTCTCA CAGGACCTTT GCTTGATTT TTCACTGTAC TTAGGTCAGT TTGCAGTTAT
TAAGTGACTG AGCAATGTCT GGCTTCTCCA GTAGACTGTC AGCTCCTAGC CATTGTATAC CTAGCACCGC
TGTGTGGGAG CACGTGACAA ACGTCCAGTG AGTCAGGGAC TCAGCAGTCT CCATTTCTCC GCCCTGCTGG
AGAATGCGTG TATTTGGCAA TCCCCAGCCC CTGTGCCATC TAACCATCTT TTCTTCTCTG TTCAGCCCAG
GTGTGGCCTC ACTCACATCC CACTCTGAGT CCAAATGTTC TCTCCCTGGA AGATATCAAT GTTTCTGTCT
GTTCGTGAGG ACTCCGTGCC CACCACGGCC TCTTTCAGGT GAGTCAAAGG GATTCCTCAG TTCACTAGTT
AGGGGAGGTG GGCAGACACC CTGGAGAACT CCCTGGAAAG CTCAACTCTC ATGCCCCGGA CAACAGTTGA
AGGAACCATG GTGATGTTAA GCCCAAAGAC AAAACCTCTC AGGTGTCCAA GTCCCTGTTG GAATCTTGGG
AGCAGAGGGA ATGTTCTGTG GTCTAGAGGA AGAGGGGCTC AGGGAGGAGA AGGGCACATT CCTGGTTGTT
ATATGTTTCT ATCTATCCCA GATGAACTTG GAAGTGAAGG GAAGAGAGTT AAACATTAAA GTAAATACCC
AGTGGATCAG ACAGCAATGT GCCAGATTGC CTTGGAAACA AAATATCTCC AACACATGGC TGACATTTGG
TGGGAGATCA GAACACCCTA AAGAGAGAAT TTAAGGGGAG GGGAGGAGG ACCTGAGCCA GAGTAGAAGC
AGAGGATAGG GAGATCTGTT CTTGGGGACA GCATTTGCAA GAAACAAGGC TGAGGGGTCC ACTCCAACCT
CTCCACCCTG CTGCAGGTGC TGCCTATGAT GAAGATGAGC AGATGGCCAT CTCAGCTGGG GCCACAGTGC
```

-continued

```
ACTGGACCTA TAGTTTCCAA TTCCGCACTC AGCAGGCATC TTTCTGATGA TCCGATGGCT TCTCAGAGCC
AGGGATGGGC CAGGATCCAT CCCCTTGGCT ACTGTCTTGC TGAGAAATTT ATAAGCAGCA TCTGGTGCTA
TACTTTGGTC TCTAGTGAGT TAGCTCATGA AAGATGATAG ACTCTCCAAG CCAGGGGTAT GCAGGAAATG
GGTTTTCTGT AGCTACAGAA ATGGGGTTGA GGGTTGGACC AAGGGACTAC CCAGGGGAAG TCTTACCTTC
AGAGGACTCT GGAAAGGAGG CTGCAAGTTT TCATGGGTCA AGAATTCAGA GCCCAGTAGA GACAGCTTAT
CTCTGTTCCA AGATGTCTGG GGCCTTGGTT GGAAGATTCA AAGGCTAGGA AACCAGGAGC CACCAAAAGC
GTAACTGGGG CCAGAGGATC CACTTTCAAG GTGGCAAGTT GGTTCCCCCC ATGTGGCTGC TTGAGTATCC
TCACATGGCG GCTCACATCC TTCCAAGTAA GCAATGCAAA AGGCCAAGAA AGATGCTGCA AAGATGTTAT
GACCTAGCCT CAGAAATCAC ACACCATCCC TGCCACCATT AGTAAGAAGT CCAGCCCACG TCCAGGAGAA
GAGGAAGCAG ATTCCTCCTT TTGAAATGAA GAATATCAAG TAATTCGGGG GGCATATGAA AGCCACCACA
CACCACAGGG ATCTTTTTAG AGCATACTTC TTATACCATC ACTGTAGTTC CTTAAGACTC AGGGGCAAAG
CCTCACTTCC TTAGCACCCA GTGAAGACCA CGCTTACTCC CTCACTCAAC CTCTTGCTAC TTCCCACCTC
TCCTGTCCAA CATCTAGTGT CACTTTCCAG AACATACCAA CAGCTTCCCC AGTTCTGTGC CTCTGCTCAG
GCTGTTCCCC CTGCCTGGTC CACTTGTCCT CCTTCTTGTC CGGTCAAAAT GCTTCTTATC CTTCAAGACC
CAGCTCTAGA GTCACCTCCA ACCCCTTACC CACCAGCCCC CTCTCCAAGT CTGTGTCCCA CAACCCCCCT
GCTCCCTCCA GGGCACCCTC CACCCTCTGG GCCACAGTTG TCAGGAGTCA GGCAGGGCAG GGGCCGGGTG
GTGTCTTCTT TGTGTTCTTG CACTCAGGGC AGAGCTCAGC ACAGAGCAGA CGCTCAAAAA ACATTTAAAG
GATAGAAGCA TTGATTTGTG GGTCCCCCAG TCTGGCTCCA GGATGCCAGC CAGCTGCTCC TAGAAGCAAA
CGGACTTTTC CTGGGAAATC CCAGAGGTGA TGATCAGTAA TCTCTCCCGT GACTCGTAGT TCAGCTCTTC
CTCCATGAGC CTGACTATCA GTGGACCTTC CAGAAAGAGC CCCTTTTCCT TCTCTCACCC ACAGCACAGG
GCACTGGGAA AATGCCCAAT GAGTCCTGCC TCTGGGTTGT GCTTTGGACT TTTCAGTGTG TCTCGCATCC
ACTCTTCAAC TTGAATGTTG CAACAGCCAT GAAAAAGAA ATGCAAAGCG ATTCAGGATG AGAGCAATAC
CCTACTCCAA AGAAGGCAAC ATAGAAGCTC AGAGAGATCA AGCAATTTGC CCAAGACCAC ACAGCTAGGA
GTGGAACTCA TGGCTGTCCA AGCCCCATGC CTCTGCTGAA GGTAGAGATG AATTACAGCA ACAAGTCTAG
AAAGGTGCCT GCCCTATGGT CTGTGAGTCT TGCCTAAGAA TGAAAGAGGA GCCAGTGGGT TAAAGATGAG
GTCACCAACA ACGGTGGTGT TGGAGTTTAC CACTGATAAT AAGGGTGCAA AATGTAAATT ACTAATGTTT
ATTGAGCCTA GTGCAGTGCG TGGGGCATTT TGCACATTGT CTCTGATCCC TATGACAACC CTGAGAGGTA
GTGGTTTTAA CTGCCATGTT ACAGGTGAGG TCATTGTGGT TCAAGGACGT TAAGTAACTT CCCCAGCGTG
ACACGGCTTA TAAGTAAGGC AGCCAGGATG TGAACCCAGT AGGACTATCT GGCTGCAAAG TCCCCACCCC
CCTCGCCATC TGTATCCTCC AATCACTTCA GTGCTTTGCT GCATAGAAGG TAACGGAAAT CACGATGCCA
CAGACTGTCC AGGAAGACAG AAACTAGGCA GATGGGCTGG CCATGGTCTC CAAGCCAGAC TGGAATCTCC
AGGTCTGGAA TGATATCATT TTTCTCTTTT AATAAATTAA CTCACCCACC ACACGGCTTT GAGAGGCTCA
AAGTTGACCA ACTCCCTTGG GAGGGCCCCG GTTGATAAGG AAGGAACGTG AATCCTCCCA TCACGGAAGC
TTCAAGGAGG TCAAGGGTCC AACACTTGAG ATTGTTAGTG CTGTTGGTGG ATACTGGCCA AGGAAATATC
CCAGTGGAGC CTCGAGATGA AGAACATGAG GCCCCGTTT AGAACCAAGG ATCAGAGGGG CTCTGTAAG
ACCCAGGGGA GTCAGGTGCA CTGGAGCGCG GGCATGCAGA AAACAGCCTG AGCTCCACCT CGGCTTCTCC
TTGTCCTGGC TGGTTGTCCT TAACCCCTGT CTCCTTCTGG ACCAGTTTTT GTCCTTCCCT TGTGACCGCT
GAGGGGTAAC AGCCTCTTTC CACTTTCTTT CAGCGCCGAC ATGCTCAATG TCACCTTGCA AGGGCCCACT
CTTAACGGGA CCTTTGCCCA GAGCAAATGC CCCCAAGTGG AGTGGCTGGG CTGGCTCAAC ACCATCCAGC
CCCCCTTCCT CTGGGTGCTG TTCGTGCTGG CCACCCTAGA GAACATCTTT GTCCTCAGCG TCTTCTGCCT
```

```
GCACAAGAGC AGCTGCACGG TGGCAGAGAT CTACCTGGGG AACCTGGCCG CAGCAGACCT GATCCTGGCC
TGCGGGCTGC CCTTCTGGGC CATCACCATC TCCAACAACT TCGACTGGCT CTTTGGGGAG ACGCTCTGCC
GCGTGGTGAA TGCCATTATC TCCATGAACC TGTACAGCAG CATCTGTTTC CTGATGCTGG TGAGCATCGA
CCGCTACCTG GCCCTGGTGA AAACCATGTC CATGGGCCGG ATGCGCGGCG TGCGCTGGGC CAAGCTCTAC
AGCTTGGTGA TCTGGGGGTG TACGCTGCTC CTGAGCTCAC CCATGCTGGT GTTCCGGACC ATGAAGGAGT
ACAGCGATGA GGGCCACAAC GTCACCGCTT GTGTCATCAG CTACCCATCC CTCATCTGGG AAGTGTTCAC
CAACATGCTC CTGAATGTCG TGGGCTTCCT GCTGCCCCTG AGTGTCATCA CCTTCTGCAC GATGCAGATC
ATGCAGGTGC TGCGGAACAA CGAGATGCAG AAGTTCAAGG AGATCCAGAC GGAGAGGAGG GCCACGGTGC
TAGTCCTGGT TGTGCTGCTG CTATTCATCA TCTGCTGGCT GCCCTTCCAG ATCAGCACCT TCCTGGATAC
GCTGCATCGC CTCGGCATCC TCTCCAGCTG CCAGGACGAG CGCATCATCG ATGTAATCAC ACAGATCGCC
TCCTTCATGG CCTACAGCAA CAGCTGCCTC AACCCACTGG TGTACGTGAT CGTGGGCAAG CGCTTCCGAA
AGAAGTCTTG GGAGGTGTAC CAGGGAGTGT GCCAGAAAGG GGGCTGCAGG TCAGAACCCA TTCAGATGGA
GAACTCCATG GGCACACTGC GGACCTCCAT CTCCGTGGAA CGCCAGATTC ACAAACTGCA GGACTGGGCA
GGGAGCAGAC AGTGAGCAAA CGCCAGCAGG GCTGCTGTGA ATTTGTGTAA GGATTGAGGG ACAGTTGCTT
TTCAGCATGG GCCCAGGAAT GCCAAGGAGA CATCTATGCA CGACCTTGGG AAATGAGTTG ATGTCTCCGG
TAAAACACCG GAGACTAATT CCTGCCCTGC CCAATTTTGC AGGGAGCATG GCTGTGAGGA TGGGGTGAAC
TCACGCACAG CCAAGGACTC CAAAATCACA ACAGCATTAC TGTTCTTATT TGCTGCCACA CCTGAGCCAG
CCTGCTCCTT CCCAGGAGTG GAGGAGGCCT GGGGGCAGGG AGAGGAGTGA CTGAGCTTCC CTCCCGTGTG
TTCTCCGTCC CTGCCCCAGC AAGACAACTT AGATCTCCAG GAGAACTGCC ATCCAGCTTT GGTGCAATGG
CTGAGTGCAC AAGTGAGTTG TTGCCCTGGG TTTCTTTAAT CTATTCAGCT AGAACTTTGA AGGACAATTT
CTTGCATTAA TAAAGGTTAA GCCCTGAGGG GTCCCTGATA ACAACCTGGA GACCAGGATT TTATGGCTCC
CCTCACTGAT GGACAAGGAG GTCTGTGCCA AAGAAGAATC CAATAAGCAC ATATTGAGCA CTTGCTGTAT
ATGCAGTATT GAGCACTGTA GGCAAGAGGG AAGAAAGAGA AGGAGCCATC TCCATCTTGA AGGAACTCAA
AGACTCAAGT GGGAACGACT GGGCACTGCC ACCACCAGAA AGCTGTTCGA TGAGACGGTC GAGCAGGGTG
CTGTGGGTGA TATGGACAGC AGAAGGGGGA GCCAGGTTCC AGCTCACCAA TACTATTGCA CACCACCTGT
CCTGCCCTC TGATCCTATC ACAACCTGAG AGTAGTTTTT ACTCCATTTA CAGGTGAGGT CATTGTGGTT
CAAGGACGTT AAGTAACTTC CCCAGCTCAC ACGGCTTATA AGTAAGGCAG CCAGGATGTG AACCCAGTAG
GACTATCTGG CTGCAAAGTC CCCACCCTCC CTCGCCATCT GTATCCTCCA ATCATCTTCA GTGCTTTGCT
GATAGAAGGT ACGGAAATAC GATGCCACAG ACTGTCCAGG AAGACAGAAA CTAGGCAGAT GGGCTGGCCA
TGGTCTCCAA GCCAGACTGG AATCTCCAGG TCTGGAATGA TATCATTTTT CTCTTTTAAT AAATTAACTC
ACCCACCACA CGGCTTTGAG AGGCTCAAAG GTGACCAACT CCCTTGGGAG GGCCCCGGTT GATAAGGAAG
GAATGTGAAT CCTCCCATCA CGGAAGCTTC AAGGAGGTCA AGGTCCAAC ACTTGAGATT GTTAGTGCTG
TTGGTGGATA CTGCAGAATA TCCAGTGGAG CCTCAGATGA AGAACATGAG GCCCGTTTA GATCCAAGGA
TCAGAGGGGG CTCTGTAAGA CCCAGGGGAG TCAGGTGCAC TGGAGCGCGG GCTGCAGAAA ACAGCCTGAG
CTCCACCTCG GCTTCTCCTT GCCCTGGCTG GTTGTCCTTA ACCCCTGTCT CCTTCTGGAC CAGTTTTTGT
CCTTCCCTTG TGACCTGAGG GGTAACAGCC TCTTTTCCAC TTTCTTTCAG CGCCGACATG CTCAATGTCA
CCTTGCAAGG GCCCACTCTT AACGGGACCT TTGCCCAGAG CAAATGCCCC CAAGTGGAGT GGCTGGGCTG
GCTCAACACC ATCCAGCCCC CCTTCCTCTG GGTGCTGTTC GTGCTGGCCA CCCTAGAGAA CATCTTTGTC
CTCAGCGTCT TCTGCCTGCA CAAGAGCAGC TGCACGGTGG CAGAGATCTA CCTGGGGAAC CTGGCCGCAG
```

-continued

```
CAGACCTGAT CCTGGCCTGC GGGCTGCCCT TCTGGGCCAT CACCATCTCC AACAACTTCG ACTGGCTCTT
TGGGGAGACG CTCTGCCGCG TGGTGAATGC CATTATCTCC ATGAACCTGT ACAGCAGCAT CTGTTTCCTG
ATGCTGGTGA GCATCGACCG CTACCTGGCC CTGGTGAAAA CCATGTCCAT GGGCCGGATG CGCGGCGTGC
GCTGGGCCAA GCTCTACAGC TTGGTGATCT GGGGGTGTAC GCTGCTCCTG AGCTCACCCA TGCTGGTGTT
CCGGACCATG AAGGAGTACA GCGATGAGGG CCACAACGTC ACCGCTTGTG TCATCAGCTA CCCATCCCTC
ATCTGGGAAG TGTTCACCAA CATGCTCCTG AATGTCGTGG GCTTCCTGCT GCCCCTGAGT GTCATCACCT
TCTGCACGAT GCAGATCATG CAGGTGCTGC GGAACAACGA GATGCAGAAG TTCAAGGAGA TCCAGACGGA
GAGGAGGGCC ACGGTGCTAG TCCTGGTTGT GCTGCTGCTA TTCATCATCT GCTGGCTGCC CTTCCAGATC
AGCACCTTCC TGGATACGCT GCATCGCCTC GGCATCCTCT CCAGCTGCCA GGACGAGCGC ATCATCGATG
TAATCACACA GATCGCCTCC TTCATGGCCT ACAGCAACAG CTGCCTCAAC CCACTGGTGT ACGTGATCGT
GGGCAAGCGC TTCCGAAAGA AGTCTTGGGA GGTGTACCAG GGAGTGTGCC AGAAAGGGGG CTGCAGGTCA
GAACCCATTC AGATGGAGAA CTCCATGGGC ACACTGCGGA CCTCCATCTC CGTGGAACGC CAGATTCACA
AACTGCAGGA CTGGGCAGGG AGCAGACAGT GAGCAAACGC CAGCAGGGCT GCTGTGAATT TGTGTAAGGA
TTGAGGGACA GTTGCTTTTC AGCATGGGCC CAGGAATGCC AAGGAGACAT CTATGCACGA CCTTGGGAAA
TGAGTGTTGA TGTCTCCGGT AAAACACCGG AGACTAATTC CTGCCCTGCC CAATTTTCGA GGGAGCATGG
CTGTGAGGAT GGGGTGAACT CACGCACAGC CAAGGACTCC AAAATCACAA CAGCATTACT GTTCTTATTT
GCTGCCACAC CTGAGCCAGC CTGCTCCTTC CCAGGAGTGG AGGAGGCCTG GGGGAGGGAG AGGAGTGACT
GAGCTTCCCT CCCGTGTGTT CTCCGTCCCT GCCCCAGCAA GACAACTTAG ATCTCCAGGA GAACTGCCAT
CCACGTTTGG TGCAATGGCT GAGTGCACAA GTGAGTTGTT GCCCTGGGTT TCTTTAATCT ATCAGCTAGA
ACTTTGAAGG ACAATTTCTT GCATTAATAA AGGTTAAGCC CTGAGGGGTC CCTTGATAAC AACCTGGAGA
CCAGGATTTT ATGGCTCCCC TCACTGATGG ACAAGGAGGT CTGTGCCAAA GAAGAATCAA TAAGCACATA
TGAGCACTTC TGTATATCAG TATTGAGCAC TGTAGGCA ATGTTCTCTC CCTGGAAGAT ATCAATGTTT
CTGTCTGTTT GTGAGGACTC CGTGCCCACC ACGGCCTCTT TCAGCGCCGA CATGCTCAAT GTCACCTTGC
AAGGGCCCAC TCTTAACGGG ACCTTTGCCC AGAGCAAATG CCCCCAAGTG GAGTGGCTGG GCTGGCTCAA
CACCATCCAG CCCCCCTTCC TCTGGGTGCT GTTCGTGCTG GCCACCCTAG AGAACATCTT TGTCCTCAGC
GTCTTCTGCC TGCACAAGAG CAGCTGCACG GTGGCAGAGA TCTACCTGGG GAACCTGGCC GCAGCAGACC
TGATCCTGGC CTGCGGGCTG CCCTTCTGGG CCATCACCAT CTCCAACAAC TTCGACTGGC TCTTTGGGGA
GACGCTCTGC CGCGTGGTGA ATGCCATTAT CTCCATGAAC CTGTACAGCA GCATCTGTTT CCTGATGCTG
GTGAGCATCG ACCGCTACCT GGCCCTGGTG AAAACCATGT CCATGGGCCG GATGCGCGGC GTGCGCTGGG
CCAAGCTCTA CAGCTTGGTG ATCTGGGGGT GTACGCTGCT CCTGAGCTCA CCCATGCTGG TGTTCCGGAC
CATGAAGGAG TACAGCGATG AGGGCCACAA CGTCACCGCT GTGTCATCA GCTACCCATC CCTCATCTGG
GAAGTGTTCA CCAACATGCT CCTGAATGTC GTGGGCTTCC TGCTGCCCCT GAGTGTCATC ACCTTCTGCA
CGATGCAGAT CATGCAGGTG CTGCGGAACA ACGAGATGCA GAAGTTCAAG GAGATCCAGA CGGAGAGGAG
GGCCACGGTG CTAGTCCTGG TTGTGCTGCT GCTATTCATC ATCTGCTGGC TGCCCTTCCA GATCAGCACC
TTCCTGGATA CGCTGCATCG CCTCGGCATC CTCTCCAGCT GCCAGGACGA GCGCATCATC GATGTAATCA
CACAGATCGC CTCCTTCATG GCCTACAGCA ACAGCTGCCT CAACCCACTG GTGTACGTGA TCGTGGGCAA
GCGCTTCCGA AAGAAGTCTT GGGAGGTGTA CCAGGGAGTG TGCCAGAAAG GGGGCTGCAG GTCAGAACCC
ATTCAGATGG AGAACTCCAT GGGCACACTG CGGACCTCCA TCTCCGTGGA ACGCCAGATT CACAAACTGC
AGGACTGGGC AGGGAGCAGA CAGTGAGCAA ACGCCAGCAG GGCTGCTGTG AATTTGTGTA AGGATTGAGG
GACAGTTGCT T ATGTTCTCTC CCTGGAAGAT ATCAATGTTT CTGTCTGTTC GTGAGGACTC CGTGCCCACC
```

```
ACGGCCTCTT TCAGCGCCGA CATGCTCAAT GTCACCTTGC AAGGGCCCAC TCTTAACGGG ACCTTTGCCC

AGAGCAAATG CCCCCAAGTG GAGTGGCTGG GCTGGCTCAA CACCATCCAG CCCCCCTTCC TCTGGGTGCT

GTTCGTGCTG GCCACCCTAG AGAACATCTT TGTCCTCAGC GTCTTCTGCC TGCACAAGAG CAGCTGCACG

GTGGCAGAGA TCTACCTGGG GAACCTGGCC GCAGCAGACC TGATCCTGGC CTGCGGGCTG CCCTTCTGGG

CCATCACCAT CTCCAACAAC TTCGACTGGC TCTTTGGGGA GACGCTCTGC CGCGTGGTGA ATGCCATTAT

CTCCATGAAC CTGTACAGCA GCATCTGTTT CCTGATGCTG GTGAGCATCG ACCGCTACCT GGCCCTGGTG

AAAACCATGT CCATGGGCCG GATGCGCGGC GTGCGCTGGG CCAAGCTCTA CAGCTTGGTG ATCTGGGGGT

GTACGCTGCT CCTGAGCTCA CCCATGCTGG TGTTCCGGAC CATGAAGGAG TACAGCGATG AGGGCCACAA

CGTCACCGCT TGTGTCATCA GCTACCCATC CCTCATCTGG GAAGTGTTCA CCAACATGCT CCTGAATGTC

GTGGGCTTCC TGCTGCCCCT GAGTGTCATC ACCTTCTGCA CGATGCAGAT CATGCAGGTG CTGCGGAACA

ACGAGATGCA GAAGTTCAAG GAGATCCAGA CGGAGAGGAG GGCCACGGTG CTAGTCCTGG TTGTGCTGCT

GCTATTCATC ATCTGCTGGC TGCCCTTCCA GATCAGCACC TTCCTGGATA CGCTGCATCG CCTCGGCATC

CTCTCCAGCT GCCAGGACGA GCGCATCATC GATGTAATCA CACAGATCGC CTCCTTCATG GCCTACAGCA

ACAGCTGCCT CAACCCACTG GTGTACGTGA TCGTGGGCAA GCGCTTCCGA AAGAAGTCTT GGGAGGTGTA

CCAGGGAGTG TGCCAGAAAG GGGGCTGCAG GTCAGAACCC ATTCAGATGG AGAACTCCAT GGGCACACTG

CGGACCTCCA TCTCCGTGGA ACGCCAGATT CACAAACTGC AGGACTGGGC AGGGAGCAGA CAGTGAGCAA

ACGCCAGCAG GGCTGCTGTG AATTTGTGTA AGGATTGAGG GACAGTTGCT T GCCCTTCAAA GATGAGCTGT

TCCCGCCGCC ACTCCAGCTC TGGCTTCTGG GCTCCGAGGA GGGGTGGGGA CGGTGGGGAC ATCAGGCTGC

CCCGCAGTAC CAGGGAGCGA CTGAAGTGCC CATGCCGCTT GCTCCGGAGA AGGTGGGTGC CGGGCAGGGG

CTGCTCCAGC CGCCTCACCT CTGCTGGGAG ACAAACTGT CCCAGCACAG AGGGAGGGAG GGAGGGCAGG

CAGCGGGGAG AAGTTTCCCT GTGGTCGTGG GGAGTT GCCCTTCAAA GATGAGCTGT TCCCGCCGCC

ACTCCAGCTC TGGCTTCTGG GCTCCGAGGA GGGGTGGGGA CGGTGGTGAC GGTGGGGACA TCAGGCTGCC

CCGCAGTACC AGGGAGCGAC TGAAGTGCCC ATGCCGCTTG CTCCGGAGAA GGTGGGTGCC GGGCAGGGGC

TGCTCCAGCC GCCTCACCTC TGCTGGGAGG ACAAACTGTC CCAGCACAGA GGGAGGGAGG GAGGGCAGGC

AGCGGGGAGA AGTTTCCCTG TGGTCGTGGG GAGTT GAGCTCTTCA ATATTTTAGT GAAAGCTATA GATGAGGCTC

CATAGGGGAT AAAGCACAGA CACACCTTTT CAGAGGGCTT GTGGACTCTG GCAGCCTGT CCATAGACCT

CTGTCCCCAA CTGGCAAGTC AGGAAACTCC AGATTAAGGA GCCCCAATGT GGTTGAACAG CCAGGTGCAC

AGATGAGTCA ACCACACAGC CAGGCCAGGG AGGGCCTTCA CTCAAGAGCC TACAGCCAGT TCACAGCCAA

GCCAGGGCTA GCGCCAGGCC ACCCATAAAC TGATCTGAGA CTCTGTTTCC CTGTCTCCAT GATGATGGGA

TCAGGCTTGA TTGCTGGTTT GTAGGCTTGT TATGAATCAA GTCACAGGGA AGAGGAGCTG ATGGGCTGGG

GGGACGTCCT CTGGCCCTCC TGTCTCTTCC CCAGATCCAC TGGGCCCACT CTTATCTGTT CTCTTCTGAA

GGAAGGGTTT TAAGGCTTCA AAAAAAAATG TTTTGAAAGT CCCTGCCCTT TCCAGCTCCT ACCGTCTCAG

CCCTGGGAGT GTAAAGTGCT GCAGATAGTT AGTAAGTCTT TGAGCAAAAC TGAGAAAGCC AGCCTGAGCC

TTGACATGGG AGAAACCTCC GCCATACATC TCCGAAGAAA CGGCCGCGTG TCTCAGGGGA GCGCAAACAC

CCGTACCCAG GAAACAGGAC AGCTTCTGCC ACTGTCGCCC TTGGGAGCCG TACGTGGCAT GACAAAGAAA

TCCCAGGACT CCGCCTGCCC ACCTGGCCAC CCTCTGTTTA CACCTTCCGC GTAAACGCCC ACTGTTTACA

TCCAAAACTC AGACACAAAA TAACCACCTC AAGAAGATAA ATAATGATAA GAAATAAATG TTACGCGAGG

CAAATTTATT CACATGGGGC TTCCCAGGCC ACTTTGTGGT CAGCCGGGAG GGACGTTTTT GCCGTCCCAC

GACTCCAACG GGCAGCCGGG CCTACGCAAA CATGGAAATC TTCCAAGAGC CTCCCTGGCC CCCAGGGCTC
```

AGAGGGTGGC AGAGCGGAGA GCGAAGGTGG CCGCAGCCTT CCCGGCCCCA CAGCCAGCCT GGCTCCAGCT

GGGCAGGAGT GCAGAGCTCA GCTGGAGGCG AGGGGGAAGT GCCCAGGAGG CTGATGACAT CACTACCCAG

CCCTTCAAAG ATGAGCTGTT CCCGCCGCCA CTCCAGCTCT GGCTTCTGGG CTCCGAGGAG GGGTGGGGAC

GGTGGTGACG GTGCGGACAT CAGGCTGCCC CGCAGTACCA GGGAGCGACT GAAGTGCCCA TGCCGCTTGC

TCCGGAGAAG GTGGGTGCCG GGCAGGGGCT GCTCCAGCCG CCTCACCTCT GCTGGGAGGA CAAACTGTCC

CAGCACAGAG GGAGGGAGGG AGGGCAGGCA GCGGGGAGAA GTTTCCCTGT GGTCGTGGGG AGTTGGGAAA

AGTTCCCTTC CTTCCGGAGG GAGG-3' (FRAG. NO:2275)(SEQ. ID NO:3018)

5'- GAGCTCTTCA ATATTTTAGT GAAAGCTATA GATGAGGCTC CATAGGGGAT AAAGCACAGA CACACCTTTT

CAGAGGGCTT GTGCACTCTG GCAGCCTGT CCATAGACCT CTGTCCCCAA CTGGCAAGTC AGGAAACTCC

AGATTAAGGA GCCCCAATGT GGTTGAACAG CCAGGTGCAC AGATGAGTCA ACCACACAGC CAGGCCAGGG

AGGGCCTTCA CTCAAGAGCC TACAGCCAGT TCACAGCCAA GCCAGGGCTA GCGCCAGGCC ACCCATAAAC

TGATCTGAGA CTCTGTTTCC CTGTCTCCAT GATGATGGGA TCAGGCTTGA TTGCTGGTTT GTAGGCTTGT

TATGAATCAA GTCACAGGGA AGAGGAGCTG ATGGGCTGGG GGGACGTCCT CTGGCCCTCC TGTCTCTTCC

CCAGATCCAC TGGCCCCACT CTTATCTGTT CTCTTCTGAA GGAAGGGTTT TAAGGCTTCA AAAAAAAATG

TTTTGAAAGT CCCTGCCCTT TCCAGCTCCT ACCGTCTCAG CCCTGGGAGT GTAAAGTGCT GCAGATAGTT

AGTAAGTCTT TGAGCAAAAC TGAGAAAGCC AGCCTGAGCC TTGACATGGG AGAAACCTCC GCCATACATC

TCCGAAGAAA CGGCCGCGTG TCTCAGGGGA GCGCAAACAC CCGTACCCAG GAAACAGGAC AGCTTCTGCC

ACTGTCGCCC TTGGGAGCCG TACGTGGCAT GACAAAGAAA TCCCAGGACT CCGCCTGCCC ACCTGGCCAC

CCTCTGTTTA CACCTTCCGC GTAAACGCCC ACTGTTTACA TCCAAAACTC AGACACAAAA TAACCACCTC

AAGAAGATAA ATAATGATAA GAAATAAATG TTACGCGAGG CAAATTTATT CACATGGGGC TTCCCAGGCC

ACTTTGTGGT CAGCCGGGAG GGACGTTTTT GCCGTCCCAC GACTCCAACG GGCAGCCGGG CCTACGCAAA

CATGGAAATC TTCCAAGAGC CTCCCTGGCC CCCAGGGCTC AGAGGGTGGC AGAGCGGAGA GCGAAGGTGG

CCGCAGCCTT CCCGGCCCCA CAGCCAGCCT GGCTCCAGCT GGGCAGGAGT GCAGAGCTCA GCTGGAGGCG

AGGGGGAAGT GCCCAGGAGG CTGATGACAT CACTACCCAG CCCTTCAAAG ATGAGCTGTT CCCGCCGCCA

CTCCAGCTCT GGCTTCTGGG CTCCGAGGAG GGGTGGGGAC GGTGGTGACG GTGGGACAT CAGGCTGCCC

CGCAGTACCA GGGAGCGACT GAAGTGCCCA TGCCGCTTGC TCCGGAGAAG GTGGGTGCCG GGCAGGGGCT

GCTCCAGCCG CCTCACCTCT GCTGGGAGGA CAAACTGTCC CAGCACAGAG GGAGGGAGGG AGGGCAGGCA

GCGGGGAGAA GTTTCCCTGT GGTCGTGGGG AGTTGGGAAA AGTTCCCTTC CTTCCGGAGG GAGG-3'

(FRAG.NO:2275) (SEQ.ID NO:2461)

5'- GCCCTTCAAA GATGAGCTGT TCCCGCCGCC ACTCCAGCTC TGGCTTCTGG GCTCCGAGGA GGGGTGGGGA

CGGTGGTGAC GGTGGGACA TCAGGCTGCC CCGCAGTACC AGGGAGCGAC TGAAGTGCCC ATGCCGCTTG

CTCCGGAGAA GGTCGGTGCC GGGCAGGGGC TGCTCCAGCC GCCTCACCTC TGCTGGGAGG ACAAACTGTC

CCAGCACAGA GGGAGGGAGG GAGGGCAGGC AGCGGGGAGA AGTTTCCCTG TGGTCGTGGG GAGTT -3' (FRAG.

NO:2275) (SEQ. ID NO:2460)

5'- GCCCTTCAAA GATGAGCTGT TCCCGCCGCC ACTCCAGCTC TGGCTTCTGG GCTCCGAGGA GGGGTGGGGA

CGGTGGGGAC ATCAGGCTGC CCCGCAGTAC CAGGGAGCGA CTGAAGTGCC CATGCCGCTT GCTCCGGAGA

AGGTGGGTGC CGGCCAGGGG CTGCTCCAGC CGCCTCACCT CTGCTGGGAG ACAAACTGT CCCAGCACAG

AGGGAGGGAG GAGGGCAGG CAGCGGGGAG AAGTTTCCCT GTGGTCGTGG GGAGTT-3' (FRAG.NO:2275)(SEQ.ID

NO:2459)

5'- ATGTTCTCTC CCTGGAAGAT ATCAATGTTT CTGTCTGTTC GTGAGGACTC CGTGCCCACC ACGGCCTCTT

```
TCAGCGCCGA CATGCTCAAT GTCACCTTGC AAGGGCCCAC TCTTAACGGG ACCTTTGCCC AGAGCAAATG

CCCCCAAGTG GAGTGGCTGG GCTGGCTCAA CACCATCCAG CCCCCCTTCC TCTGGGTGCT GTTCGTGCTG

GCCACCCTAG AGAACATCTT TGTCCTCAGC GTCTTCTGCC TGCACAAGAG CAGCTGCACG GTGGCAGAGA

TCTACCTGGG GAACCTGGCC GCAGCAGACC TGATCCTGGC CTGCGGGCTG CCCTTCTGGG CCATCACCAT

CTCCAACAAC TTCGACTGGC TCTTTGGGGA GACGCTCTGC CGCGTGGTGA ATGCCATTAT CTCCATGAAC

CTGTACAGCA GCATCTGTTT CCTGATGCTG GTGAGCATCG ACCGCTACCT GGCCCTGGTG AAAACCATGT

CCATGGGCCG GATGCGCGGC GTGCGCTGGG CCAAGCTCTA CAGCTTGGTG ATCTGGGGGT GTACGCTGCT

CCTGAGCTCA CCCATGCTGG TGTTCCGGAC CATGAAGGAG TACAGCGATG AGGGCCACAA CGTCACCGCT

TGTGTCATCA GCTACCCATC CCTCATCTGG GAAGTGTTCA CCAACATGCT CCTGAATGTC GTGGGCTTCC

TGCTGCCCCT GAGTGTCATC ACCTTCTGCA CGATGCAGAT CATGCAGGTG CTGCGGAACA ACGAGATGCA

GAAGTTCAAG GAGATCCAGA CGGAGAGGAG GGCCACGGTG CTAGTCCTGG TTGTGCTGCT GCTATTCATC

ATCTGCTGGC TGCCCTTCCA GATCAGCACC TTCCTGGATA CGCTGCATCG CCTCGGCATC CTCTCCAGCT

GCCAGGACGA GCGCATCATC GATGTAATCA CACAGATCGC CTCCTTCATG GCCTACAGCA ACAGCTGCCT

CAACCCACTG GTGTACGTGA TCGTGGGCAA GCGCTTCCGA AAGAAGTCTT GGGAGGTGTA CCAGGGAGTG

TGCCAGAAAG GGGGCTGCAG GTCAGAACCC ATTCAGATGG AGAACTCCAT GGGCACACTG CGGACCTCCA

TCTCCGTGGA ACGCCAGATT CACAAACTGC AGGACTGGGC AGGGAGCAGA CAGTGAGCAA ACGCCAGCAG

GGCTGCTGTG AATTTGTGTA AGGATTGAGG GACAGTTGCT T-3' (FRAG. NO:2275) (SEQ. ID NO:2458)

5'- ATGTTCTCTC CCTGGAAGAT ATCAATGTTT CTGTCTGTTT GTGAGGACTC CGTGCCCACC ACGGCCTCTT

TCAGCGCCGA CATGCTCAAT GTCACCTTGC AAGGGCCCAC TCTTAACGGG ACCTTTGCCC AGAGCAAATG

CCCCCAAGTG GAGTGGCTGG GCTGGCTCAA CACCATCCAG CCCCCCTTCC TCTGGGTGCT GTTCGTGCTG

GCCACCCTAG AGAACATCTT TGTCCTCAGC GTCTTCTGCC TGCACAAGAG CAGCTGCACG GTGGCAGAGA

TCTACCTGGG GAACCTGGCC GCAGCAGACC TGATCCTGGC CTGCGGGCTG CCCTTCTGGG CCATCACCAT

CTCCAACAAC TTCGACTGGC TCTTTGGGGA GACGCTCTGC CGCGTGGTGA ATGCCATTAT CTCCATGAAC

CTGTACAGCA GCATCTGTTT CCTGATGCTG GTGAGCATCG ACCGCTACCT GGCCCTGGTG AAAACCATGT

CCATGGGCCG GATGGGCGGC GTGCGCTGGG CCAAGCTCTA CAGCTTGGTG ATCTGGGGGT GTACGCTGCT

CCTGAGCTCA CCCATGCTGG TGTTCCGGAC CATGAAGGAG TACAGCGATG AGGGCCACAA CGTCACCGCT

TGTGTCATCA GCTACCCATC CCTCATCTGG GAAGTGTTCA CCAACATGCT CCTGAATGTC GTGGGCTTCC

TGCTGCCCCT GAGTGTCATC ACCTTCTGCA CGATGCAGAT CATGCAGGTG CTGCGGAACA ACGAGATGCA

GAAGTTCAAG GAGATCCAGA CGGAGAGGAG GGCCACGGTG CTAGTCCTGG TTGTGCTGCT GCTATTCATC

ATCTGCTGGC TGCCCTTCCA GATCAGCACC TTCCTGGATA CGCTGCATCG CCTCGGCATC CTCTCCAGCT

GCCAGGACGA GCGCATCATC GATGTAATCA CACAGATCGC CTCCTTCATG GCCTACAGCA ACAGCTGCCT

CAACCCACTG GTGTACGTGA TCGTGGGCAA GCGCTTCCGA AAGAAGTCTT GGGAGGTGTA CCAGGGAGTG

TGCCAGAAAG GGGGCTGCAG GTCAGAACCC ATTCAGATGG AGAACTCCAT GGGCACACTG CGGACCTCCA

TCTCCGTGGA ACGCCAGATT CACAAACTGC AGGACTGGGC AGGGAGCAGA CAGTGAGCAA ACGCCAGCAG

GGCTGCTGTG AATTTGTGTA AGGATTGAGG GACAGTTGCT T-3' (FRAG. NO:2275) (SEQ. ID NO:2457)

5'- TGATCCTATC ACAACCTGAG AGTAGTTTTT ACTCCATTTA CAGGTGAGGT CATTGTGGTT CAAGGACGTT

AAGTAACTTC CCCAGCTCAC ACGGCTTATA AGTAAGGCAG CCAGGATGTG AACCCAGTAG GACTATCTGG

CTGCAAAGTC CCCACCCTCC CTCGCCATCT GTATCCTCCA ATCATCTTCA GTGCTTTGCT GATAGAAGGT

ACGGAAATAC GATGCCACAG ACTGTCCAGG AAGACAGAAA CTAGGCAGAT GGGCTGGCCA TGGTCTCCAA
```

```
GCCAGACTGG AATCTCCAGG TCTGGAATGA TATCATTTTT CTCTTTTAAT AAATTAACTC ACCCACCACA
CGGCTTTGAG AGGCTCAAAG GTGACCAACT CCCTTGGGAG GGCCCCGGTT GATAAGGAAG GAATGTGAAT
CCTCCCATCA CGGAAGCTTC AAGGAGGTCA AGGGTCCAAC ACTTGAGATT GTTAGTGCTG TTGGTGGATA
CTGCAGAATA TCCAGTGGAG CCTCAGATGA AGAACATGAG GCCCCGTTTA GATCCAAGGA TCAGAGGGGG
CTCTGTAAGA CCCAGGGGAG TCAGGTGCAC TGGAGCGCGG GCTGCAGAAA ACAGCCTGAG CTCCACCTCG
GCTTCTCCTT GCCCTGGCTG GTTGTCCTTA ACCCCTGTCT CCTTCTGGAC CAGTTTTTGT CCTTCCCTTG
TGACCTGAGG GGTAACAGCC TCTTTTCCAC TTTCTTTCAG CGCCGACATG CTCAATGTCA CCTTGCAAGG
GCCCACTCTT AACGGGACCT TGCCCAGAG CAAATGCCCC CAAGTGGAGT GGCTGGGCTG GCTCAACACC
ATCCAGCCCC CCTTCCTCTG GGTGCTGTTC GTGCTGGCCA CCCTAGAGAA CATCTTTGTC CTCAGCGTCT
TCTGCCTGCA CAAGAGCAGC TGCACGGTGG CAGAGATCTA CCTGGGGAAC CTGGCCGCAG CAGACCTGAT
CCTGGCCTGC GGGCTGCCCT TCTGGGCCAT CACCATCTCC AACAACTTCG ACTGGCTCTT TGGGGAGACG
CTCTGCCGCG TGGTGAATGC CATTATCTCC ATGAACCTGT ACAGCAGCAT CTGTTTCCTG ATGCTGGTGA
GCATCGACCG CTACCTGGCC CTGGTGAAAA CCATGTCCAT GGGCCGGATG CGCGGCGTGC GCTGGGCCAA
GCTCTACAGC TTGGTGATCT GGGGGTGTAC GCTGCTCCTG AGCTCACCCA TGCTGGTGTT CCGGACCATG
AAGGAGTACA GCGATGAGGG CCACAACGTC ACCGCTTGTG TCATCAGCTA CCCATCCCTC ATCTGGGAAG
TGTTCACCAA CATGCTCCTG AATGTCGTGG GCTTCCTGCT GCCCCTGAGT GTCATCACCT TCTGCACGAT
GCAGATCATG CAGGTGCTGC GGAACAACGA GATGCAGAAG TTCAAGGAGA TCCAGACGGA GAGGAGGGCC
ACGGTGCTAG TCCTGGTTGT GCTGCTGCTA TTCATCATCT GCTGGCTGCC CTTCCAGATC AGCACCTTCC
TGGATACGCT GCATCGCCTC GGCATCCTCT CCAGCTGCCA GGACGAGCGC ATCATCGATG TAATCACACA
GATCGCCTCC TTCATGGCCT ACAGCAACAG CTGCCTCAAC CCACTGGTGT ACGTGATCGT GGGCAAGCGC
TTCCGAAAGA AGTCTTGGGA GGTGTACCAG GGAGTGTGCC AGAAAGGGGG CTGCAGGTCA GAACCCATTC
AGATGGAGAA CTCCATGGGC ACACTGCGGA CCTCCATCTC CGTGGAACGC AGATTCACA AACTGCAGGA
CTGGGCAGGG AGCAGACAGT GAGCAAACGC CAGCAGGGCT GCTGTGAATT TGTGTAAGGA TTGAGGGACA
GTTGCTTTTC AGCATGGGCC CAGGAATGCC AAGGAGACAT CTATGCACGA CCTTGGGAAA TGAGTGTTGA
TGTCTCCGGT AAAACACCGG AGACTAATTC CTGCCCTGCC CAATTTTCGA GGGAGCATGG CTGTGAGGAT
GGGGTGAACT CACGCACAGC CAAGGACTCC AAAATCACAA CAGCATTACT GTTCTTATTT GCTGCCACAC
CTGAGCCAGC CTGCTCCTTC CCAGGAGTGG AGGAGGCCTG GGGGAGGGAG AGGAGTGACT GAGCTTCCCT
CCCGTGTGTT CTCCGTCCCT GCCCCAGCAA GACAACTTAG ATCTCCAGGA GAACTGCCAT CCACGTTTGG
TGCAATGGCT GAGTGCACAA GTGAGTTGTT GCCCTGGGTT TCTTTAATCT ATCAGCTAGA ACTTTGAAGG
ACAATTTCTT GCATTAATAA AGGTTAAGCC CTGAGGGGTC CCTTGATAAC AACCTGGAGA CCAGGATTTT
ATGGCTCCCC TCACTGATGG ACAAGGAGGT CTGTGCCAAA GAAGAATCAA TAAGCACATA TGAGCACTTC
TGTATATCAG TATTGAGCAC TGTAGGCA -3' (FRAG. NO:2275) (SEQ. ID NO:2456)
5'- CTGCAGAAAA CAGCCTGAGC TCCACCTCGG CTTCTCCTTG CCCTGGCTGG TTGTCCTTAA CCCCTGTCTC
CTTCTGGACC AGTTTTTGTC CTTCCCTTGT GACCCTGAGG GGTAACAGCC TCTTTTCCAC TTTCTTTCAG
CGCCGACATG CTCAATGTCA CCTTGCAAGG GCCCACTCTT AACGGGACCT TGCCCAGAG CAAATGCCCC
CAAGTGGAGT GGCTGGGCTG GCTCAACACC ATCCAGCCCC CCTTCCTCTG GGTGCTGTTC GTGCTGGCCA
CCCTAGAGAA CATCTTTGTC CTCAGCGTCT TCTGCCTGCA CAAGAGCAGC TGCACGGTGG CAGAGATCTA
CCTGGGGAAC CTGGCCGCAG CAGACCTGAT CCTGGCCTGC GGGCTGCCCT TCTGGGCCAT CACCATCTCC
AACAACTTCG ACTGGCTCTT TGGGGAGACG CTCTGCCGCG TGGTGAATGC CATTATCTCC ATGAACCTGT
ACAGCAGCAT CTGTTTCCTG ATGCTGGTGA GCATCGACCG CTACCTGGCC CTGGTGAAAA CCATGTCCAT
```

```
GGGCCGGATG CGCGGCGTGC GCTGGGCCAA GCTCTACAGC TTGGTGATCT GGGGGTGTAC GCTGCTCCTG
AGCTCACCCA TGCTGGTGTT CCGGACCATG AAGGAGTACA GCGATGAGGG CCACAACGTC ACCGCTTGTG
TCATCAGCTA CCCATCCCTC ATCTGGGAAG TGTTCACCAA CATGCTCCTG AATGTCGTGG CGTTCCTGCT
GCCCCTGAGT GTCATCACCT TCTGCACGAT GCAGATCATG CAGGTGCTGC GGAACAACGA GATGCAGAAG
TTCAAGGAGA TCCAGACGGA GAGGAGGGCC ACGGTGCTAG TCCTGGTTGT GCTGCTGCTA TTCATCATCT
GCTGGCTGCC CTTCCAGATC AGCACCTTCC TGGATACGCT GCATCGCCTC GGCATCCTCT CCAGCTGCCA
GGACGAGCGC ATCATCGATG TAATCACACA GATCGCCTCC TTCATGGCCT ACAGCAACAG CTGCCTCAAC
CCACTGGTGT ACGTGATCGT GGGCAAGCGC TTCCGAAAGA AGTCTTGGGA GGTGTACCAG GGAGTGTGCC
AGAAAGGGGG CTGCAGGTCA GAACCCATTC AGATGGAGAA CTCCATGGGC ACACTGCGGA CCTCCATCTC
CGTGGAACGC CAGATTCACA AACTGCAGGA CTGGGCAGGG AGCAGACAGT GAGCAAACGC CAGCAGGGCT
GCTGTGAATT TGTGTAAGGA TTGAGGGACA GTTGCTTTTC AGCATGGGCC CAGGAATGCC AAGGAGACAT
CTATGCACGA CCTTGGGAAA TGAGTTGATG TCTCCGGTAA AACACCGGAG ACTAATTCCT GNCCTGCCCA
ATTTTGCAGG GAGCATGGCT GTGAGGATGG GGTGAACTCA CGCACAGCCA AGGACTCCAA AATCACAACA
GCATTACTGT TCTTATTTGC TGCCACACCT GAGCCAGCCT GCTCCTTCCC AGGAGTGGAG GAGGCCTGGG
GGCAGGGAGA GGAGTGACTG AGCTTCCCTC CCGTGTGTTC TCCGTCCCTG CCCCAGCAAG ACAACTTAGA
TCTCCAGGAG AACTGCCATC CAGCTTTGGT GCAATGGCTG AGTGCACAAG TGAGTTGTTG CCCTGGGTTT
CTTTAATCTA TTCAGCTAGA ACTTTGAAGG ACAATTTCTT GCATTAATAA AGGTTAAGCC CTGAGGGGTC
CCTGATAACA ACCTGGAGAC CAGGATTTTA TGGCTCCCCT CACTGATGGA CAAGGGAGGT CTGTGCCAAA
GAAGAATCCA ATAAGCACAT ATTGAGCACT TGCTGTATAT GCAGTATTGA GCACTGTAGG CAAGAGGGAA
GAAAGAGAAG GAGCCATCTC CATCTTGAAG GAACTCAAAG ACTCAAGTGG GAACGACTGG CACTGCCACC
ACCAGAAAGC TGTTCGACGA GACGGTCGAG CAGGGTGCTG TGGGTGATAT GGACAGCAGA AGGGGGAGAC
CAAGGTTCCA GCTCAACCAA TAACTATTGC ACAACCACCT GTCCCTGCCT CAGTTCCCTC TTCTGTAACA
TGAAGTCGTT GTGAGGGTTA AAGGCAGTAA CAGGTATAAA GTACTTAGAA AGCAAAGGG TGCTACGTAC
ATGTGAGGCA TCATTACGCA GACGTAACTG GGATATGTTT ACTATAAGGA AAAGACACTG AGGTCTAGA -3'
(FRAG. NO:2275) (SEQ. ID NO:2455)
5'- AAATGATAGA CCGTCAATAA TTTGTTAAAT GCTTTTTAAA ATGAATGCTT TAAGCCGGGT GCAGTGCCTC
ACATCTGTAA TCCCAGCACT TTGGAGCCGA GCGGGTGGAT TGTGTGAGGT CAGGAGTTCG AGACCAACCT
GGCCAACATG GCAAAACCTC ACTCTCTACC AAAAATACAA AAATTAGCCA GGCATGGTGG CAGGCACCTG
TGATCCCAGC TACTCAGGAG GCTGAGACAG GAGAATCGCT TGAACCCGGG AGGCAAGGTT GCAGTGAGCC
AAGATTACGC CATTGTACTC CAGCCTGGGT GACAGAGAGA GACTCCGTCT CAAAAAAAAA AAAAAAAAA
AAAAAATTAC GCTTCAAACA CATGATCTCT CACCACTGTT GAATTTTCTT TCTATGAGCC CAGGAGGGCC
TCTCAGAGAG GAAAGCTCCT AGGTCTTCCT TTCCCTCTGC AAACTCCCTG CCTTGAAGGT TCAGAAGGAC
TGTGCGTGCT CGTTGCATCC TTTGCAAGTG TCCAAACCCT GATCCCAGCT GTGCTTAGGG GTTCCTGCAA
ACCTTTTCCA GGTGTTAATT ACCTCCCACT TCATTTCCTG TTTACCAACT CAGCTTTTTG TTTTAGTGTG
TTTGAATTCC CTGAACTGAC CGTTGTCTGA TCTCCACCTC CCAACTGAAT TAGGGGAGCT GGGCTTCTGG
AAACCCAGGT GCCGGGTGTT GCAGAGTGGC TGAAAGCTGG GATGTGGCAG ATCCGTGGCT ACATTCATGC
ACACACACAC ACCCACATAC CCACACATGC ACACACACAC ACACACCCGC ACTCACACAC TTGGACATGC
ATAGACCACA GCTTTCCACA CCCTTCCTAG ACAGGGTCA CTTGGTATCC TGGAGAGAGT GTGAAGTCCT
GGAATGGAAA GAGGGGGGAT TAAGCCCCAC CTCTAGCCAT GGGACTGAGA CAAGTCACCA CCAACCCATC
```

```
TGCGCCTTGT TTACCTCCTC TGTGAGGCAA GCACAGAGCC CATGCCTGCC CCCCTGGATG GGAGTGATGT
GAAACTTGAA GGGCGGTCAG AGCAAGGGTC GGGAATGGAA GGCCCTTGGG AAAAAAGGCC CTTTCAACTA
GGGGCACAGA GGAGGCCCTG GGCTGAGAAC TTGACAGCAC CTTGTAATTG GTAAGCCAAG CCCGAAGGGA
CTGGAAATAC TCAGATGTGT CTGTCTCCCT TATTAGGTTC AAAGTCCCTC AAGACCCTGT CTCCATCACA
GTGCTCCAGT CCAGACCCCT CCTCTGAGCT CCAGACCCTG CTGGACCCAA CCAGCCCTAT GGGGTCGCAT
CCCCACCTGC CTGGAATTCT CCAAAGAACC TCCCCTTTAA CAGTTCCAGC CTTTAACAGT TCCAGTCTAA
ACACATGACC TTTCTCCTCT AAATCAGCCC CCCATCTCTG CCTTTGCAGG AGATGGAAGC CATGCACCT
GCCTCGCCCC TGTCCTCACC CCATCCATGT CCAATCAAGC ACTAGGCATG TCAGGTTTAC CCTCTAAACT
CCTCTGGAAT CCAGTCTCTC AGTCTCCATC ATCCCAGGTC GAAGCTAATG GGCTAACTGG TCCTTGCTTC
CACTCTACCC CCACTGCAGT CCTGACTTCC TGAGCAGCAG CCAGGGCCTA ATCGATATTC ACACCAAGCG
CCAACCTGAC TGACATATCC TCCTGCACCA TCATCCCTCC ACCCTGTTTA GTTCTGCTCA CCCTCAGTGT
TCTCATCAAT AATCCACTCC CCTCACAGGC GCGTTTGGGA CCCCATGTTC TATGCTCTCA CAGGACCTTT
TGCTTGATTT TTCACTGTAC TTAGGTCAGT TTGCAGTTAT TAAGTGACTG AGCAATGTCT GGCTTCTCCA
GTAGACTGTC AGCTCCTAGC CATTGTATAC CTAGCACCGC TGTGTGGGAG CACGTGACAA ACGTCCAGTG
AGTCAGGGAC TCAGCAGTCT CCATTTCTCC GCCCTGCTGG AGAATGCGTG TATTTGGCAA TCCCCAGCCC
CTGTGCCATC TAACCATCTT TTCTTCTCTG TTCAGCCCAG GTGTGGCCTC ACTCACATCC CACTCTGAGT
CCAAATGTTC TCTCCCTGGA AGATATCAAT GTTTCTGTCT GTTCGTGAGG ACTCCGTGCC CACCACGGCC
TCTTTCAGGT GAGTCAAAGG GATTCCTCAG TTCACTAGTT AGGGGAGGTG GGCAGACACC CTGGAGAACT
CCCTGGAAAG CTCAACTCTC ATGCCCCGGA CAACAGTTGA AGGAACCATG GTGATGTTAA GCCCAAAGAC
AAAACCTCTC AGGTGTCCAA GTCCCTGTTG GAATCTTGGG AGCAGAGGGA ATGTTCTGTG GTCTAGAGGA
AGAGGGGCTC AGGGAGGAGA AGGGCACATT CCTGGTTGTT ATATGTTTCT ATCTATCCCA GATGAACTTG
GAAGTGAAGG GAAGAGAGTT AAACATTAAA GTAAATACCC AGTGGATCAG ACAGCAATGT GCCAGATTGC
CTTGGAAACA AAATATCTCC AACACATGGC TGACATTTGG TGGGAGATCA GAACACCCTA AAGAGAGAAT
TTAAGGGGAG GGGGAGGAGG ACCTGAGCCA GAGTAGAAGC AGAGGATAGG GAGATCTGTT CTTGGGGACA
GCATTTGCAA GAAACAAGGC TGAGGGGTCC ACTCCAACCT CTCCACCCTG CTGCAGGTGC TGCCTATGAT
GAAGATGAGC AGATGGCCAT CTCAGCTGGG GCCACAGTGC ACTGGACCTA TAGTTTCAA TTCCGCACTC
AGCAGGCATC TTTCTGATGA TCCGATGGCT TCTCAGAGCC AGGGATGGGC CAGGATCCAT CCCCTTGGCT
ACTGTCTTGC TGAGAAATTT ATAAGCAGCA TCTGGTGCTA TACTTTGGTC TCTAGTGAGT TAGCTCATGA
AAGATGATAG ACTCTCCAAG CCAGGGGTAT GCAGGAAATG GGTTTTCTGT AGCTACAGAA ATGGGGTTGA
GGGTTGGACC AAGGGACTAC CCAGGGGAAG TCTTACCTTC AGAGGACTCT GGAAAGGAGG CTGCAAGTTT
TCATGGGTCA AGAATTCAGA GCCCAGTAGA GACAGCTTAT CTCTGTTCCA AGATGTCTGG GGCCTTGGTT
GGAAGATTCA AAGGCTAGGA AACCAGGAGC CACCAAAAGC GTAACTGGGG CCAGAGGATC CACTTTCAAG
GTGGCAAGTT GGTTCCCCCC ATGTGGCTGC TTGAGTATCC TCACATGGCG GCTCACATCC TTCCAAGTAA
GCAATGCAAA AGGCCAAGAA AGATGCTGCA AAGATGTTAT GACCTAGCCT CAGAAATCAC ACACCATCCC
TGCCACCATT AGTAAGAAGT CCAGCCCACG TCCAGGAGAA GAGGAAGCAG ATTCCTCCTT TTGAAATGAA
GAATATCAAG TAATTCGGGG GGCATATGAA AGCCACCACA CACCACAGGG ATCTTTTTAG AGCATACTTC
TTATACCATC ACTGTAGTTC CTTAAGACTC AGGGGCAAAG CCTCACTTCC TTAGCACCCA GTGAAGACCA
CGCTTACTCC CTCACTCAAC CTCTTGCTAC TTCCCACCTC TCCTGTCCAA CATCTAGTGT CACTTTCCAG
AACATACCAA CAGCTTCCCC AGTTCTGTGC CTCTGCTCAG GCTGTTCCCC CTGCCTGGTC CACTTGTCCT
CCTTCTTGTC CGGTCAAAAT GCTTCTTATC CTTCAAGACC CAGCTCTAGA GTCACCTCCA ACCCCTTACC
```

-continued

```
CACCAGCCCC CTCTCCAAGT CTGTGTCCCA CAACCCCCCT GCTCCCTCCA GGGCACCCTC CACCCTCTGG

GCCACAGTTG TCAGGAGTCA GGCAGGGCAG GGGCCGGGTG GTGTCTTCTT TGTGTTCTTG CACTCAGGGC

AGAGCTCAGC ACAGAGCAGA CGCTCAAAAA ACATTTAAAG GATAGAAGCA TTGATTTGTG GGTCCCCCAG

TCTGGCTCCA GGATGCCAGC CAGCTGCTCC TAGAAGCAAA CGGACTTTTC CTGGGAAATC CCAGAGGTGA

TGATCAGTAA TCTCTCCCGT GACTCGTAGT TCAGCTCTTC CTCCATGAGC CTGACTATCA GTGGACCTTC

CAGAAAGAGC CCCTTTTCCT TCTCTCACCC ACAGCACAGG GCACTGGGAA AATGCCCAAT GAGTCCTGCC

TCTGGGTTGT GCTTTGGACT TTTCAGTGTG TCTCGCATCC ACTCTTCAAC TTGAATGTTG CAACAGCCAT

GAAAAAGAA ATGCAAAGCG ATTCAGGATG AGAGCAATAC CCTACTCCAA AGAAGGCAAC ATAGAAGCTC

AGAGAGATCA AGCAATTTGC CCAAGACCAC ACAGCTAGGA GTGGAACTCA TGGCTGTCCA AGCCCCATGC

CTCTGCTGAA GGTAGAGATG AATTACAGCA ACAAGTCTAG AAAGGTGCCT GCCCTATGGT CTGTGAGTCT

TGCCTAAGAA TGAAAGAGGA GCCAGTGGGT TAAAGATGAG GTCACCAACA ACGGTGGTGT TGGAGTTTAC

CACTGATAAT AAGGGTGCAA AATGTAAATT ACTAATGTTT ATTGAGCCTA GTGCAGTCG TGGGGCATTT

TGCACATTGT CTCTGATCCC TATGACAACC CTGAGAGGTA GTGGTTTTAA CTGCCATGTT ACAGGTGAGG

TCATTGTGGT TCAAGGACGT TAAGTAACTT CCCCAGCGTG ACACGGCTTA TAAGTAAGGC AGCCAGGATG

TGAACCCAGT AGGACTATCT GGCTGCAAAG TCCCCACCCC CCTCGCCATC TGTATCCTCC AATCACTTCA

GTGCTTTGCT GCATAGAAGG TAACGGAAAT CACGATGCCA CAGACTGTCC AGGAAGACAG AAACTAGGCA

GATGGGCTGG CCATGGTCTC CAAGCCAGAC TGGAATCTCC AGGTCTGAA TGATATCATT TTTCTCTTTT

AATAAATTAA CTCACCCACC ACACGGCTTT GAGAGGCTCA AAGTTGACCA ACTCCCTTGG GAGGGCCCCG

GTTGATAAGG AAGGAACGTG AATCCTCCCA TCACGGAAGC TTCAAGGAGG TCAAGGGTCC AACACTTGAG

ATTGTTAGTG CTGTTGGTGG ATACTGGCCA AGGAAATATC CCAGTGGAGC CTCGAGATGA AGAACATGAG

GCCCCCGTTT AGAACCAAGG ATCAGAGGGG GCTCTGTAAG ACCCAGGGGA GTCAGGTGCA CTGGAGCGCG

GGCATGCAGA AAACAGCCTG AGCTCCACCT CGGCTTCTCC TTGTCCTGGC TGGTTGTCCT TAACCCCTGT

CTCCTTCTGG ACCAGTTTTT GTCCTTCCCT TGTGACCGCT GAGGGGTAAC AGCCTCTTTC CACTTTCTTT

CAGCGCCGAC ATGCTCAATG TCACCTTGCA AGGGCCCACT CTTAACGGGA CCTTTGCCCA GAGCAAATGC

CCCCAAGTGG AGTGGCTGGG CTGGCTCAAC ACCATCCAGC CCCCCTTCCT CTGGGTGCTG TTCGTGCTGG

CCACCCTAGA GAACATCTTT GTCCTCAGCG TCTTCTGCCT GCACAAGAGC AGCTGCACGG TGGCAGAGAT

CTACCTGGGG AACCTGGCCG CAGCAGACCT GATCCTGGCC TGCGGGCTGC CCTTCTGGGC CATCACCATC

TCCAACAACT TCGACTGGCT CTTTGGGGAG ACGCTCTGCC GCGTGGTGAA TGCCATTATC TCCATGAACC

TGTACAGCAG CATCTGTTTC CTGATGCTGG TGAGCATCGA CCGCTACCTG GCCCTGGTGA AAACCATGTC

CATGGGCCGG ATGCGCGGCG TGCGCTGGGC CAAGCTCTAC AGCTTGGTGA TCTGGGGGTG TACGCTGCTC

CTGAGCTCAC CCATGCTGGT GTTCCGGACC ATGAAGGAGT ACAGCGATGA GGGCCACAAC GTCACCGCTT

GTGTCATCAG CTACCCATCC CTCATCTGGG AAGTGTTCAC CAACATGCTC CTGAATGTCG TGGGCTTCCT

GCTGCCCCTG AGTGTCATCA CCTTCTGCAC GATGCAGATC ATGCAGGTGC TGCGGAACAA CGAGATGCAG

AAGTTCAAGG AGATCCAGAC GGAGAGGAGG GCCACGGTGC TAGTCCTGGT TGTGCTGCTG CTATTCATCA

TCTGCTGGCT GCCCTTCCAG ATCAGCACCT TCCTGGATAC GCTGCATCGC CTCGGCATCC TCTCCAGCTG

CCAGGACGAG CGCATCATCG ATGTAATCAC ACAGATCGCC TCCTTCATGG CCTACAGCAA CAGCTGCCTC

AACCCACTGG TGTACGTGAT CGTGGGCAAG CGCTTCCGAA AGAAGTCTTG GGAGGTGTAC CAGGGAGTGT

GCCAGAAAGG GGGCTGCAGG TCAGAACCCA TTCAGATGGA GAACTCCATG GCACACTGC GGACCTCCAT

CTCCGTGGAA CGCCAGATTC ACAAACTGCA GGACTGGGCA GGGAGCAGAC AGTGAGCAAA CGCCAGCAGG
```

```
GCTGCTGTGA ATTTGTGTAA GGATTGAGGG ACAGTTGCTT TTCAGCATGG GCCCAGGAAT GCCAAGGAGA

CATCTATGCA CGACCTTGGG AAATGAGTTG ATGTCTCCGG TAAAACACCG GAGACTAATT CCTGCCCTGC

CCAATTTTGC AGGGAGCATG GCTGTGAGGA TGGGGTGAAC TCACGCACAG CCAAGGACTC CAAAATCACA

ACAGCATTAC TGTTCTTATT TGCTGCCACA CCTGAGCCAG CCTGCTCCTT CCCAGGAGTG GAGGAGGCCT

GGGGGCAGGG AGAGGAGTGA CTGAGCTTCC CTCCCGTGTG TTCTCCGTCC CTGCCCCAGC AAGACAACTT

AGATCTCCAG GAGAACTGCC ATCCAGCTTT GGTGCAATGG CTGAGTGCAC AAGTGAGTTG TTGCCCTGGG

TTTCTTTAAT CTATTCAGCT AGAACTTTGA AGGACAATTT CTTGCATTAA TAAAGGTTAA GCCCTGAGGG

GTCCCTGATA ACAACCTGGA GACCAGGATT TTATGGCTCC CCTCACTGAT GGACAAGGAG GTCTGTGCCA

AAGAAGAATC CAATAAGCAC ATATTGAGCA CTTGCTGTAT ATGCAGTATT GAGCACTGTA GGCAAGAGGG

AAGAAAGAGA AGGAGCCATC TCCATCTTGA AGGAACTCAA AGACTCAAGT GGGAACGACT GGGCACTGCC

ACCACCAGAA AGCTGTTCGA TGAGACGGTC GAGCAGGGTG CTGTGGGTGA TATGGACAGC AGAAGGGGGA

GCCAGGTTCC AGCTCACCAA TACTATTGCA CACCACCTGT CCTGCCTC-3' (FRAG. NO:2275) (SEQ. ID NO:2454)

5'- CAGATTCACA AACTGCAGGA CTGGGCAGGG AGCAGACAGT GAGCAAACGC CAGCAGGGCT GCTGTGAATT

TGTGTAAGGA TTGAGGGACA GTTGCTTTTC AGCATGGGCC CAGGAATGCC AAGGAGACAT CTATGCACGA

CCTTGGGAAA TGAGTTGATG TCTCCGGTAA ACACCGGAG ACTAATTCCT GCCCTGCCCA ATTTTGCAGG

GAGCATGGCT GTGAGGATGG GGTGAACTCA CGCACAGCCA AGGACTCCAA ATCACAACA GCATTACTGT

TCTTATTTGC TGCCACACCT GAGCCAGCCT GCTCCTTCCC AGGAGTGGAG GAGGCCTGGG GGGAGGGAGA

GGAGTGACTG AGCTTCCCTC CCGTGTGTTC TCCGTCCCTG CCCCAGCAAG ACAACTTAGA TCTCCAGGAG

AACTGCCATC CAGCTTTGGT GCAATGGCTG AGTGCACAAG TGAGTTGTTG CCCTGGGTTT CTTTAATCTA

TTCAGCTAGA ACTTTGAAGG ACAATTTCTT GCATTAATAA AGGTTAAGCC CTGAGGGGTC CCTGATAACA

ACCTGGAGAC CAGGATTTTA TGGCTCCCCT CACTGATGGA CAAGGAGGTC TGTGCCAAAG AAGAATCCAA

TAAGCACATA TTGAGCACTT GCTGTATATG CAGTATTGAG CACTGTAGGC AAGACCCAAG AAAGAGAAGG

AGCCATCTCC ATCTTGAAGG AACTCAAAGA CTCAAGTGGG AACGACTGGG CACTGCCACC ACCAGAAAGC

TGTTCGACGA GACGGTCGAG CAGGGTGCTG TGGGTGATAT GGACAGCAGA AGGGGGAGAC CAAGGTTCCA

GCTCAACCAA TAACTATTGC ACAACCACCT GTCCCTGCCT CAGTTCCCTT TTATGTAACA TGAAGTCGTT

GTGAGGGTTA AAGGCAGTAA CAGGTATAAA GTACTTAGAA AAGCAAAGGG TGCTACGTAC ATGTGAGGCA

TCATTACGCA GACGTAACTG GGATATGTTT ACTATAAGGA AAAGACACTG AGGTCTAGAA ATAGCTCCGT

GGAGCAGAAT CAGTATTGGG AGCCGGTGGC GGTGTGAAGC ACCAGTGTCT GGCACACAGT AGGTGCTCAT

TGGCTCCCTT CCACCTGTCA TTCCCACCAC CCTGAGGCCC CAACCGCCAC ACACACAGGA GCATTTGGAG

AGAAGGCCAT GTCTTCAAAG TCTGATTTGT GATGAGGCAG AGGAAGATAT TTCTAATCGG TCTTGCCCAG

AGGATCACAG TGCTGAGACC CCCCACCACC AGCCGGTACC TGGGAAGGGG GAGAGTGCAG GCCTGCTCAG

GGACTGTTCC TGTCTCAGCA ACCAAGGGAT TGTTCCTGTC AATCAATGGT TATTGGAAG GTGGCCCAGT

ATGAGCCCTA GAAGAGTGTG AAAAGGAATG GCAATGGTGT TCACCATCGG CAGTGCCAGG GCAGCACTCA

TTCACTTGAT AAATGAATAT TTATTAGCTG GTTGGAGAGC TAGAACCTGG AGAGCTAGAA CCTGGAGAAC

TAGAACCTGG AGGGCTAGAA CCTGGAGAGG CTAGAACCAA GAAGGGCTAG AACCTGGAGG GCTAGAACC

TAGAGAAGCT AAAACCTGAG CTAGAAGCTG GAGGACTAGA ACCTGGAGGG CTGGAATCTG AAGGGCTAGA

ACCTGGAGGG CTGGAATCTG GAGAGCTAGA ACCTGGAGGG CTAGAACCTG GAGGGCTAGA ACCTAGAAGG

GCTAGAACCT GGAGGGCTGG AATCTGGAGA GCTAGAACCT GGAGGGCTAG AACCTGGAGG GCTAGAACCT

AGAAGGGCTA GAACCTGGAG GGCTAGAACC TGGCAGGTTA GAACCTAGAA GGGCTAGAAC CTGGAGAGCC

AGAACCTGGA GGGCTAGAAC CTGGAAGGGC TAGAACCTGT AGAGCTAGAA CATGGAGAGC TAGAACCCGG
```

```
CAGGCTAGAA CCTGGCAAGC TAGAACCTGG AGGGAATGAA CCTGGAGGGC TAGAACCTGG AGAATGAGAA

AAATTTACAT GGCAAAGAGC CCATAAATCC TGACCAATCC AACTCTGAAT TTTAAAGCAA AAGCGTGAAA

AAAAAGATTC CCTCCTTACC CCCAACCCAC TCTTTTTTCC CACCACCCAC TCTCCTCTGC CTCAGTAAGT

ATCTGGAGGA AGAAAACAGG TGAAAGAAGA AGTAAAAACC ATTTAGTATT AGTATTAGAA TGAAGTCAAA

CTGTGCCACA CATGGTGAAT GAAAAAAAAA AAAAAGAGGC TGTGTTTTGT CACACAGGGC AGTCATTCAG

CACCAGAGCA CGTGATGGTC TGAGACTCTC TTAGGAGCAG AGCTCTGCCG CAATGGCCAT GTGGGGATCC

ACACCTGGTC TGAGGGGCAA CTGAGTCTGC GGGAGAAGAG CGGCCCTATG CATGGTGTAG ATGCCCTGAT

AAAGAACATC TGTCCTGTGA AAGACTCAAT GAGCTGTTAT GTTGTAAACA GGAAGCATTT CACATCCAAA

CGAGAAAATC ATGTAAACAT GTGTCTTTTC TGTAGAGCAT AATAAATGGA TGAGGTTTTT GCAAAAAAAA

AAAAAAAAA-3' (FRAG. NO:2275) (SEQ. ID NO:2453)
```

5'- GAGCTCTTCA ATATTTTAGT GAAAGCTATA GATGAGGCTC CATAGGGGAT AAAGCACAGA CACACCTTTT

CAGAGGGCTT GTGGACTCTG GCAGCCTGT CCATAGACCT CTGTCCCCAA CTGGCAAGTC AGGAAACTCC

AGATTAAGGA GCCCCAATGT GGTTGAACAG CCAGGTGCAC AGATGAGTCA ACCACACAGC CAGGCCAGGG

AGGGCCTTCA CTCAAGAGCC TACAGCCAGT TCACAGCCAA GCCAGGGCTA GCGCCAGGCC ACCCATAAAC

TGATCTGAGA CTCTGTTTCC CTGTCTCCAT GATGATGGGA TCAGGCTTGA TTGCTGGTTT GTAGGCTTGT

TATGAATCAA GTCACAGGGA AGAGGAGCTG ATGGGCTGGG GGGACGTCCT CTGGCCCTCC TGTCTCTTCC

CCAGATCCAC TGGGCCCACT CTTATCTGTT CTCTTCTGAA GGAAGGGTTT TAAGGCTTCA AAAAAAAATG

TTTTGAAAGT CCCTGCCCTT TCCAGCTCCT ACCGTCTCAG CCCTGGGAGT GTAAAGTGCT GCAGATAGTT

AGTAAGTCTT TGAGCAAAAC TGAGAAAGCA AGCCTGAGCC TTGACATGGG AGAAACCTCC GCCATACATC

TCCGAAGAAA CGGCCGCGTG TCTCAGGGGA GCGCAAACAC CCGTACCCAG GAAACAGGAC AGCTTCTGCC

ACTGTCGCCC TTGGGAGCCG TACGTGGCAT GACAAAGAAA TCCCAGGACT CCGCCTGCCC ACCTGGCCAC

CCTCTGTTTA CACCTTCCGC GTAAACGCCC ACTGTTTACA TCCAAAACTC AGACACAAAA TAACCACCTC

AAGAAGATAA ATAATGATAA GAAATAAATG TTACGCGAGG CAAATTTATT CACATGGGGC TTCCCAGGCC

ACTTTGTGGT CAGCCGGGAG GGACGTTTTT GCCGTCCCAC GACTCCAACG GGCAGCCGGG CCTACGCAAA

CATGGAAATC TTCCAAGAGC CTCCCTGGCC CCCAGGGCTC AGAGGGTGGC AGAGCGGAGA GCGAAGGTGG

CCGCAGCCTT CCCGGCCCCA CAGCCAGCCT GGCTCCAGCT GGGCAGGAGT GCAGAGCTCA GCTGGAGGCG

AGGGGGAAGT GCCCAGGAGG CTGATGACAT CACTACCCAG CCCTTCAAAG ATGAGCTGTT CCCGCCGCCA

CTCCAGCTCT GGCTTCTGGG CTCCGAGGAG GGTGGGGAC GGTGGTGACG GTGGGGACAT CAGGCTGCCC

CGCAGTACCA GGGAGCGACT GAAGTGCCCA TGCCGCTTGC TCCGGAGAAG GTGGGTGCCG GGCAGGGGCT

GCTCCAGCCG CCTCACCTCT GCTGGGAGGA CAAACTGTCC CAGCACAGAG GGAGGGAGGG AGGGCAGGCA

GCGGGGAGAA GTTTCCCTGT GGTCGTGGGG AGTTGGGAAA AGTTCCCTTC CTTCCGGAGG GAGG-3'

(FRAG. NO:2275) (SEQ.ID NO:2452)

5'- GCCCTTCAAA GATGAGCTGT TCCCGCCGCC ACTCCAGCTC TGGCTTCTGG GCTCCGAGGA GGGGTGGGGA

CGGTGGTGAC GGTGGGGACA TCAGGCTGCC CCGCAGTACC AGGGAGCGAC TGAAGTGCCC ATGCCGCTTG

CTCCGGAGAA GGTGGGTGCC GGGCAGGGGC TGCTCCAGCC GCCTCACCTC TGCTGGGAGG ACAAACTGTC

CCAGCACAGA GGGAGGGAGG GAGGGCAGGC AGCGGGGAGA AGTTTCCCTG TGGTCGTGGG GAGTT -3'

(FRAG.NO:2275) (SEQ.ID NO:2451)

5'- GCCCTTCAAA GATGAGCTGT TCCCGCCGCC ACTCCAGCTC TGGCTTCTGG GCTCCGAGGA GGGGTGGGGA

CGGTGGGGAC ATCAGGCTGC CCCGCAGTAC CAGGGAGCGA CTGAAGTGCC CATGCCGCTT GCTCCGGAGA

-continued

AGGTGGGTGC CGGGCAGGGG CTGCTCCAGC CGCCTCACCT CTGCTGGGAG GACAAACTGT CCCAGCACAG
AGGGAGGGAG GGAGGGCAGG CAGCGGGGAG AAGTTTCCCT GTGGTCGTGG GGAGTT-3' (FRAG.NO:2275) (SEQ.
ID NO:2450)

5'- ATGTTCTCTC CCTGGAAGAT ATCAATGTTT CTGTCTGTTC GTGAGGACTC CGTGCCCACC ACGGCCTCTT
TCAGCGCCGA CATGCTCAAT GTCACCTTGC AAGGGCCCAC TCTTAACGGG ACCTTTGCCC AGAGCAAATG
CCCCCAAGTG GAGTGGCTGG GCTGGCTCAA CACCATCCAG CCCCCCTTCC TCTGGGTGCT GTTCGTGCTG
GCCACCCTAG AGAACATCTT TGTCCTCAGC GTCTTCTGCC TGCACAAGAG CAGCTGCACG GTGGCAGAGA
TCTACCTGGG GAACCTGGCC GCAGCAGACC TGATCCTGGC CTGCGGGCTG CCCTTCTGGG CCATCACCAT
CTCCAACAAC TTCGACTGGC TCTTTGGGGA GACGCTCTGC CGCGTGGTGA ATGCCATTAT CTCCATGAAC
CTGTACAGCA GCATCTGTTT CCTGATGCTG GTGAGCATCG ACCGCTACCT GGCCCTGGTG AAAACCATGT
CCATGGGCCG GATGCGCGGC GTGCGCTGGG CCAAGCTCTA CAGCTTGGTG ATCTGGGGGT GTACGCTGCT
CCTGAGCTCA CCCATGCTGG TGTTCCGGAC CATGAAGGAG TACAGCGATG AGGGCCACAA CGTCACCGCT
TGTGTCATCA GCTACCCATC CCTCATCTGG GAAGTGTTCA CCAACATGCT CCTGAATGTC GTGGGCTTCC
TGCTGCCCCT GAGTGTCATC ACCTTCTGCA CGATGCAGAT CATGCAGGTG CTGCGGAACA ACGAGATGCA
GAAGTTCAAG GAGATCCAGA CGGAGAGGAG GGCCACGGTG CTAGTCCTGG TTGTGCTGCT GCTATTCATC
ATCTGCTGGC TGCCCTTCCA GATCAGCACC TTCCTGGATA CGCTGCATCG CCTCGGCATC CTCTCCAGCT
GCCAGGACGA GCGCATCATC GATGTAATCA CACAGATCGC CTCCTTCATG GCCTACAGCA ACAGCTGCCT
CAACCCACTG GTGTACGTGA TCGTGGGCAA GCGCTTCCGA AAGAAGTCTT GGGAGGTGTA CCAGGGAGTG
TGCCAGAAAG GGGGCTGCAG GTCAGAACCC ATTCAGATGG AGAACTCCAT GGGCACACTG CGGACCTCCA
TCTCCGTGGA ACGCCAGATT CACAAACTGC AGGACTGGGC AGGGAGCAGA CAGTGAGCAA ACGCCAGCAG
GGCTGCTGTG AATTTGTGTA AGGATTGAGG GACAGTTGCT T-3' (FRAG. NO:2275) (SEQ. ID NO:2449)

5'- ATGTTCTCTC CCTGGAAGAT ATCAATGTTT CTGTCTGTTT GTGAGGACTC CGTGCCCACC ACGGCCTCTT
TCAGCGCCGA CATGCTCAAT GTCACCTTGC AAGGGCCCAC TCTTAACGGG ACCTTTGCCC AGAGCAAATG
CCCCCAAGTG GAGTGGCTGG GCTGGCTCAA CACCATCCAG CCCCCCTTCC TCTGGGTGCT GTTCGTGCTG
GCCACCCTAG AGAACATCTT TGTCCTCAGC GTCTTCTGCC TGCACAAGAG CAGCTGCACG GTGGCAGAGA
TCTACCTGGG GAACCTGGCC GCAGCAGACC TGATCCTGGC CTGCGGGCTG CCCTTCTGGG CCATCACCAT
CTCCAACAAC TTCGACTGGC TCTTTGGGGA GACGCTCTGC CGCGTGGTGA ATGCCATTAT CTCCATGAAC
CTGTACAGCA GCATCTGTTT CCTGATGCTG GTGAGCATCG ACCGCTACCT GGCCCTGGTG AAAACCATGT
CCATGGGCCG GATGCGCGGC GTGCGCTGGG CCAAGCTCTA CAGCTTGGTG ATCTGGGGGT GTACGCTGCT
CCTGAGCTCA CCCATGCTGG TGTTCCGGAC CATGAAGGAG TACAGCGATG AGGGCCACAA CGTCACCGCT
TGTGTCATCA GCTACCCATC CCTCATCTGG GAAGTGTTCA CCAACATGCT CCTGAATGTC GTGGGCTTCC
TGCTGCCCCT GAGTGTCATC ACCTTCTGCA CGATGCAGAT CATGCAGGTG CTGCGGAACA ACGAGATGCA
GAAGTTCAAG GAGATCCAGA CGGAGAGGAG GGCCACGGTG CTAGTCCTGG TTGTGCTGCT GCTATTCATC
ATCTGCTGGC TGCCCTTCCA GATCAGCACC TTCCTGGATA CGCTGCATCG CCTCGGCATC CTCTCCAGCT
GCCAGGACGA GCGCATCATC GATGTAATCA CACAGATCGC CTCCTTCATG GCCTACAGCA ACAGCTGCCT
CAACCCACTG GTGTACGTGA TCGTGGGCAA GCGCTTCCGA AAGAAGTCTT GGGAGGTGTA CCAGGGAGTG
TGCCAGAAAG GGGGCTGCAG GTCAGAACCC ATTCAGATGG AGAACTCCAT GGGCACACTG CGGACCTCCA
TCTCCGTGGA ACGCCAGATT CACAAACTGC AGGACTGGGC AGGGAGCAGA CAGTGAGCAA ACGCCAGCAG
GGCTGCTGTG AATTTGTGTA AGGATTGAGG GACAGTTGCT T-3' (FRAG. NO:2275) (SEQ. ID NO:2448)

5'- TGATCCTATC ACAACCTGAG AGTAGTTTTT ACTCCATTTA CAGGTGAGGT CATTGTGGTT CAAGGACGTT

-continued

```
AAGTAACTTC CCCAGCTCAC ACGGCTTATA AGTAAGGCAG CCAGGATGTG AACCCAGTAG GACTATCTGG
CTGCAAAGTC CCCACCCTCC CTCGCCATCT GTATCCTCCA ATCATCTTCA GTGCTTTGCT GATAGAAGGT
ACGGAAATAC GATGCCACAG ACTGTCCAGG AAGACAGAAA CTAGGCAGAT GGGCTGGCCA TGGTCTCCAA
GCCAGACTGG AATCTCCAGG TCTGGAATGA TATCATTTTT CTCTTTTAAT AAATTAACTC ACCCACCACA
CGGCTTTGAG AGGCTCAAAG GTGACCAACT CCCTTGGGAG GGCCCCGGTT GATAAGGAAG GAATGTGAAT
CCTCCCATCA CGGAAGCTTC AAGGAGGTCA AGGGTCCAAC ACTTGAGATT GTTAGTGCTG TTGGTGGATA
CTGCAGAATA TCCAGTGGAG CCTCAGATGA AGAACATGAG GCCCCGTTTA GATCCAAGGA TCAGAGGGGG
CTCTGTAAGA CCCAGGGGAG TCAGGTGCAC TGGAGCGCGG GCTGCAGAAA ACAGCCTGAG CTCCACCTCG
GCTTCTCCTT GCCCTGGCTG GTTGTCCTTA ACCCCTGTCT CCTTCTGGAC CAGTTTTTGT CCTTCCCTTG
TGACCTGAGG GGTAACAGCC TCTTTTCCAC TTTCTTTCAG CGCCGACATG CTCAATGTCA CCTTGCAAGG
GCCCACTCTT AACGGGACCT TGCCCAGAG CAAATGCCCC CAAGTGGAGT GGCTGGGCTG GCTCAACACC
ATCCAGCCCC CCTTCCTCTG GGTGCTGTTC GTGCTGGCCA CCCTAGAGAA CATCTTTGTC CTCAGCGTCT
TCTGCCTGCA CAAGAGCAGC TGCACGGTGG CAGAGATCTA CCTGGGGAAC CTGGCCGCAG CAGACCTGAT
CCTGGCCTGC GGGCTGCCCT TCTGGGCCAT CACCATCTCC AACAACTTCG ACTGGCTCTT TGGGGAGACG
CTCTGCCGCG TGGTGAATGC CATTATCTCC ATGAACCTGT ACAGCAGCAT CTGTTTCCTG ATGCTGGTGA
GCATCGACCG CTACCTGGCC CTGGTGAAAA CCATGTCCAT GGGCCGGATG CGCGGCGTGC GCTGGGCCAA
GCTCTACAGC TTGGTGATCT GGGGGTGTAC GCTGCTCCTG AGCTCACCCA TGCTGGTGTT CCGGACCATG
AAGGAGTACA GCGATGAGGG CCACAACGTC ACCGCTTGTG TCATCAGCTA CCCATCCCTC ATCTGGGAAG
TGTTCACCAA CATGCTCCTG AATGTCGTGG GCTTCCTGCT GCCCCTGAGT GTCATCACCT TCTGCACGAT
GCAGATCATG CAGGTGCTGC GGAACAACGA GATGCAGAAG TTCAAGGAGA TCCAGACGGA GAGGAGGGCC
ACGGTGCTAG TCCTGGTTGT GCTGCTGCTA TTCATCATCT GCTGGCTGCC CTTCCAGATC AGCACCTTCC
TGGATACGCT GCATCGCCTC GGCATCCTCT CCAGCTGCCA GGACGAGCGC ATCATCGATG TAATCACACA
GATCGCCTCC TTCATGGCCT ACAGCAACAG CTGCCTCAAC CCACTGGTGT ACGTGATCGT GGGCAAGCGC
TTCCGAAAGA AGTCTTGGGA GGTGTACCAG GGAGTGTGCC AGAAAGGGGG CTGCAGGTCA GAACCCATTC
AGATGGAGAA CTCCATGGGC ACACTGCGGA CCTCCATCTC CGTGGAACGC CAGATTCACA AACTGCAGGA
CTGGGCAGGG AGCAGACAGT GAGCAAACGC CAGCAGGGCT GCTGTGAATT TGTGTAAGGA TTGAGGGACA
GTTGCTTTTC AGCATGGGCC CAGGAATGCC AAGGAGACAT CTATGCACGA CCTTGGGAAA TGAGTGTTGA
TGTCTCCGGT AAAACACCGG AGACTAATTC CTGCCCTGCC CAATTTTCGA GGGAGCATGG CTGTGAGGAT
GGGGTGAACT CACGCACAGC CAAGGACTCC AAAATCACAA CAGCATTACT GTTCTTATTT GCTGCCACAC
CTGAGCCAGC CTGCTCCTTC CCAGGAGTGG AGGAGGCCTG GGGGAGGGAG AGGAGTGACT GAGCTTCCCT
CCCGTGTGTT CTCCGTCCCT GCCCCAGCAA GACAACTTAG ATCTCCAGGA GAACTGCCAT CCACGTTTGG
TGCAATGGCT GAGTGCACAA GTGAGTTGTT GCCCTGGGTT TCTTTAATCT ATCAGCTAGA ACTTTGAAGG
ACAATTTCTT GCATTAATAA AGGTTAAGCC CTGAGGGGTC CCTTGATAAC AACCTGGAGA CCAGGATTTT
ATGGCTCCCC TCACTGATGG ACAAGGAGGT CTGTGCCAAA GAAGAATCAA TAAGCACATA TGAGCACTTC
TGTATATCAG TATTGAGCAC TGTAGGCA-3' (FRAG. NO:2275) (SEQ. ID NO:2447)
5'- CTGCAGAAAA CAGCCTGAGC TCCACCTCGG CTTCTCCTTG CCCTGGCTGG TTGTCCTTAA CCCCTGTCTC
CTTCTGGACC AGTTTTTGTC CTTCCCTTGT GACCCTGAGG GGTAACAGCC TCTTTTCCAC TTTCTTTCAG
CGCCGACATG CTCAATGTCA CCTTGCAAGG GCCCACTCTT AACGGGACCT TGCCCAGAG CAAATGCCCC
CAAGTGGAGT GGCTGGGCTG GCTCAACACC ATCCAGCCCC CCTTCCTCTG GGTGCTGTTC GTGCTGGCCA
```

```
CCCTAGAGAA CATCTTTGTC CTCAGCGTCT TCTGCCTGCA CAAGAGCAGC TGCACGGTGG CAGAGATCTA
CCTGGGGAAC CTGGCCGCAG CAGACCTGAT CCTGGCCTGC GGGCTGCCCT TCTGGGCCAT CACCATCTCC
AACAACTTCG ACTGGCTCTT TGGGGAGACG CTCTGCCGCG TGGTGAATGC CATTATCTCC ATGAACCTGT
ACAGCAGCAT CTGTTTCCTG ATGCTGGTGA GCATCGACCG CTACCTGGCC CTGGTGAAAA CCATGTCCAT
GGGCCGGATG CGCGGCGTGC GCTGGGCCAA GCTCTACAGC TTGGTGATCT GGGGGTGTAC GCTGCTCCTG
AGCTCACCCA TGCTGGTGTT CCGGACCATG AAGGAGTACA GCGATGAGGG CCACAACGTC ACCGCTTGTG
TCATCAGCTA CCCATCCCTC ATCTGGGAAG TGTTCACCAA CATGCTCCTG AATGTCGTGG GCTTCCTGCT
GCCCCTGAGT GTCATCACCT TCTGCACGAT GCAGATCATG CAGGTGCTGC GGAACAACGA GATGCAGAAG
TTCAAGGAGA TCCAGACGGA GAGGAGGGCC ACGGTGCTAG TCCTGGTTGT GCTGCTGCTA TTCATCATCT
GCTGGCTGCC CTTCCAGATC AGCACCTTCC TGGATACGCT GCATCGCCTC GGCATCCTCT CCAGCTGCCA
GGACGAGCGC ATCATCGATG TAATCACACA GATCGCCTCC TTCATGGCCT ACAGCAACAG CTGCCTCAAC
CCACTGGTGT ACGTGATCGT GGGCAAGCGC TTCCGAAAGA AGTCTTGGGA GGTGTACCAG GGAGTGTGCC
AGAAAGGGGG CTGCAGGTCA GAACCCATTC AGATGGAGAA CTCCATGGGC ACACTGCGGA CCTCCATCTC
CGTGGAACGC CAGATTCACA AACTGCAGGA CTGGGCAGGG AGCAGACAGT GAGCAAACGC CAGCAGGGCT
GCTGTGAATT TGTGTAAGGA TTGAGGGACA GTTGCTTTTC AGCATGGGCC CAGGAATGCC AAGGAGACAT
CTATGCACGA CCTTGGGAAA TGAGTTGATG TCTCCGGTAA ACACCGGAG ACTAATTCCT GNCCTGCCCA
ATTTTGCAGG GAGCATGGCT GTGAGGATGG GGTGAACTCA CGCACAGCCA AGGACTCCAA AATCACAACA
GCATTACTGT TCTTATTTGC TGCCACACCT GAGCCAGCCT GCTCCTTCCC AGGAGTGGAG GAGGCCTGGG
GGCAGGGAGA GGAGTGACTG AGCTTCCCTC CCGTGTGTTC TCCGTCCCTG CCCCAGCAAG ACAACTTAGA
TCTCCAGGAG AACTGCCATC CAGCTTTGGT GCAATGGCTG AGTGCACAAG TGAGTTGTTG CCCTGGGTTT
CTTTAATCTA TTCAGCTAGA ACTTTGAAGG ACAATTTCTT GCATTAATAA AGGTTAAGCC CTGAGGGGTC
CCTGATAACA ACCTGGAGAC CAGGATTTTA TGGCTCCCCT CACTGATGGA CAAGGGAGGT CTGTGCCAAA
GAAGAATCCA ATAAGCACAT ATTGAGCACT TGCTGTATAT GCAGTATTGA GCACTGTAGG CAAGAGGGAA
GAAAGAGAAG GAGCCATCTC CATCTTGAAG GAACTCAAAG ACTCAAGTGG GAACGACTGG CACTGCCACC
ACCAGAAAGC TGTTCGACGA GACGGTCGAG CAGGGTGCTG TGGGTGATAT GGACAGCAGA AGGGGGAGAC
CAAGGTTCCA GCTCAACCAA TAACTATTGC ACAACCACCT GTCCCTGCCT CAGTTCCCTC TTCTGTAACA
TGAAGTCGTT GTGAGGGTTA AAGGCAGTAA CAGGTATAAA GTACTTAGAA AAGCAAAGGG TGCTACGTAC
ATGTGAGGCA TCATTACGCA GACGTAACTG GGATATGTTT ACTATAAGGA AAAGACACTG AGGTCTAGA -3'
(FRAG. NO:2275) (SEQ. ID NO:2446)
5'- AAATGATAGA CCGTCAATAA TTTGTTAAAT GCTTTTTAAA ATGAATGCTT TAAGCCGGGT GCAGTGCCTC
ACATCTGTAA TCCCAGCACT TTGGAGCCGA GCGGGTGGAT TGTGTGAGGT CAGGAGTTCG AGACCAACCT
GGCCAACATG GCAAAACCTC ACTCTCTACC AAAAATACAA AAATTAGCCA GGCATGGTGG CAGGCACCTG
TGATCCCAGC TACTCAGGAG GCTGAGACAG GAGAATCGCT TGAACCCGGG AGGCAAGGTT GCAGTGAGCC
AAGATTACGC CATTGTACTC CAGCCTGGGT GACAGAGAGA GACTCCGTCT CAAAAAAAAA AAAAAAAAA
AAAAAATTAC GCTTCAAACA CATGATCTCT CACCACTGTT GAATTTTCTT TCTATGAGCC CAGGAGGGCC
TCTCAGAGAG GAAAGCTCCT AGGTCTTCCT TTCCCTCTGC AAACTCCCTG CCTTGAAGGT TCAGAAGGAC
TGTGCGTGCT CGTTGCATCC TTTGCAAGTG TCCAAACCCT GATCCAGCT GTGCTTAGGG GTTCCTGCAA
ACCTTTTCCA GGTGTTAATT ACCTCCCACT TCATTTCCTG TTTACCAACT CAGCTTTTTG TTTTAGTGTG
TTTGAATTCC CTGAACTGAC CGTTGTCTGA TCTCCACCTC CCAACTGAAT TAGGGGAGCT GGGCTTCTGG
AAACCCAGGT GCCGGGTGTT GCAGAGTGGC TGAAAGCTGG GATGTGGCAG ATCCGTGGCT ACATTCATGC
```

-continued

```
ACACACACAC ACCCACATAC CCACACATGC ACACACACAC ACACACCCGC ACTCACACAC TTGGACATGC

ATAGACCACA GCTTTCCACA CCCTTCCTAG ACAGGGGTCA CTTGGTATCC TGGAGAGAGT GTGAAGTCCT

GGAATGGAAA GAGGGGGGAT TAAGCCCCAC CTCTAGCCAT GGGACTGAGA CAAGTCACCA CCAACCCATC

TGCGCCTTGT TTACCTCCTC TGTGAGGCAA GCACAGAGCC CATGCCTGCC CCCCTGGATG GGAGTGATGT

GAAACTTGAA GGGCGGTCAG AGCAAGGGTC GGGAATGGAA GGCCCTTGGG AAAAAAGGCC CTTTCAACTA

GGGGCACAGA GGAGGCCCTG GGCTGAGAAC TTGACAGCAC CTTGTAATTG GTAAGCCAAG CCCGAAGGGA

CTGGAAATAC TCAGATGTGT CTGTCTCCCT TATTAGGTTC AAAGTCCCTC AAGACCCTGT CTCCATCACA

GTGCTCCAGT CCAGACCCCT CCTCTGAGCT CCAGACCCTG CTGGACCCAA CCAGCCCTAT GGGGTCGCAT

CCCCACCTGC CTGGAATTCT CCAAAGAACC TCCCCTTTAA CAGTTCCAGC CTTTAACAGT TCCAGTCTAA

ACACATGACC TTTCTCCTCT AAATCAGCCC CCCATCTCTG CCTTTGCAGG AGATGGAAGC CATGACACCT

GCCTCGCCCC TGTCCTCACC CCATCCATGT CCAATCAAGC ACTAGGCATG TCAGGTTTAC CCTCTAAACT

CCTCTGGAAT CCAGTCTCTC AGTCTCCATC ATCCCAGGTC GAAGCTAATG GGCTAACTGG TCCTTGCTTC

CACTCTACCC CCACTGCAGT CCTGACTTCC TGAGCAGCAG CCAGGGCCTA ATCGATATTC ACACCAAGCG

CCAACCTGAC TGAGATATCC TCCTGCACCA TCATCCCTCC ACCCTGTTTA GTTCTGCTCA CCCTCAGTGT

TCTCATCAAT AATCCACTCC CCTCACAGGC GCGTTTGGGA CCCCATGTTC TATGCTCTCA CAGGACCTTT

TGCTTGATTT TTCACTGTAC TTAGGTCAGT TTGCAGTTAT TAAGTGACTG AGCAATGTCT GGCTTCTCCA

GTAGACTGTC AGCTCCTAGC CATTGTATAC CTAGCACCGC TGTGTGGGAG CACGTGACAA ACGTCCAGTG

AGTCAGGGAC TCAGCAGTCT CCATTTCTCC GCCCTGCTGG AGAATGCGTG TATTTGGCAA TCCCCAGCCC

CTGTGCCATC TAACCATCTT TTCTTCTCTG TTCAGCCCAG GTGTGGCCTC ACTCACATCC CACTCTGAGT

CCAAATGTTC TCTCCCTGGA AGATATCAAT GTTTCTGTCT GTTCGTGAGG ACTCCGTGCC CACCACGGCC

TCTTTCAGGT GAGTCAAAGG GATTCCTCAG TTCACTAGTT AGGGGAGGTG GGCAGACACC CTGGAGAACT

CCCTGGAAAG CTCAACTCTC ATGCCCCGGA CAACAGTTGA AGGAACCATG GTGATGTTAA GCCCAAAGAC

AAAACCTCTC AGGTGTCCAA GTCCCTGTTG GAATCTTGGG AGCAGAGGGA ATGTTCTGTG GTCTAGAGGA

AGAGGGGCTC AGGGAGGAGA AGGGCACATT CCTGGTTGTT ATATGTTTCT ATCTATCCCA GATGAACTTG

GAAGTGAAGG GAAGAGAGTT AAACATTAAA GTAAATACCC AGTGGATCAG ACAGCAATGT GCCAGATTGC

CTTGGAAACA AAATATCTCC AACACATGGC TGACATTTGG TGGGAGATCA GAACACCCTA AAGAGAGAAT

TTAAGGGGAG GGGGAGGAGG ACCTGAGCCA GAGTAGAAGC AGAGGATAGG GAGATCTGTT CTTGGGGACA

GCATTTGCAA GAAACAAGGC TGAGGGGTCC ACTCCAACCT CTCCACCCTG CTGCAGGTGC TGCCTATGAT

GAAGATGAGC AGATGGCCAT CTCAGCTGGG GCCACAGTGC ACTGGACCTA TAGTTTCCAA TTCCGCACTC

AGCAGGCATC TTTCTGATGA TCCGATGGCT CTCTCAGAGCC AGGGATGGGC CAGGATCCAT CCCCTTGGCT

ACTGTCTTGC TGAGAAATTT ATAAGCAGCA TCTGGTGCTA TACTTTGGTC TCTAGTGAGT TAGCTCATGA

AAGATGATAG ACTCTCCAAG CCAGGGGTAT GCAGGAAATG GGTTTTCTGT AGCTACAGAA ATGGGGTTGA

GGGTTGGACC AAGGGACTAC CCAGGGGAAG TCTTACCTTC AGAGGACTCT GGAAAGGAGG CTGCAAGTTT

TCATGGGTCA AGAATTCAGA GCCCAGTAGA GACAGCTTAT CTCTGTTCCA AGATGTCTGG GGCCTTGGTT

GGAAGATTCA AAGGCTAGGA AACCAGGAGC CACCAAAAGC GTAACTGGGG CCAGAGGATC CACTTTCAAG

GTGGCAAGTT GGTTCCCCCC ATGTGGCTGC TTGAGTATCC TCACATGCG GCTCACATCC TTCCAAGTAA

GCAATGCAAA AGGCCAAGAA AGATGCTGCA AAGATGTTAT GACCTAGCCT CAGAAATCAC ACACCATCCC

TGCCACCATT AGTAAGAAGT CCAGCCCACG TCCAGGAGAA GAGGAAGCAG ATTCCTCCTT TTGAAAATGAA

GAATATCAAG TAATTCGGGG GGCATATGAA AGCCACCACA CACCACAGGG ATCTTTTTAG AGCATACTTC
```

```
TTATACCATC ACTGTAGTTC CTTAAGACTC AGGGGCAAAG CCTCACTTCC TTAGCACCCA GTGAAGACCA
CGCTTACTCC CTCACTCAAC CTCTTGCTAC TTCCCACCTC TCCTGTCCAA CATCTAGTGT CACTTTCCAG
AACATACCAA CAGCTTCCCC AGTTCTGTGC CTCTGCTCAG GCTGTTCCCC CTGCCTGGTC CACTTGTCCT
CCTTCTTGTC CGGTCAAAAT GCTTCTTATC CTTCAAGACC CAGCTCTAGA GTCACCTCCA ACCCCTTACC
CACCAGCCCC CTCTCCAAGT CTGTGTCCCA CAACCCCCCT GCTCCCTCCA GGGCACCCTC CACCCTCTGG
GCCACAGTTG TCAGGAGTCA GGCAGGGCAG GGGCCGGGTG GTGTCTTCTT TGTGTTCTTG CACTCAGGGC
AGAGCTCAGC ACAGAGCAGA CGCTCAAAAA ACATTTAAAG GATAGAAGCA TTGATTTGTG GGTCCCCCAG
TCTGGCTCCA GGATGCCAGC CAGCTGCTCC TAGAAGCAAA CGGACTTTTC CTGGGAAATC CCAGAGGTGA
TGATCAGTAA TCTCTCCCGT GACTCGTAGT TCAGCTCTTC CTCCATGAGC CTGACTATCA GTGGACCTTC
CAGAAAGAGC CCCTTTTCCT TCTCTCACCC ACAGCACAGG GCACTGGGAA AATGCCCAAT GAGTCCTGCC
TCTGGGTTGT GCTTTGGACT TTTCAGTGTG TCTCGCATCC ACTCTTCAAC TTGAATGTTG CAACAGCCAT
GAAAAAGAA ATGCAAAGCG ATTCAGGATG AGAGCAATAC CCTACTCCAA AGAAGGCAAC ATAGAAGCTC
AGAGAGATCA AGCAATTTGC CCAAGACCAC ACAGCTAGGA GTGGAACTCA TGGCTGTCCA AGCCCCATGC
CTCTGCTGAA GGTAGAGATG AATTACAGCA ACAAGTCTAG AAAGGTGCCT GCCCTATGGT CTGTGAGTCT
TGCCTAAGAA TGAAAGAGGA GCCAGTGGGT TAAAGATGAG GTCACCAACA ACGGTGGTGT TGGAGTTTAC
CACTGATAAT AAGGGTGCAA AATGTAAATT ACTAATGTTT ATTGAGCCTA GTGCAGTGCG TGGGGCATTT
TGCACATTGT CTCTGATCCC TATGACAACC CTGAGAGGTA GTGGTTTTAA CTGCCATGTT ACAGGTGAGG
TCATTGTGGT TCAAGGACGT TAAGTAACTT CCCCAGCGTG ACACGGCTTA TAAGTAAGGC AGCCAGGATG
TGAACCCAGT AGGACTATCT GGCTGCAAAG TCCCCACCCC CCTCGCCATC TGTATCCTCC AATCACTTCA
GTGCTTTGCT GCATAGAAGG TAACGGAAAT CACGATGCCA CAGACTGTCC AGGAAGACAG AAACTAGGCA
GATGGGCTGG CCATGGTCTC CAAGCCAGAC TGGAATCTCC AGGTCTGGAA TGATATCATT TTTCTCTTTT
AATAAATTAA CTCACCCACC ACACGGCTTT GAGAGGCTCA AAGTTGACCA ACTCCCTTGG GAGGGCCCCG
GTTGATAAGG AAGGAACGTG AATCCTCCCA TCACGGAAGC TTCAAGGAGG TCAAGGGTCC AACACTTGAG
ATTGTTAGTG CTGTTGGTGG ATACTGGCCA AGGAAATATC CCAGTGGAGC CTCGAGATGA AGAACATGAG
GCCCCCGTTT AGAACCAAGG ATCAGAGGGG GCTCTGTAAG ACCCAGGGGA GTCAGGTGCA CTGGAGCGCG
GGCATGCAGA AAACAGCCTG AGCTCCACCT CGGCTTCTCC TTGTCCTGGC TGGTTGTCCT TAACCCCTGT
CTCCTTCTGG ACCAGTTTTT GTCCTTCCCT TGTGACCGCT GAGGGGTAAC AGCCTCTTTC CACTTTCTTT
CAGCGCCGAC ATGCTCAATG TCACCTTGCA AGGGCCCACT CTTAACGGGA CCTTTGCCCA GAGCAAATGC
CCCCAAGTGG AGTGGCTGGG CTGGCTCAAC ACCATCCAGC CCCCCTTCCT CTGGGTGCTG TTCGTGCTGG
CCACCCTAGA GAACATCTTT GTCCTCAGCG TCTTCTGCCT GCACAAGAGC AGCTGCACGG TGGCAGAGAT
CTACCTGGGG AACCTGGCCG CAGCAGACCT GATCCTGGCC TGCGGGCTGC CCTTCTGGGC CATCACCATC
TCCAACAACT TCGACTGGCT CTTTGGGGAG ACGCTCTGCC GCGTGGTGAA TGCCATTATC TCCATGAACC
TGTACAGCAG CATCTGTTTC CTGATGCTGG TGAGCATCGA CCGCTACCTG GCCCTGGTGA AAACCATGTC
CATGGGCCGG ATGCGCGGCG TGCGCTGGGC CAAGCTCTAC AGCTTGGTGA TCTGGGGGTG TACGCTGCTC
CTGAGCTCAC CCATGCTGGT GTTCCGGACC ATGAAGGAGT ACAGCGATGA GGGCCACAAC GTCACCGCTT
GTGTCATCAG CTACCCATCC CTCATCTGGG AAGTGTTCAC CAACATGCTC CTGAATGTCG TGGGCTTCCT
GCTGCCCCTG AGTGTCATCA CCTTCTGCAC GATGCAGATC ATGCAGGTGC TGCGGAACAA CGAGATGCAG
AAGTTCAAGG AGATCCAGAC GGAGAGGAGG GCCACGGTGC TAGTCCTGGT TGTGCTGCTG CTATTCATCA
TCTGCTGGCT GCCCTTCCAG ATCAGCACCT TCCTGGATAC GCTGCATCGC CTCGGCATCC TCTCCAGCTG
CCAGGACGAG CGCATCATCG ATGTAATCAC ACAGATCGCC TCCTTCATGG CCTACAGCAA CAGCTGCCTC
```

```
AACCCACTGG TGTACGTGAT CGTGGGCAAG CGCTTCCGAA AGAAGTCTTG GGAGGTGTAC CAGGGAGTGT

GCCAGAAAGG GGGCTGCAGG TCAGAACCCA TTCAGATGGA GAACTCCATG GGCACACTGC GGACCTCCAT

CTCCGTGGAA CGCCAGATTC ACAAACTGCA GGACTGGGCA GGGAGCAGAC AGTGAGCAAA CGCCAGCAGG

GCTGCTGTGA ATTTGTGTAA GGATTGAGGG ACAGTTGCTT TTCAGCATGG GCCCAGGAAT GCCAAGGAGA

CATCTATGCA CGACCTTGGG AAATGAGTTG ATGTCTCCGG TAAAACACCG GAGACTAATT CCTGCCCTGC

CCAATTTTGC AGGGAGCATG GCTGTGAGGA TGGGGTGAAC TCACGCACAG CCAAGGACTC CAAAATCACA

ACAGCATTAC TGTTCTTATT TGCTGCCACA CCTGAGCCAG CCTGCTCCTT CCCAGGAGTG GAGGAGGCCT

GGGGGCAGGG AGAGGAGTGA CTGAGCTTCC CTCCCGTGTG TTCTCCGTCC CTGCCCCAGC AAGACAACTT

AGATCTCCAG GAGAACTGCC ATCCAGCTTT GGTGCAATGG CTGAGTGCAC AAGTGAGTTG TTGCCCTGGG

TTTCTTTAAT CTATTCAGCT AGAACTTTGA AGGACAATTT CTTGCATTAA TAAAGGTTAA GCCCTGAGGG

GTCCCTGATA CAACCTGGA GACCAGGATT TTATGGCTCC CCTCACTGAT GGACAAGGAG GTCTGTGCCA

AAGAAGAATC CAATAAGCAC ATATTGAGCA CTTGCTGTAT ATGCAGTATT GAGCACTGTA GGCAAGAGGG

AAGAAAGAGA AGGAGCCATC TCCATCTTGA AGGAACTCAA AGACTCAAGT GGGAACGACT GGGCACTGCC

ACCACCAGAA AGCTGTTCGA TGAGACGGTC GAGCAGGGTG CTGTGGGTGA TATGGACAGC AGAAGGGGGA

GCCAGGTTCC AGCTCACCAA TACTATTGCA CACCACCTGT CCTGCCTC-3' (FRAG.NO:2275) (SEQ. ID NO:2445)

5'-CAGATTCACA AACTGCAGGA CTGGGCAGGG AGCAGACAGT GAGCAAACGC CAGCAGGGCT GCTGTGAATT

TGTGTAAGGA TTGAGGGACA GTTGCTTTTC AGCATGGGCC CAGGAATGCC AAGGAGACAT CTATGCACGA

CCTTGGGAAA TGAGTTGATG TCTCCGGTAA ACACCGGAG ACTAATTCCT GCCCTGCCCA ATTTTGCAGG

GAGCATGGCT GTGAGGATGG GGTGAACTCA CGCACAGCCA AGGACTCCAA AATCACAACA GCATTACTGT

TCTTATTTGC TGCCACACCT GAGCCAGCCT GCTCCTTCCC AGGAGTGGAG GAGGCCTGGG GGAGGGAGA

GGAGTGACTG AGGTTCCCTC CGTGTGTTC TCCGTCCCTG CCCCAGCAAG ACAACTTAGA TCTCCAGGAG

AACTGCCATC CAGCTTTGGT GCAATGGCTG AGTGCACAAG TGAGTTGTTG CCCTGGGTTT CTTTAATCTA

TTCAGCTAGA ACTTTGAAGG ACAATTTCTT GCATTAATAA AGGTTAAGCC CTGAGGGGTC CCTGATAACA

ACCTGGAGAC CAGGATTTTA TGGCTCCCCT CACTGATGGA CAAGGAGGTC TGTGCCAAAG AAGAATCCAA

TAAGCACATA TTGAGCACTT GCTGTATATG CAGTATTGAG CACTGTAGGC AAGACCCAAG AAAGAGAAGG

AGCCATCTCC ATCTTGAAGG AACTCAAAGA CTCAAGTGGG AACGACTGGG CACTGCCACC ACCAGAAAGC

TGTTCGACGA GACGGTCGAG CAGGGTGCTG TGGGTGATAT GGACAGCAGA AGGGGAGAC CAAGGTTCCA

GCTCAACCAA TAACTATTGC ACAACCACCT GTCCCTGCCT CAGTTCCCTT TTATGTAACA TGAAGTCGTT

GTGAGGGTTA AAGGCAGTAA CAGGTATAAA GTACTTAGAA AAGCAAAGGG TGCTACGTAC ATGTGAGGCA

TCATTACGCA GACGTAACTG GGATATGTTT ACTATAAGGA AAAGACACTG AGGTCTAGAA ATAGCTCCGT

GGAGCAGAAT CAGTATTGGG AGCCGGTGGC GGTGTGAAGC ACCAGTGTCT GGCACACAGT AGGTGCTCAT

TGGCTCCCTT CCACCTGTCA TTCCCACCAC CCTGAGGCCC CAACCGCCAC ACACACAGGA GCATTTGGAG

AGAAGGCCAT GTCTTCAAAG TCTGATTTGT GATGAGGCAG AGGAAGATAT TTCTAATCGG TCTTGCCCAG

AGGATCACAG TGCTGAGACC CCCCACCACC AGCCGGTACC TGGGAAGGGG GAGAGTGCAG GCCTGCTCAG

GGACTGTTCC TGTCTCAGCA ACCAAGGGAT TGTTCCTGTC AATCAATGGT TTATTGGAAG GTGGCCCAGT

ATGAGCCCTA GAAGAGTGTG AAAAGGAATG GCAATGGTGT TCACCATCGG CAGTGCCAGG GCAGCACTCA

TTCACTTGAT AAATGAATAT TTATTAGCTG GTTGGAGAGC TAGAACCTGG AGAGCTAGAA CCTGGAGAAC

TAGAACCTGG AGGGCTAGAA CCTGGAGAGG CTAGAACCAA GAAGGGCTAG AACCTGGAGG GGCTAGAACC

TAGAGAAGCT AAAACCTGAG CTAGAAGCTG GAGGACTAGA ACCTGGAGGG CTGGAATCTG AAGGGCTAGA
```

ACCTGGAGGG CTGGAATCTG GAGAGCTAGA ACCTGGAGGG CTAGAACCTG GAGGGCTAGA ACCTAGAAGG
GCTAGAACCT GGAGGGCTGG AATCTGGAGA GCTAGAACCT GGAGGGCTAG AACCTGGAGG GCTAGAACCT
AGAAGGGCTA GAACCTGGAG GGCTAGAACC TGGCAGGTTA GAACCTAGAA GGGCTAGAAC CTGGAGAGCC
AGAACCTGGA GGGCTAGAAC CTGGAAGGGC TAGAACCTGT AGAGCTAGAA CATGGAGAGC TAGAACCCGG
CAGGCTAGAA CCTGGCAAGC TAGAACCTGG AGGGAATGAA CCTGGAGGGC TAGAACCTGG AGAATGAGAA
AAATTTACAT GGCAAAGAGC CCATAAATCC TGACCAATCC AACTCTGAAT TTTAAAGCAA AAGCGTGAAA
AAAAAGATTC CCTCCTTACC CCCAACCCAC TCTTTTTTCC CACCACCCAC TCTCCTCTGC CTCAGTAAGT
ATCTGGAGGA AGAAACAGG TGAAAGAAGA AGTAAAAACC ATTTAGTATT AGTATTAGAA TGAAGTCAAA
CTGTGCCACA CATGGTGAAT GAAAAAAAAA AAAAGAGGC TGTGTTTTGT CACACAGGGC AGTCATTCAG
CACCAGAGCA CGTGATGGTC TGAGACTCTC TTAGGAGCAG AGCTCTGCCG CAATGGCCAT GTGGGGATCC
ACACCTGGTC TGAGGGCAA CTGAGTCTGC GGGAGAAGAG CGGCCCTATG CATGGTGTAG ATGCCCTGAT
AAAGAACATC TGTCCTGTGA AAGACTCAAT GAGCTGTTAT GTTGTAAACA GGAAGCATTT CACATCCAAA
CGAGAAAATC ATGTAAACAT GTGTCTTTTC TGTAGAGCAT AATAAATGGA TGAGGTTTTT GCAAAAAAAA
AAAAAAAAA-3' (FRAG. NO:2275) (SEQ. ID NO:2444)

5'- GAGCTCTTCA ATATTTTAGT GAAAGCTATA GATGAGGCTC CATAGGGGAT AAAGCACAGA CACACCTTTT
CAGAGGGCTT GTGGACTCTG GCAGCCTGT CCATAGACCT CTGTCCCCAA CTGGCAAGTC AGGAAACTCC
AGATTAAGGA GCCCCAATGT GGTTGAACAG CCAGGTGCAC AGATGAGTCA ACCACACAGC CAGGCCAGGG
AGGGCCTTCA CTCAAGAGCC TACAGCCAGT TCACAGCCAA GCCAGGGCTA GCGCCAGGCC ACCCATAAAC
TGATCTGAGA CTCTGTTTCC CTGTCTCCAT GATGATGGGA TCAGGCTTGA TTGCTGGTTT GTAGGCTTGT
TATGAATCAA GTCACAGGGA AGAGGAGCTG ATGGGCTGGG GGGACGTCCT CTGGCCCTCC TGTCTCTTCC
CCAGATCCAC TGGGCCCACT CTTATCTGTT CTCTTCTGAA GGAAGGGTTT TAAGGCTTCA AAAAAAAATG
TTTTGAAAGT CCCTGCCCTT TCCAGCTCCT ACCGTCTCAG CCCTGGGAGT GTAAAGTGCT GCAGATAGTT
AGTAAGTCTT TGAGCAAAAC TGAGAAAGCC AGCCTGAGCC TTGACATGGG AGAAACCTCC GCCATACATC
TCCGAAGAAA CGGCCGCGTG TCTCAGGGGA GCGCAAACAC CCGTACCCAG GAAACAGGAC AGCTTCTGCC
ACTGTCGCCC TTGGGAGCCG TACGTGGCAT GACAAAGAAA TCCCAGGACT CCGCCTGCCC ACCTGGCCAC
CCTCTGTTTA CACCTTCCGC GTAAACGCCC ACTGTTTACA TCCAAAACTC AGACACAAAA TAACCACCTC
AAGAAGATAA ATAATGATAA GAAATAAATG TTACGCGAGG CAAATTTATT CACATGGGGC TTCCCAGGCC
ACTTTGTGGT CAGCCGGGAG GGACGTTTTT GCCGTCCCAC GACTCCAACG GGCAGCCGGG CCTACGCAAA
CATGGAAATC TTCCAAGAGC CTCCCTGGCC CCCAGGGCTC AGAGGGTGGC AGAGCGGAGA GCGAAGGTGG
CCGCAGCCTT CCCGGCCCCA CAGCCAGCCT GGCTCCAGCT GGGCAGGAGT GCAGAGCTCA GCTGGAGGCG
AGGGGGAAGT GCCCAGGAGG CTGATGACAT CACTACCCAG CCCTTCAAAG ATGAGCTGTT CCCGCCGCCA
CTCCAGCTCT GGCTTCTGGG CTCCGAGGAG GGGTGGGGAC GGTGGTGACG GTGGGGACAT CAGGCTGCCC
CGCAGTACCA GGGAGCGACT GAAGTGCCCA TGCCGCTTGC TCCGGAGAAG GTGGGTGCCG GGCAGGGGCT
GCTCCAGCCG CCTCACCTCT GCTGGGAGGA CAAACTGTCC CAGCACAGAG GGAGGGAGGG AGGGCAGGCA
GCGGGGAGAA GTTTCCCTGT GGTCGTGGGG AGTTGGGAAA AGTTCCCTTC CTTCCGGAGG GAGG-3'
(FRAG.NO:2275) (SEQ. ID NO:2443)

5'- GCCCTTCAAA GATGAGCTGT TCCCGCCGCC ACTCCAGCTC TGGCTTCTGG GCTCCGAGGA GGGGTGGGGA
CGGTGGTGAC GGTGGGGACA TCAGGCTGCC CCGCAGTACC AGGGAGCGAC TGAAGTGCCC ATGCCGCTTG
CTCCGGAGAA GGTGGGTGCC GGGCAGGGGC TGCTCCAGCC GCCTCACCTC TGCTGGGAGG ACAAACTGTC
CCAGCACAGA GGGAGGGAGG GAGGGCAGGC AGCGGGGAGA AGTTTCCCTG TGGTCGTGGG GAGTT -3' (FRAG.

NO:2275) (SEQ. ID NO:2442)

5'- AAATGATAGA CCGTCAATAA TTTGTTAAAT GCTTTTTAAA ATGAATGCTT TAAGCCGGGT GCAGTGCCTC
ACATCTGTAA TCCCAGCACT TTGGAGCCGA GCGGGTGGAT TGTGTGAGGT CAGGAGTTCG AGACCAACCT
GGCCAACATG GCAAAACCTC ACTCTCTACC AAAAATACAA AAATTAGCCA GGCATGGTGG CAGGCACCTG
TGATCCCAGC TACTCAGGAG GCTGAGACAG GAGAATCGCT TGAACCCGGG AGGCAAGGTT GCAGTGAGCC
AAGATTACGC CATTGTACTC CAGCCTGGGT GACAGAGAGA GACTCCGTCT CAAAAAAAAA AAAAAAAAA
AAAAAATTAC GCTTCAAACA CATGATCTCT CACCACTGTT GAATTTTCTT TCTATGAGCC AGGAGGGCC
TCTCAGAGAG GAAAGCTCCT AGGTCTTCCT TTCCCTCTGC AAACTCCCTG CCTTGAAGGT TCAGAAGGAC
TGTGCGTGCT CGTTGCATCC TTTGCAAGTG TCCAAACCCT GATCCCAGCT GTGCTTAGGG GTTCCTGCAA
ACCTTTTCCA GGTGTTAATT ACCTCCCACT TCATTTCCTG TTTACCAACT CAGCTTTTTG TTTTAGTGTG
TTTGAATTCC CTGAACTGAC CGTTGTCTGA TCTCCACCTC CCAACTGAAT TAGGGGAGCT GGGCTTCTGG
AAACCCAGGT GCCGGGTGTT GCAGAGTGGC TGAAAGCTGG GATGTGGCAG ATCCGTGGCT ACATTCATGC
ACACACACAC ACCCACATAC CCACACATGC ACACACACAC ACACACCCGC ACTCACACAC TTGGACATGC
ATAGACCACA GCTTTCCACA CCCTTCCTAG ACAGGGTCA CTTGGTATCC TGGAGAGAGT GTGAAGTCCT
GGAATGGAAA GAGGGGGGAT TAAGCCCCAC CTCTAGCCAT GGGACTGAGA CAAGTCACCA CCAACCCATC
TGCGCCTTGT TTACCTCCTC TGTGAGGCAA GCACAGAGCC CATGCCTGCC CCCTGGATG GGAGTGATGT
GAAACTTGAA GGGCGGTCAG AGCAAGGGTC GGGAATGGAA GGCCCTTGGG AAAAAAGGCC CTTTCAACTA
GGGGCACAGA GGAGGCCCTG GGCTGAGAAC TTGACAGCAC CTTGTAATTG GTAAGCCAAG CCCGAAGGGA
CTGGAAATAC TCAGATGTGT CTGTCTCCCT TATTAGGTTC AAAGTCCCTC AAGACCCTGT CTCCATCACA
GTGCTCCAGT CCAGACCCCT CCTCTGAGCT CCAGACCCTG CTGGACCCAA CCAGCCCTAT GGGGTCGCAT
CCCCACCTGC CTGGAATTCT CCAAAGAACC TCCCCTTTAA CAGTTCCAGC CTTTAACAGT TCCAGTCTAA
ACACATGACC TTTCTCCTCT AAATCAGCCC CCCATCTCTG CCTTTGCAGG AGATGGAAGC CATGACACCT
GCCTCGCCCC TGTCCTCACC CCATCCATGT CCAATCAAGC ACTAGGCATG TCAGGTTTAC CCTCTAAACT
CCTCTGGAAT CCAGTCTCTC AGTCTCCATC ATCCCAGGTC GAAGCTAATG GGCTAACTGG TCCTTGCTTC
CACTCTACCC CCACTGCAGT CCTGACTTCC TGAGCAGCAG CCAGGGCCTA ATCGATATTC ACACCAAGCG
CCAACCTGAC TGAGATATCC TCCTGCACCA TCATCCCTCC ACCCTGTTTA GTTCTGCTCA CCCTCAGTGT
TCTCATCAAT AATCCACTCC CCTCACAGGC GCGTTTGGGA CCCCATGTTC TATGCTCTCA CAGGACCTTT
TGCTTGATTT TTCACTGTAC TTAGGTCAGT TTGCAGTTAT TAAGTGACTG AGCAATGTCT GGCTTCTCCA
GTAGACTGTC AGCTCCTAGC CATTGTATAC CTAGCACCGC TGTGTGGGAG CACGTGACAA ACGTCCAGTG
AGTCAGGGAC TCAGCAGTCT CCATTTCTCC GCCCTGCTGG AGAATGCGTG TATTTGGCAA TCCCCAGCCC
CTGTGCCATC TAACCATCTT TTCTTCTCTG TTCAGCCCAG GTGTGGCCTC ACTCACATCC CACTCTGAGT
CCAAATGTTC TCTCCCTGGA AGATATCAAT GTTTCTGTCT GTTCGTGAGG ACTCCGTGCC CACCACGGCC
TCTTTCAGGT GAGTCAAAGG GATTCCTCAG TTCACTAGTT AGGGGAGGTG GGCAGACACC CTGGAGAACT
CCCTGGAAAG CTCAACTCTC ATGCCCCGGA CAACAGTTGA AGGAACCATG GTGATGTTAA GCCCAAAGAC
AAAACCTCTC AGGTGTCCAA GTCCCTGTTG GAATCTTGGG AGCAGAGGGA ATGTTCTGTG GTCTAGAGGA
AGAGGGGCTC AGGGAGGAGA AGGGCACATT CCTGGTTGTT ATATGTTTCT ATCTATCCCA GATGAACTTG
GAAGTGAAGG GAAGAGAGTT AAACATTAAA GTAAATACCC AGTGGATCAG ACAGCAATGT GCCAGATTGC
CTTGGAAACA AAATATCTCC AACACATGGC TGACATTTGG TGGGAGATCA GAACACCCTA AGAGAGAAT
TTAAGGGGAG GGGGAGGAGG ACCTGAGCCA GAGTAGAAGC AGAGGATAGG GAGATCTGTT CTTGGGGACA

-continued

```
GCATTTGCAA GAAACAAGGC TGAGGGGTCC ACTCCAACCT CTCCACCCTG CTGCAGGTGC TGCCTATGAT
GAAGATGAGC AGATGGCCAT CTCAGCTGGG GCCACAGTGC ACTGGACCTA TAGTTTCCAA TTCCGCACTC
AGCAGGCATC TTTCTGATGA TCCGATGGCT TCTCAGAGCC AGGGATGGGC CAGGATCCAT CCCCTTGGCT
ACTGTCTTGC TGAGAAATTT ATAAGCAGCA TCTGGTGCTA TACTTTGGTC TCTAGTGAGT TAGCTCATGA
AAGATGATAG ACTCTCCAAG CCAGGGGTAT GCAGGAAATG GGTTTTCTGT AGCTACAGAA ATGGGGTTGA
GGGTTGGACC AAGGGACTAC CCAGGGGAAG TCTTACCTTC AGAGGACTCT GGAAAGGAGG CTGCAAGTTT
TCATGGGTCA AGAATTCAGA GCCCAGTAGA GACAGCTTAT CTCTGTTCCA AGATGTCTGG GGCCTTGGTT
GGAAGATTCA AAGGCTAGGA AACCAGGAGC CACCAAAAGC GTAACTGGGG CCAGAGGATC CACTTTCAAG
GTGGCAAGTT GGTTCCCCCC ATGTGGCTGC TTGAGTATCC TCACATGGCG GCTCACATCC TTCCAAGTAA
GCAATGCAAA AGGCCAAGAA AGATGCTGCA AAGATGTTAT GACCTAGCCT CAGAAATCAC ACACCATCCC
TGCCACCATT AGTAAGAAGT CCAGCCCACG TCCAGGAGAA GAGGAAGCAG ATTCCTCCTT TTGAAATGAA
GAATATCAAG TAATTCGGGG GGCATATGAA AGCCACCACA CACCACAGGG ATCTTTTTAG AGCATACTTC
TTATACCATC ACTGTAGTTC CTTAAGACTC AGGGGCAAAG CCTCACTTCC TTAGCACCCA GTGAAGACCA
CGCTTACTCC CTCACTCAAC CTCTTGCTAC TTCCCACCTC TCCTGTCCAA CATCTAGTGT CACTTTCCAG
AACATACCAA CAGCTTCCCC AGTTCTGTGC CTCTGCTCAG GCTGTTCCCC CTGCCTGGTC CACTTGTCCT
CCTTCTTGTC CGGTCAAAAT GCTTCTTATC CTTCAAGACC CAGCTCTAGA GTCACCTCCA ACCCCTTACC
CACCAGCCCC CTCTCCAAGT CTGTGTCCCA CAACCCCCCT GCTCCCTCCA GGGCACCCTC CACCCTCTGG
GCCACAGTTG TCAGGAGTCA GGCAGGGCAG GGGCCGGGTG GTGTCTTCTT TGTGTTCTTG CACTCAGGGC
AGAGCTCAGC ACAGAGCAGA CGCTCAAAAA ACATTTAAAG GATAGAAGCA TTGATTTGTG GGTCCCCCAG
TCTGGCTCCA GGATGCCAGC CAGCTGCTCC TAGAAGCAAA CGGACTTTTC CTGGGAAATC CCAGAGGTGA
TGATCAGTAA TCTCTCCCGT GACTCGTAGT TCAGCTCTTC CTCCATGAGC CTGACTATCA GTGGACCTTC
CAGAAAGAGC CCCTTTTCCT TCTCTCACCC ACAGCACAGG GCACTGGGAA AATGCCCAAT GAGTCCTGCC
TCTGGGTTGT GCTTTGGACT TTTCAGTGTG TCTCGCATCC ACTCTTCAAC TTGAATGTTG CAACAGCCAT
GAAAAAGAA ATGCAAAGCG ATTCAGGATG AGAGCAATAC CCTACTCCAA GAAGGCAAC ATAGAAGCTC
AGAGAGATCA AGCAATTTGC CCAAGACCAC ACAGCTAGGA GTGGAACTCA TGGCTGTCCA AGCCCCATGC
CTCTGCTGAA GGTAGAGATG AATTACAGCA ACAAGTCTAG AAAGGTGCCT GCCCTATGGT CTGTGAGTCT
TGCCTAAGAA TGAAAGAGGA GCCAGTGGGT TAAAGATGAG GTCACCAACA ACGGTGGTGT TGGAGTTTAC
CACTGATAAT AAGGGTGCAA AATGTAAATT ACTAATGTTT ATTGAGCCTA GTGCAGTGCG TGGGGCATTT
TGCACATTGT CTCTGATCCC TATGACAACC CTGAGAGGTA GTGGTTTTAA CTGCCATGTT ACAGGTGAGG
TCATTGTGGT TCAAGGACGT TAAGTAACTT CCCCAGCGTG ACACGGCTTA TAAGTAAGGC AGCCAGGATG
TGAACCCAGT AGGACTATCT GGCTGCAAAG TCCCCACCCC CCTCGCCATC TGTATCCTCC AATCACTTCA
GTGCTTTGCT GCATAGAAGG TAACGGAAAT CACGATGCCA CAGACTGTCC AGGAAGACAG AAACTAGGCA
GATGGGCTGG CCATGGTCTC CAAGCCAGAC TGGAATCTCC AGGTCTGGAA TGATATCATT TTTCTCTTTT
AATAAATTAA CTCACCCACC ACACGGCTTT GAGAGGCTCA AGTTGACCA ACTCCCTTGG GAGGGCCCCG
GTTGATAAGG AAGGAACGTG AATCCTCCCA TCACGGAAGC TTCAAGGAGG TCAAGGGTCC AACACTTGAG
ATTGTTAGTG CTGTTGGTGG ATACTGGCCA AGGAAATATC CCAGTGGAGC CTCGAGATGA AGAACATGAG
GCCCCCGTTT AGAACCAAGG ATCAGAGGGG GCTCTGTAAG ACCCAGGGGA GTCAGGTGCA CTGGAGCGCG
GGCATGCAGA AAACAGCCTG AGCTCCACCT CGGCTTCTCC TTGTCCTGGC TGGTTGTCCT TAACCCCTGT
CTCCTTCTGG ACCAGTTTTT GTCCTTCCCT TGTGACCGCT GAGGGGTAAC AGCCTCTTTC CACTTTCTTT
CAGCGCCGAC ATGCTCAATG TCACCTTGCA AGGGCCCACT CTTAACGGGA CCTTTGCCCA GAGCAAATGC
```

-continued

```
CCCCAAGTGG AGTGGCTGGG CTGGCTCAAC ACCATCCAGC CCCCCTTCCT CTGGGTGCTG TTCGTGCTGG
CCACCCTAGA GAACATCTTT GTCCTCAGCG TCTTCTGCCT GCACAAGAGC AGCTGCACGG TGGCAGAGAT
CTACCTGGGG AACCTGGCCG CAGCAGACCT GATCCTGGCC TGCGGGCTGC CCTTCTGGGC CATCACCATC
TCCAACAACT TCGACTGGCT CTTTGGGGAG ACGCTCTGCC GCGTGGTGAA TGCCATTATC TCCATGAACC
TGTACAGCAG CATCTGTTTC CTGATGCTGG TGAGCATCGA CCGCTACCTG GCCCTGGTGA AAACCATGTC
CATGGGCCGG ATGCGCGGCG TGCGCTGGGC CAAGCTCTAC AGCTTGGTGA TCTGGGGGTG TACGCTGCTC
CTGAGCTCAC CCATGCTGGT GTTCCGGACC ATGAAGGAGT ACAGCGATGA GGGCCACAAC GTCACCGCTT
GTGTCATCAG CTACCCATCC CTCATCTGGG AAGTGTTCAC CAACATGCTC CTGAATGTCG TGGGCTTCCT
GCTGCCCCTG AGTGTCATCA CCTTCTGCAC GATGCAGATC ATGCAGGTGC TGCGGAACAA CGAGATGCAG
AAGTTCAAGG AGATCCAGAC GGAGAGGAGG GCCACGGTGC TAGTCCTGGT TGTGCTGCTG CTATTCATCA
TCTGCTGGCT GCCCTTCCAG ATCAGCACCT TCCTGGATAC GCTGCATCGC CTCGGCATCC TCTCCAGCTG
CCAGGACGAG CGCATCATCG ATGTAATCAC ACAGATCGCC TCCTTCATGG CCTACAGCAA CAGCTGCCTC
AACCCACTGG TGTACGTGAT CGTGGGCAAG CGCTTCCGAA AGAAGTCTTG GGAGGTGTAC CAGGGAGTGT
GCCAGAAAGG GGGCTGCAGG TCAGAACCCA TTCAGATGGA GAACTCCATG GGCACACTGC GGACCTCCAT
CTCCGTGGAA CGCCAGATTC ACAAACTGCA GGACTGGGCA GGGAGCAGAC AGTGAGCAAA CGCCAGCAGG
GCTGCTGTGA ATTTGTGTAA GGATTGAGGG ACAGTTGCTT TTCAGCATGG GCCCAGGAAT GCCAAGGAGA
CATCTATGCA CGACCTTGGG AAATGAGTTG ATGTCTCCGG TAAAACACCG GAGACTAATT CCTGCCCTGC
CCAATTTTGC AGGGAGCATG GCTGTGAGGA TGGGGTGAAC TCACGCACAG CCAAGGACTC CAAAATCACA
ACAGCATTAC TGTTCTTATT TGCTGCCACA CCTGAGCCAG CCTGCTCCTT CCCAGGAGTG GAGGAGGCCT
GGGGGCAGGG AGAGGAGTGA CTGAGCTTCC CTCCCGTGTG TTCTCCGTCC CTGCCCCAGC AAGACAACTT
AGATCTCCAG GAGAACTGCC ATCCAGCTTT GGTGCAATGG CTGAGTGCAC AAGTGAGTTG TTGCCCTGGG
TTTCTTTAAT CTATTCAGCT AGAACTTTGA AGGACAATTT CTTGCATTAA TAAAGGTTAA GCCCTGAGGG
GTCCCTGATA ACAACCTGGA GACCAGGATT TTATGGCTCC CCTCACTGAT GGACAAGGAG GTCTGTGCCA
AAGAAGAATC CAATAAGCAC ATATTGAGCA CTTGCTGTAT ATGCAGTATT GAGCACTGTA GGCAAGAGGG
AAGAAAGAGA AGGAGCCATC TCCATCTTGA AGGAACTCAA AGACTCAAGT GGGAACGACT GGGCACTGCC
ACCACCAGAA AGCTGTTCGA TGAGACGGTC GAGCAGGGTG CTGTGGGTGA TATGGACAGC AGAAGGGGGA
GCCAGGTTCC AGCTCACCAA TACTATTGCA CACCACCTGT CCTGCCTC-3' (FRAQ. NO:_) (SEQ. ID NO 2441)
5'-CAGATTCACA AACTGCAGGA CTGGGCAGGG AGCAGACAGT GAGCAAACGC CAGCAGGGCT GCTGTGAATT
TGTGTAAGGA TTGAGGGACA GTTGCTTTTC AGCATGGGCC CAGGAATGCC AAGGAGACAT CTATGCACGA
CCTTGGGAAA TGAGTTGATG TCTCCGGTAA ACACCGGAG ACTAATTCCT GCCCTGCCCA ATTTTGCAGG
GAGCATGGCT GTGAGGATGG GGTGAACTCA CGCACAGCCA AGGACTCCAA AATCACAACA GCATTACTGT
TCTTATTTGC TGCCACACCT GAGCCAGCCT GCTCCTTCCC AGGAGTGGAG GAGGCCTGGG GGAGGGAGA
GGAGTGACTG AGCTTCCCTC CCGTGTGTTC TCCGTCCCTG CCCCAGCAAG ACAACTTAGA TCTCCAGGAG
AACTGCCATC CAGCTTTGGT GCAATGGCTG AGTGCACAAG TGAGTTGTTG CCCTGGGTTT CTTTAATCTA
TTCAGCTAGA ACTTTGAAGG ACAATTTCTT GCATTAATAA AGGTTAAGCC CTGAGGGTC CCTGATAACA
ACCTGGAGAC CAGGATTTTA TGGCTCCCCT CACTGATGGA CAAGGAGGTC TGTGCCAAAG AAGAATCCAA
TAAGCACATA TTGAGCACTT GCTGTATATG CAGTATTGAG CACTGTAGGC AAGACCCAAG AAAGAGAAGG
AGCCATCTCC ATCTTGAAGG AACTCAAAGA CTCAAGTGGG AACGACTGGG CACTGCCACC ACCAGAAAGC
TGTTCGACGA GACGGTCGAG CAGGGTGCTG TGGGTGATAT GGACAGCAGA AGGGGAGAC CAAGGTTCCA
```

-continued

```
GCTCAACCAA TAACTATTGC ACAACCACCT GTCCCTGCCT CAGTTCCCTT TTATGTAACA TGAAGTCGTT
GTGAGGGTTA AAGGCAGTAA CAGGTATAAA GTACTTAGAA AAGCAAAGGG TGCTACGTAC ATGTGAGGCA
TCATTACGCA GACGTAACTG GGATATGTTT ACTATAAGGA AAAGACACTG AGGTCTAGAA ATAGCTCCGT
GGAGCAGAAT CAGTATTGGG AGCCGGTGGC GGTGTGAAGC ACCAGTGTCT GGCACACAGT AGGTGCTCAT
TGGCTCCCTT CCACCTGTCA TTCCCACCAC CCTGAGGCCC CAACCGCCAC ACACACAGGA GCATTTGGAG
AGAAGGCCAT GTCTTCAAAG TCTGATTTGT GATGAGGCAG AGGAAGATAT TTCTAATCGG TCTTGCCCAG
AGGATCACAG TGCTGAGACC CCCCACCACC AGCCGGTACC TGGGAAGGGG GAGAGTGCAG GCCTGCTCAG
GGACTGTTCC TGTCTCAGCA ACCAAGGGAT TGTTCCTGTC AATCAATGGT TTATTGGAAG GTGGCCCAGT
ATGAGCCCTA GAAGAGTGTG AAAAGGAATG GCAATGGTGT TCACCATCGG CAGTGCCAGG GCAGCACTCA
TTCACTTGAT AAATGAATAT TTATTAGCTG GTTGGAGAGC TAGAACCTGG AGAGCTAGAA CCTGGAGAAC
TAGAACCTGG AGGGCTAGAA CCTGGAGAGG CTAGAACCAA GAAGGGCTAG AACCTGGAGG GGCTAGAACC
TAGAGAAGCT AAAACCTGAG CTAGAAGCTG GAGGACTAGA ACCTGGAGGG CTGGAATCTG AAGGGCTAGA
ACCTGGAGGG CTGGAATCTG GAGAGCTAGA ACCTGGAGGG CTAGAACCTG GAGGGCTAGA ACCTAGAAGG
GCTAGAACCT GGAGGGCTGG AATCTGGAGA GCTAGAACCT GGAGGGCTAG AACCTGGAGG GCTAGAACCT
AGAAGGGCTA GAACCTGGAG GGCTAGAACC TGGCAGGTTA GAACCTAGAA GGGCTAGAAC CTGGAGAGCC
AGAACCTGGA GGGCTAGAAC CTGGAAGGGC TAGAACCTGT AGAGCTAGAA CATGGAGAGC TAGAACCCGG
CAGGCTAGAA CCTGGCAAGC TAGAACCTGG AGGGAATGAA CCTGGAGGGC TAGAACCTGG AGAATGAGAA
AAATTTACAT GGCAAAGAGC CCATAAATCC TGACCAATCC AACTCTGAAT TTTAAAGCAA AAGCGTGAAA
AAAAAGATTC CCTCCTTACC CCCAACCCAC TCTTTTTTCC CACCACCCAC TCTCCTCTGC CTCAGTAAGT
ATCTGGAGGA AGAAAACAGG TGAAAGAAGA AGTAAAAACC ATTTAGTATT AGTATTAGAA TGAAGTCAAA
CTGTGCCACA CATGGTGAAT GAAAAAAAAA AAAAAGAGGC TGTGTTTTGT CACACAGGGC AGTCATTCAG
CACCAGAGCA CGTGATGGTC TGAGACTCTC TTAGGAGCAG AGCTCTGCCG CAATGGCCAT GTGGGGATCC
ACACCTGGTC TGAGGGCAA CTGAGTCTGC GGGAGAAGAG CGGCCCTATG CATGGTGTAG ATGCCCTGAT
AAAGAACATC TGTCCTGTGA AAGACTCAAT GAGCTGTTAT GTTGTAAACA GGAAGCATTT CACATCCAAA
CGAGAAAATC ATGTAAACAT GTGTCTTTTC TGTAGAGCAT AATAAATGGA TGAGGTTTTT GCAAAAAAAA
AAAAAAAAA-3' (FRAQ. NO:_) (SEQ. ID NO 2431)
5'-GGTGBCBTTGBGCBTGTCGGCGC-3' (FRAG. NO:2276) (SEQ. ID NO:2289)
5'-GGTCCCGTTBBGBGTGGGCCC-3' (FRAG. NO:2277) (SEQ. ID NO:2290)
5'-GCCAGCCCAGCCACTCCACTTGGGGGC-3' (FRAG. NO:2278) (SEQ. ID NO:2291)
5'-GGGTGGCCAGCACGAACAGCACCCAGAGGAAGGGGGGC-3' (FRAG. NO:2279) (SEQ. ID NO:2292)
5'-GGCCCAGAAGGGCAGCCCGCAGGCCAGGATCAGGTCTGCTGCGGCC-3'(FRAG.NO:2280)(SEQ.ID NO:2293)
5'-GGAGATAATGGCATTCACCACGCGGC-3' (FRAG. NO:2281) (SEQ. ID NO:2294)
5'-GGCCCAGCGCACGCCGCGCATCCGGCCC-3' (FRAG. NO:2282) (SEQ. ID NO:2295)
5'-GGGTTCTGACCTGCAGCCCCC-3' (FRAG. NO:2283) (SEQ. ID NO:2296)
5'-GTCTCCTTGGCATTCCTGGGCCC-3' (FRAG. NO:2284) (SEQ. ID NO:2297)
5'-CAGTCACTCCTCTCCCTGCCCCC-3' (FRAG. NO:2285) (SEQ. ID NO:2298)
5'-CTTGCTGGGGCAGGGACGG-3' (FRAG. NO:2286) (SEQ. ID NO:2299)
5'-GGTGBCBTTGBGCBTGTCGGCGC-3' (FRAG. NO:2287) (SEQ. ID NO:2300)
5'-GGTCCCGTTBBGBGTGGGCCC-3' (FRAG. NO:2288) (SEQ. ID NO:2301)
5'-GCCAGCCCAGCCACTCCACTTGGGGGC-3' (FRAG. NO:2289) (SEQ. ID NO:2302)
```

5'-GGGTGGCCAGCACGAACAGCACCCAGAGGAAGGGGGC-3' (FRAG. NO:2290) (SEQ. ID NO:2303)

5'-GGCCCAGAAGGGCAGCCCGCAGGCCAGGATCAGGTCTGCTGCGGCC-3' (FRAG.NO:2291)(SEQ.ID NO:2304)

5'-GGAGATAATGGCATTCACCACGCGGC-3' (FRAG. NO:2292) (SEQ. ID NO:2305)

5'-GGCCCAGCGCACGCCGCGCATCCGGCCC-3' (FRAG. NO:2293) (SEQ. ID NO:2306)

5'-GGGTTCTGACCTGCAGCCCCC-3' (FRAG. NO:2294) (SEQ. ID NO:2307)

5'-GTCTCCTTGGCATTCCTGGGCCC-3' (FRAG. NO:2295) (SEQ. ID NO:2308)

5'-CAGTCACTCCTCTCCCTGCCCCC-3' (FRAG. NO:2296) (SEQ. ID NO:2309)

5'-CTTGCTGGGGCAGGGACGG-3' (FRAG. NO:2297) (SEQ. ID NO:2310)

5'-CCGTGTTGTCBGTGGTGCTG-3' (FRAG. NO:2298) (SEQ. ID NO:2311)

5'-CCCGTTTGBGGTBTGGC-3' (FRAG. NO:2299) (SEQ. ID NO:2312)

5'-GCTCCBCCBBTTCCCTTTTCTCC-3' (FRAG. NO:2300) (SEQ. ID NO:2313)

5'-TTGTTTTCCGTTTCTCTTG-3' (FRAG. NO:2301) (SEQ. ID NO:2314)

5'-CCGTCTGTGGTT-3' (FRAG. NO:2302) (SEQ. ID NO:2315)

β2 Adrenergic Receptor Kinase Nucleic Acids and
Antisense Oligonucleotide Fragments 5'- GCCGCCGCCG CCAAGATGGC GGACCTGGAG GCGGTGCTGG CCGACGTGAG CTACCTGATG GCCATGGAGA
AGAGCAAGGC CACGCCGGCC GCGCGCGCCA GCAAGAAGAT ACTGCTGCCC GAGCCCAGCA TCCGCAGTGT
CATGCAGAAG TACCTGGAGG ACCGGGGCGA GGTGACCTTT GAGAAGATCT TTTCCCAGAA GCTGGGGTAC
CTGCTCTTCC GAGACTTCTG CCTGAACCAC CTGGAGGAGG CCAGGCCCTT GGTGGAATTC TATGAGGAGA
TCAAGAAGTA CGAGAAGCTG GAGACGGAGG AGGAGCGTGT GGCCCGCAGC CGGGAGATCT TCGACTCATA
CATCATGAAG GAGCTGCTGG CCTGCTCGCA TCCCTTCTCG AAGAGTGCCA CTGAGCATGT CCAAGGCCAC
CTGGGGAAGA AGCAGGTGCC TCCGGATCTC TTCCAGCCAT ACATCGAAGA GATTTGTCAA AACCTCCGAG
GGACGTGTT CCAGAAATTC ATTGAGAGCG ATAAGTTCAC ACGGTTTTGC CAGTGGAAGA ATGTGGAGCT
CAACATCCAC CTGACCATGA ATGACTTCAG CGTGCATCGC ATCATTGGGC GCGGGGCTT TGGCGAGGTC
TATGGGTGCC GGAAGGCTGA CACAGGCAAG ATGTACGCCA TGAAGTGCCT GGACAAAAAG CGCATCAAGA
TGAAGCAGGG GGAGACCCTG GCCCTGAACG AGCGCATCAT GCTCTCGCTC GTCAGCACTG GGGACTGCCC
ATTCATTGTC TGCATGTCAT ACGCGTTCCA CACGCCAGAC AAGCTCAGCT TCATCCTGGA CCTCATGAAC
GGTGGGGACC TGCACTACCA CCTCTCCCAG CACGGGGTCT TCTCAGAGGC TGACATGCGC TTCTATGCGG
CCGAGATCAT CCTGGGCCTG GAGCACATGC ACAACCGCTT CGTGGTCTAC CGGGACCTGA AGCCAGCCAA
CATCCTTCTG GACGAGCATG GCCACGTGCG GATCTCGGAC CTGGGCCTGG CCTGTGACTT CTCCAAGAAG
AAGCCCCATG CCAGCGTGGG CACCCACGGG TACATGGCTC CGGAGGTCCT GCAGAAGGGC GTGGCCTACG
ACAGCAGTGC CGACTGGTTC TCTCTGGGGT GCATGCTCTT CAAGTTGCTG CGGGGGCACA GCCCCTTCCG
GCAGCACAAG ACCAAAGACA AGCATGAGAT CGACCGCATG ACGCTGACGA TGGCCGTGGA GCTGCCCGAC
TCCTTCTCCC CTGAACTACG CTCCCTGCTG GAGGGGTTGC TGCAGAGGGA TGTCAACCGG AGATTGGGCT
GCCTGGGCCG AGGGGCTCAG GAGGTGAAAG AGAGCCCCTT TTTCCGCTCC CTGGACTGGC AGATGGTCTT
CTTGCAGAAG TACCCTCCCC CGCTGATCCC CCCACGAGGG GAGGTGAACG CGGCCGACGC CTTCGACATT
GGCTCCTTCG ATGAGGAGGA CACAAAAGGA ATCAAGTTAC TGGACAGTGA TCAGGAGCTC TACCGCAACT
TCCCCCTCAC CATCTCGGAG CGGTGGCAGC AGGAGGTGGC AGAGACTGTC TTCGACACCA TCAACGCTGA
GACAGACCGG CTGGAGGCTC GCAAGAAAGC CAAGAACAAG CAGCTGGGCC ATGAGGAAGA CTACGCCCTG -continued

```
GGCAAGGACT GCATCATGCA TGGCTACATG TCCAAGATGG GCAACCCCTT CCTGACCCAG TGGCAGCGGC
GGTACTTCTA CCTGTTCCCC AACCGCCTCG AGTGGCGGGG CGAGGGCGAG GCCCCGCAGA GCCTGCTGAC
CATGGAGGAG ATCCAGTCGG TGGAGGAGAC GCAGATCAAG GAGCGCAAGT GCCTGCTCCT CAAGATCCGC
GGTGGGAAAC AGTTCATTTT GCAGTGCGAT AGCGACCCTG AGCTGGTGCA GTGGAAGAAG GAGCTGCGCG
ACGCCTACCG CGAGGCCCAG CAGCTGGTGC AGCGGGTGCC CAAGATGAAG AACAAGCCGC GCTCGCCCGT
GGTGGAGCTG AGCAAGGTGC CGCTGGTCCA GCGCGGCAGT GCCAACGGCC TCTGACCCGC CCACCCGCCT
CCAGGAAGCT ACCTGGAGGA GGTGAGTCTT AGCGGATGAG TAGGAGTTGT CCACGGAGGA AGGTACACAG
AAGGGCTTCC AGGCCCAGGA AACAGCAGAG GCACAGAAGT GAGAATGGGT GGGTGAGTTG GTGGGAAAC
TCCAGGTGCA GAGGATGGTA GCGAAACAAA CTGGAGCATT AAGGTCCAAG TCCTCCAAGA TCTTGACTTG
CAGATTAAGG AGTTTGTTCA CCTAATCTGC TTTGGGCAGA GTGTGGTGAG TCCTAGAGAC CCCTCTAGGT
CTCTCCTCTC AGTAGCCCCA GAAGGCCTGG AGAGCTGCTT CTGGGTGCCA AGCAGGCAGT GACTCCATCA
GATCTAGATT TGGGAAAAGC ATCCCTGGTC AGGGCCTGCA TCAGGGCAGT GGCTGGCCAT GAGGACCCTG
AGAAGTAGAC AGATTCACGG AGATTCTCAG GAGGCCAGAC AGGAGACTAT GGTGACAAAT TAGATTAGAG
AAGGGGAGAG AATGAAGGAG CAGTTGGGGT AAAAGAAAAC TGAGGCTGAC ATGGGTATAT GGGTGGCGAG
TGACTCACCA CCCACTGAGA GGAGAACCTC ACAAGCTCTG ACATGCTCTG GTTCCAGGTT CTGTTGGGGC
TGATCCAAGA TGGTAGCCTA GAGGTGCACA GAGATGGGGG CCTTGCTTTG CAAAAGGATG CTGGCTGCTG
GCCCACAGCA TGGTAATGAG ATTTGAGCTT TATGTGCCCA GGGCTGGGAG GAGGGTCCTG TCACTTTGAA
AGCAAAGAGA GGCTCTAGAG AGGGGCATGT TGAGATAGGA ATGCTGCCTT GAGACACCTG GCTTTCCCCA
CTCTGGGTGG CTCTCAGCAG GGTGGGTTTC CCCTGCCAGG CAGCACTGAA CCTCTGTGCG CTTCCGGCTG
GGAGAGTTTT TACCGTAACT ACATGTGGAA CCATCCTGAA GGAACATCTG GATGGGATGG GGTACAGGGA
AGGGAGCTGC CAAGAGTGCT GGCCAGGGAC CTGGGTCTAT GAGCTGGTTG GGGGTGGGG TTGGGTGCAG
GGTACTTGAT CCTGAGTGGG CCTTCTGCGG CCAGGATTGG TTCTAGAGTA GGAGGGGTGG GATCGGGGAT
GGGGGAAGCC TGTAACTGCG CTGCAGTTGT CAGGTCCCAG GTTCTGGGTG ACCTACTAAG GATTCTGGGT
CCAGTGTGGG TCCCAGGTTA GACGTCCTAG TCCTGAGTCC GTGTCCACAG TTCTGGGTGT TGAGTCTAGG
ACAGTGATCT GGAGTTGACA GTCCAATCTA GGTCTGAGTC CTGACCCCAA GTCTAGAGTT CAGGGTCATG
GTAGTAGCCT AGGGTCAGAA TCAAGGTTGG GGTCAGTAAC CAGGATGGGA TCGAGGTCAT GGTCCAAAAT
CTGGATCTGG GGACCTGTTG GGGGTCTGAG GTGAGTGTCG CAGTCTGGGT ATGGCGTTGG AGACCCAGGG
CTGTGATCTG AGGTCATGGT TAGAGTCTCA GGTGGTGGGC CAAGGTTTGA GTCTGGGGTC CTGTTTGGAG
TCTGGTGTCA GGTCGTGGAC TGCGTCCAAG GTCAGGGAGT CCGGGGTTAT AGCCAGGGTC TGAGATGAAA
GTCCCAGATG GTGTTCAGAG GTCTGAATCT GTGTCTTGGT GAGCGTCCAG GTTCCCTGTG ATCACGTTTG
GTGTCAGGGC TGCGGCCCGA CTGGGAGCC TGGGATCCAG AGATGTGACC CGAGGTTGTG GTCAGAGAAT
GGGTCTCGGG TCGTCTTCGT GCCGGGTCCC TGTCGTGTTC CAGGCCCGGG TCTCCGTCCA GCATCGAGGG
CCGAGGTCAC GGCCAGGGTC TGAGCCCGCG GTCGCAGGTC TGGTTCGGGG TCAGATTCCG CGCGGCCTCC
AGGGGGCGCC GTCGCCGCCC GGCTCGGCCC CTCGCGGGCT CGCTGGCGTT GTGCGCGGCA GGCGGGGCCG
GAGGCGGCGG CGGCTCCGGG GGCGCGGGCC GGGCGGCGGC GGCGGCGGCG CCCCGACTGC AGTCCCGGCG
GGAGCGGAGC GCGAAGCGCG GGGCCGGGCC CGGAGCCGGC GCCATGGGGC GGCGCCGCCT GTGAGCGGCG
GCGAGCGGAG CCGCGGGCGC CGAGCAGGGC CAGGCGGGAG CGTCGGCGCC CGAGGCCGAG CGAGCCGCGG
CCGGGCCGGG CCGAGCGCCG AGCGAGCAGG AGCGGCGGCG GCGGCGGCGG CGGCGGGAGG AGGCAGCGCC
GCCGCCAAGA TGGCGGACCT GGAGGCGGTG CTGGCCGACG TGAGCTACCT GATGGCCATG GAGAAGAGCA
AGGCCACGCC GGCCGCGCGC GCCAGCAAGA AGATACTGCT GCCCGAGCCC AAGGTGAGGAG AAGCT-3' (FRAG.
```

NO:_) (SEQ. ID NO:2430)

5'-CCAGGAAGCT ACCTGGAGGA GGTGAGTCTT AGCGGATGAG TAGGAGTTGT CCACGGAGGA AGGTACACAG

AAGGGCTTCC AGGCCCAGGA ACAGCAGAG GCACAGAAGT GAGAATGGGT GGGTGAGTTG GTGGGGAAAC

TCCAGGTGCA GAGGATGGTA GCGAAACAAA CTGGAGCATT AAGGTCCAAG TCCTCCAAGA TCTTGACTTG

CAGATTAAGG AGTTTGTTCA CCTAATCTGC TTTGGGCAGA GTGTGGTGAG TCCTAGAGAC CCCTCTAGGT

CTCTCCTCTC AGTAGCCCCA GAAGGCCTGG AGAGCTGCTT CTGGGTGCCA AGCAGGCAGT GACTCCATCA

GATCTAGATT TGGGAAAAGC ATCCCTGGTC AGGGCCTGCA TCAGGGCAGT GGCTGGCCAT GAGGACCCTG

AGAAGTAGAC AGATTCACGG AGATTCTCAG GAGGCCAGAC AGGAGACTAT GGTGACAAAT TAGATTAGAG

AAGGGGAGAG AATGAAGGAG CAGTTGGGGT AAAAGAAAAC TGAGGCTGAC ATGGGTATAT GGGTGGCGAG

TGACTCACCA CCCACTGAGA GGAGAACCTC ACAAGCTCTG ACATGCTCTG GTTCCAGGTT CTGTTGGGGC

TGATCCAAGA TGGTAGCCTA GAGGTGCACA GAGATGGGGG CCTTGCTTTG CAAAAGGATG CTGGCTGCTG

GCCCACAGCA TGGTAATGAG ATTTGAGCTT TATGTGCCCA GGGCTGGGAG GAGGGTCCTG TCACTTTGAA

AGCAAAGAGA GGCTCTAGAG AGGGGCATGT TGAGATAGGA ATGCTGCCTT GAGACACCTG GCTTTCCCCA

CTCTGGGTGG CTCTCAGCAG GGTGGGTTTC CCCTGCCAGG CAGCACTGAA CCTCTGTGCG CTTCCGGCTG

GGAGAGTTTT TACCGTAACT ACATGTGGAA CCATCCTGAA GGAACATCTG GATGGGATGG GGTACAGGGA

AGGGAGCTGC CAAGAGTGCT GGCCAGGGAC CTGGGTCTAT GAGCTGGTTG GGGGTGGGG TTGGGTGCAG

GGTACTTGAT CCTGAGTGGG CCTTCTGCGG CCAGGATTGG TTCTAGAGTA GGAGGGGTGG GATCGGGGAT

GGGGGAAGCC TGTAACTGCG CTGCAGTTGT CAGGTCCCAG GTTCTGGGTG ACCTACTAAG GATTCTGGGT

CCAGTGTGGG TCCCAGGTTA GACGTCCTAG TCCTGAGTCC GTGTCCACAG TTCTGGGTGT TGAGTCTAGG

ACAGTGATCT GGAGTTGACA GTCCAATCTA GGTCTGAGTC CTGACCCCAA GTCTAGAGTT CAGGGTCATG

GTAGTAGCCT AGGGTCAGAA TCAAGGTTGG GGTCAGTAAC CAGGATGGGA TCGAGGTCAT GGTCCAAAAT

CTGGATCTGG GGACCTGTTG GGGGTCTGAG GTGAGTGTCG CAGTCTGGGT ATGGCGTTGG AGACCCAGGG

CTGTGATCTG AGGTCATGGT TAGAGTCTCA GGTGGTGGGC CAAGGTTTGA GTCTGGGTC CTGTTTGGAG

TCTGGTGTCA GGTCGTGGAC TGCGTCCAAG GTCAGGGAGT CCGGGGTTAT AGCCAGGGTC TGAGATGAAA

GTCCCAGATG GTGTTCAGAG GTCTGAATCT GTGTCTTGGT GAGCGTCCAG GTTCCCTGTG ATCACGTTTG

GTGTCAGGGC TGCCGCCCGA CTGGGGAGCC TGGGATCCAG AGATGTGACC CGAGGTTGTG GTCAGAGAAT

GGGTCTCGGG TCGTCTTCGT GCCGGGTCCC TGTCGTGTTC CAGGCCCGGG TCTCCGTCCA GCATCGAGGG

CCGAGGTCAC GGCCAGGGTC TGAGCCCGCG GTCGCAGGTC TGGTTCGGGG TCAGATTCCG CGCGGCCTCC

AGGGGGCGCC GTCGCCGCCC GGCTCGGCCC CTCGCGGGCT CGCTGGCGTT GTGCGCGGCA GGCGGGGCCG

GAGGCGGCGG CGGCTCCGGG GGCGCGGGCC GGGCGGCGGC GGCGGCGGCG CCCCGACTGC AGTCCCGGCG

GGAGCGGAGC GCGAAGCGCG GGGCCGGGCC CGGAGCCGGC GCCATGGGGC GGCGCCGCCT GTGAGCGGCG

GCGAGCGGAG CCGCGGGCGC CGAGCAGGGC CAGGCGGGAG CGTCGGCGCC CGAGGCCGAG CGAGCCGCGG

CCGGGCCGGG CCGAGCGCCG AGCGAGCAGG AGCGGCGGCG GCGGCGGCGG CGGCGGGAGG AGGCAGCGCC

GCCGCCAAGA TGGCGGACCT GGAGGCGGTG CTGGCCGACG TGAGCTACCT GATGGCCATG GAGAAGAGCA

AGGCCACGCC GGCCGCGCGC GCCAGCAAGA AGATACTGCT GCCCGAGCCC AGGTGAGGAG AAGCT-3' (FRAG.

NO:_) (SEQ. ID NO:2429)

5'-GCCGCCGCCG CCAAGATGGC GGACCTGGAG GCGGTGCTGG CCGACGTGAG CTACCTGATG GCCATGGAGA

AGAGCAAGGC CACGCCGGCC GCGCGCGCCA GCAAGAAGAT ACTGCTGCCC GAGCCCAGCA TCCGCAGTGT

CATGCAGAAG TACCTGGAGG ACCGGGGCGA GGTGACCTTT GAGAAGATCT TTTCCCAGAA GCTGGGGTAC

```
CTGCTCTTCC GAGACTTCTG CCTGAACCAC CTGGAGGAGG CCAGGCCCTT GGTGGAATTC TATGAGGAGA
TCAAGAAGTA CGAGAAGCTG GAGACGGAGG AGGAGCGTGT GGCCCGCAGC CGGGAGATCT TCGACTCATA
CATCATGAAG GAGCTGCTGG CCTGCTCGCA TCCCTTCTCG AAGAGTGCCA CTGAGCATGT CCAAGGCCAC
CTGGGGAAGA AGCAGGTGCC TCCGGATCTC TTCCAGCCAT ACATCGAAGA GATTTGTCAA AACCTCCGAG
GGGACGTGTT CCACAAATTC ATTGAGAGCG ATAAGTTCAC ACGGTTTTGC AGTGGAAGA ATGTGGAGCT
CAACATCCAC CTGACCATGA ATGACTTCAG CGTGCATCGC ATCATTGGGC GCGGGGCTT TGGCGAGGTC
TATGGGTGCC GGAAGGCTGA CACAGGCAAG ATGTACGCCA TGAAGTGCCT GGACAAAAAG CGCATCAAGA
TGAAGCAGGG GGAGACCCTG GCCCTGAACG AGCGCATCAT GCTCTCGCTC GTCAGCACTG GGGACTGCCC
ATTCATTGTC TGCATGTCAT ACGCGTTCCA CACGCCAGAC AAGCTCAGCT TCATCCTGGA CCTCATGAAC
GGTGGGGACC TGCACTACCA CCTCTCCCAG CACGGGTCT TCTCAGAGGC TGACATGCGC TTCTATGCGG
CCGAGATCAT CCTGGGCCTG GAGCACATGC ACAACCGCTT CGTGGTCTAC CGGGACCTGA AGCCAGCCAA
CATCCTTCTG GACGAGCATG GCCACGTGCG GATCTCGGAC CTGGGCCTGG CCTGTGACTT CTCCAAGAAG
AAGCCCCATG CCACCGTGGG CACCCACGGG TACATGGCTC CGGAGGTCCT GCAGAAGGGC GTGGCCTACG
ACAGCAGTGC CGACTGGTTC TCTCTGGGGT GCATGCTCTT CAAGTTGCTG CGGGGGCACA GCCCCTTCCG
GCAGCACAAG ACCAAAGACA AGCATGAGAT CGACCGCATG ACGCTGACGA TGGCCGTGGA GCTGCCCGAC
TCCTTCTCCC CTGAACTACG CTCCCTGCTG GAGGGGTTGC TGCAGAGGGA TGTCAACCGG AGATTGGGCT
GCCTGGGCCG AGGGGCTCAG GAGGTGAAAG AGAGCCCCTT TTTCCGCTCC CTGGACTGGC AGATGGTCTT
CTTGCAGAAG TACCCTCCCC CGCTGATCCC CCCACGAGGG GAGGTGAACG CGGCCGACGC CTTCGACATT
GGCTCCTTCG ATGAGGAGGA CACAAAAGGA ATCAAGTTAC TGGACAGTGA TCAGGAGCTC TACCGCAACT
TCCCCCTCAC CATCTCGGAG CGGTGGCAGC AGGAGGTGGC AGAGACTGTC TTCGACACCA TCAACGCTGA
GACAGACCGG CTGCAGGCTC GCAAGAAAGC CAAGAACAAG CAGCTGGGCC ATGAGGAAGA CTACGCCCTG
GGCAAGGACT GCATCATGCA TGGCTACATG TCCAAGATGG GCAACCCCTT CCTGACCCAG TGGCAGCGGC
GGTACTTCTA CCTGTTCCCC AACCGCCTCG AGTGGCGGGG CGAGGGCGAG GCCCCGCAGA GCCTGCTGAC
CATGGAGGAG ATCCAGTCGG TGGAGGAGAC GCAGATCAAG GAGCGCAAGT GCCTGCTCCT CAAGATCCGC
GGTGGGAAAC AGTTCATTTT GCAGTGCGAT AGCGACCCTG AGCTGGTGCA GTGGAAGAAG GAGCTGCGCG
ACGCCTACCG CGACGCCCAG CAGCTGGTGC AGCGGGTGCC CAAGATGAAG AACAAGCCGC GCTCGCCCGT
GGTGGAGCTG AGCAAGGTGC CGCTGGTCCA GCGCGGCAGT GCCAACGGCC TCTGACCCGC CCACCCGCCT-3'
(FRAG. NO:_) (SEQ. ID NO:2428)
```

CCR-2 CC Chemokine Receptor Nucleic Acids and
Antisense Oligonucleotide Fragments

```
5'-CTTTGTGAAG AAGGAATTGG CAACACTGAA ACCTCCAGAA CAAAGGCTGT CACTAAGGTC CCGCTGCCTT
GATGGATTAT ACACTTGACC TCAGTGTGAC AACAGTGACC GACTACTACT ACCCTGATAT CTTCTCAAGC
CCCTGTGATG CGGAACTTAT TCAGACAAAT GGCAAGTTGC TCCTTGCTGT CTTTTATTGC CTCCTGTTTG
TATTCAGTCT TCTGGGAAAC AGCCTGGTCA TCCTGGTCCT TGTGGTCTGC AAGAAGCTGA GGAGCATCAC
AGATGTATAC CTCTTGAACC TGGCCCTGTC TGACCTGCTT TTTGTCTTCT CCTTCCCCTT TCAGACCTAC
TATCTGCTGG ACCAGTGGGT GTTTGGGACT GTAATGTGCA AAGTGGTGTC TGGCTTTTAT TACATTGGCT
TCTACAGCAG CATGTTTTTC ATCACCCTCA TGAGTGTGGA CAGGTACCTG GCTGTTGTCC ATGCCGTGTA
TGCCCTAAAG GTGAGGACGA TCAGGATGGG CACAACGCTG TGCCTGGCAG TATGGCTAAC CGCCATTATG
GCTACCATCC CATTGCTAGT GTTTTACCAA GTGGCCTCTG AAGATGGTGT CTACAGTGT TATTCATTTT
ACAATCAACA GACTTTGAAG TGGAAGATCT TCACCAACTT CAAAATGAAC ATTTTAGGCT TGTTGATCCC
```

```
ATTCACCATC TTTATGTTCT GCTACATTAA AATCCTGCAC CAGCTGAAGA GGTGTCAAAA CCACAACAAG

ACCAAGGCCA TCAGGTTGGT GCTCATTGTG GTCATTGCAT CTTTACTTTT CTGGGTCCCA TTCAACGTGG

TTCTTTTCCT CACTTCCTTG CACAGTATGC ACATCTTGGA TGGATGTAGC ATAAGCCAAC AGCTGACTTA

TGCCACCCAT GTCACAGAAA TCATTTCCTT TACTCACTGC TGTGTGAACC CTGTTATCTA TGCTTTTGTT

GGGGAGAAGT TCAAGAAACA CCTCTCAGAA ATATTTCAGA AAAGTTGCAG CCAAATCTTC AACTACCTAG

GAAGACAAAT GCCTAGGGAG AGCTGTGAAA AGTCATCATC CTGCCAGCAG CACTCCTCCC GTTCCTCCAG

CGTAGACTAC ATTTTGTGAG GATCAATGAA GACTAAATAT AAAAAACATT TTCTTGAATG GCATGCTAGT

AGCAGTGAGC AAAGGTGTGG GTGTGAAAGG TTTCCAAAAA AAGTTCAGCA TGAAGGATGC CGTGTGTGTT

GTTGCCAACA CTTGGAACAC AATGACTGGA GACATAGTTG TGCATGCCTG GCACAACATC AAGCCTGTGA

TTGTGTTTAT TGATGATGTT GAACAAGTGG TGGCTTTGAG GGATTCTGTA TGCCAAGTGG AAAAAAAAGA

TGTCTCCGGA ATTCGACAGG TTATCA-3' (FRAG. NO:_) (SEQ. ID NO:2462)
```

CCR-4 CC Chemokine Receptor Nucleic Acids and
Antisense Oligonucleotide Fragments

```
5'-TTTCATCTCT CCCGGCTTAT TTGCTGGTTT CTCCGAATGC GGGCCTTGTC TGGTTCACGC TGGATCCCCA

ACGCCTAGAA CAGTGCGTGG CACGCAGTTC GTCCTTCTAT AAATATCGGA CTAAATGCAT CTCTGTGATG

GTAATACCCA CACCGTGTTG TGAGAATGAA TGAGTGATTC TGTGCAAGTT CCTAGTGATC TGTTACAAAA

AGTACTGGTC GCTAAATTAC TCTTATAATA AAGCATACTT TTAGGATAAT AAAGCACTAT TCGCGAATTG

GTTACCGCTA TTATGAAATT ACTGAGCAAT ACATATCTAC ATCTGATCAG TCTCCAGAAT TATGCCAAAT

CCTACCTTCT TCTGAAAGTA TCTCCTAATT ATCTGCACCT GACCCTAGTG ATGCTGTGAA TGTGCAAGTA

TAGCTACATC CTCCGAAGGA AGGATCTTTA CTCCTTTTAC CTCCTGAATG GGCTGCGTCT GCTGAAAGCG

CGGGGGAATG GGCGGTTGGA AGCTTGGCCC TACTTCCAGC ATTGCCGCCT ACTGGTTGGG TTACTCCAGC

AAGTCACTCC CCTTCCCTGG GCCTCAGTGT CTCTACTGTA GCATTCCCAG GTCTGGAATT CCATCCACTT

TAGCAAGGAT GGACGCGCCA CAGAGAGACG CGTTCCTAGC CCGCGCTTCC CACCTGTCTT CAGGCGCATC

CCGCTTCCCT CAAACTTAGG AAATGCCTCT GGGAGGTCCT GTCCGGCTCC GGACTCACTA CCGACCACCC

GCAAACAGCA GGGTCCCCTG GCTTCCCAA GCCGCGCACC TCTCCGCCCC GCCCCTGCGC CCTCCTTCCT

CGCGTCTGCC CCTCTCCCCC ACCCCGCCTT CTCCCTCCCC GCCCCAGCGG CGCATGCGCC GCGCTCGGAG

CGTGTTTTTA TAAAAGTCCG GCCGCGGCCA GAAACTTCAG TTTGTTGGCT GCGGCAGCAG GTAGCAAAGT

GACGCCGAGG GCCTGAGTGC TCCAGTAGCC ACCGCATCTG GAGAACCAGC GGTTACCATG GAGGGGATCA

GTGTAAGTCC AGTTTCAACC TGCTTTGTCA TAAATGTACA AACGTTTGAA CTTAGAGCGC AGCCCCTCTC

CGAGCGGGCA GAAGCGGCCA GGACATTGGA GGTACCCGTA CTCCAAAAAA GGGTCACCGA AAGGAGTTTT

CTTGACCATG CCTATATAGT GCGGGTGGGT GGGGGGGAG CAGGATTGGA ATCTTTTTCT CTGTGAGTCG

AGGAGAAACG ACTGGAAAGA GCGTTCCAGT GGCTGCATGT GTCTCCCCCT TGAGTCCCGC CGCGCGCGGC

GGCTTGCACG CTGTTTGCAA ACGTAAGAAC ATTCTGTGCA CAAGTGCAGA GAAGGCGTGC GCGCTGCCTC

GGGACTCAGA CCACCGGTCT CTTCCTTGGG GAAGCGGGGA TGTCTTGGAG CGAGTTACAT TGTCTGAATT

TAGAGGCGGA GGGCGGCGTG CCTGGGCTGA CTTCCCAGGA GGAGATTGCG CCCGCTTTAA CTTCGGGGTT

AAGCGCCTGG TGACTGTTCT TGACACTGGG TGCGTGTTTG TTAAACTCTG TGCGGCCGAC GGAGCTGTGC

CAGTCTCCCA GCACAGTAGG CAGAGGGCGG GAGAGGCGGG TGGACCCACC GCGCCGATCC TCTGAGGGGA

TCGAGTGGTG GCACCAGCTA GGAGTTGATC CGCCCGCGCG CTTTGGGTTT GAGGGGGAAA CCTTCCCGCC

GTCCGAAGCG CGCCTCTTCC CCACGGCCGC GAGTGGGTCC TGCAGTTCGA GAGTTTGGGG TCGTGCAGAG
```

-continued

```
GTCAGCGGAG TGGTTTGACC TCCCCTTTGA CACCGCGCAG CTGCCAGCCC TGAGATTTGC GCTCCGGGGA

TAGGAGCGGG TACCGGGTGA GGGGCGGGGG CGGTTAAGAC CGCACCTGGG CTGCCAGGTC GCCGCCGCGA

AGACTGGCAG GTGCAAGTGG GGAAACCGTT TGGCTCTCTC CGAGTCCAGT TGTGATGTTT AACCGTCGGT

GGTTTCCAGA AACCTTTTGA AACCCTCTTG CTAGGGAGTT TTTGGTTTCC TGCAGCGGCG CGCAATTCAA

AGACGCTCGC GGCGGAGCCG CCCAGTCGCT CCCCAGCACC CTGTGGGACA GAGCCTGGCG TGTCGCCCAG

CGGAGCCCCT GCACCGCTGC TTGCGGGCGG TTGGCGTGGG TGTAGTGGGC AGCCGCGGCG GCCCGGGGCT

GGACGACCCG GCCCCCCGCG TGCCCACCGC CTGGAGGCTT CCAGCTGCCC ACCTCCGGCC GGGTTAACTG

GATCAGTGGC GGGGTAATGG GAAGCCACCC GGGAGAGTGA GGAAATGAAA CTTGGGGCGA GGACCACGGG

TGCAGACCCC GTTACCTTCT CCACCCAGGA AAATGCCCCG CTCCCTAACG TCCCAAACGC GCCAAGTGAT

AAACACGAGG ATGGCAAGAG ACCCACACAC CGGAGGAGCG CCCGCTTGGG GGAGGAGGTG CCGTTTGTTC

ATTTTCTGAC ACTCCCGCCC AATATACCCC AAGCACCGAA GGGCCTTCGT TTTAAGACCG CATTCTCTTT

ACCCACTACA AGTTGCTTGA AGCCCAGAAT GGTTTGTATT TAGGCAGGCG TGGGAAAATT AAGTTTTTGC

GCTTTAGGAG AATGAGTCTT TGCAACGCCC CCGCCCTCCC CCCGTGATCC TCCCTTCTCC CCTCTTCCCT

CCCTGGGCGA AAAACTTCTT ACAAAAAGTT AATCACTGCC CCTCCTAGCA GCACCCACCC CACCCCCCAC

GCCGCCTGGG AGTGGCCTCT TTGTGTGTAT TTTTTTTTTC CTCCTAAGGA AGGTTTTTTT TCTTCCCTCT

AGTGGGCGGG GCAGAGGAGT TAGCCAAGAT GTGACTTTGA AACCCTCAGC GTCTCAGTGC CCTTTTGTTC

TAAACAAAGA ATTTTGTAAT TGGTTCTACC AAAGAAGGAT ATAATGAAGT CACTATGGGA AAAGATGGGG

AGGAGAGTTG TAGGATTCTA CATTAATTCT CTTGTGCCCT TAGCCCACTA CTTCAGAATT CCTGAAGAA

AGCAAGCCTG AATCGGTTTT TTAAATTGCT TTAAAAATTT TTTTTAACTG GGTTAATGCT TGCTGAATTG

GAAGTGAATG TCCATTCCTT TGCCTCTTTT GCAGATATAC ACTTCAGATA ACTACACCGA GGAAATGGGC

TCAGGGACT ATGACTCCAT GAAGGAACCC TGTTTCCGTG AAGAAAATGC TAATTTCAAT AAAATCTTCC

TGCCCACCAT CTACTCCATC ATCTTCTTAA CTGGCATTGT GGGCAATGGA TTGGTCATCC TGGTCATGGG

TTACCAGAAG AAACTGAGAA GCATGACGGA CAAGTACAGG CTGCACCTGT CAGTGGCCGA CCTCCTCTTT

GTCATCACGC TTCCCTTCTG GCAGTTGAT GCCGTGGCAA ACTGGTACTT TGGGAACTTC CTATGCAAGG

CAGTCCATGT CATCTACACA GTCAACCTCT ACAGCAGTGT CCTCATCCTG GCCTTCATCA GTCTGGACCG

CTACCTGGCC ATCGTCCACG CCACCAACAG TCAGAGGCCA AGGAAGCTGT GGCTGAAAA GGTGGTCTAT

GTTGGCGTCT GGATCCCTGC CCTCCTGCTG ACTATTCCCG ACTTCATCTT TGCCAACGTC AGTGAGGCAG

ATGACAGATA TATCTGTGAC CGCTTCTACC CCAATGACTT GTGGGTGGTT GTGTTCCAGT TTCAGCACAT

CATGGTTGGC CTTATCCTGC CTGGTATTGT CATCCTGTCC TGCTATTGCA TTATCATCTC CAAGCTGTCA

CACTCCAAGG GCCACCAGAA GCGCAAGGCC CTCAAGACCA CAGTCATCCT CATCCTGGCT TTCTTCGCCT

GTTGGCTGCC TTACTACATT GGGATCAGCA TCGACTCCTT CATCCTCCTG GAAATCATCA AGCAAGGGTG

TGAGTTTGAG AACACTGTGC ACAAGTGGAT TTCCATCACC GAGGCCCTAG CTTTCTTCCA CTGTTGTCTG

AACCCCATCC TCTATGCTTT CCTTGGAGCC AAATTTAAAA CCTCTGCCCA GCACGCACTC ACCTCTGTGA

GCAGAGGGTC CAGCCTCAAG ATCCTCTCCA AAGGAAAGCG AGGTGGACAT TCATCTGTTT CCACTGAGTC

TGAGTCTTCA AGTTTTCACT CCAGCTAACA CAGATGTAAA AGACTTTTTT TTATACGATA ATAACTTTT

TTTTAAGTTA CACATTTTTC AGATATAAAA GACTGACCAA TATTGTACAG TTTTTATTGC TTGTTGGATT

TTTGTCTTGT GTTTCTTTAG TTTTTGTGAA GTTAATTGA CTTATTTATA TAAATTTTTT TTGTTTCATA

TTGATGTGTG TCTAGGCAGG ACCTGTGGCC AAGTTCTTAG TTGCTGTATG TCTCGTGGTA GGACTGTAGA

AAAGGGAACT GAACATTCCA GAGCGTGTAG TGAATCACGT AAAGCTAGAA ATGATCCCCA GCTGTTTATG

CATAGATAAT CTCTCCATTC CCGTGGAACG TTTTTCCTGT TCTTAAGACG TGATTTTGCT GTAGAAGATG
```

-continued

```
GCACTTATAA CCAAAGCCCA AAGTGGTATA GAAATGCTGG TTTTTCAGTT TTCAGGAGTG GGTTGATTTC

AGCACCTACA GTGTACAGTC TTGTATTAAG TTGTTAATAA AAGTACATGT TAAACTTACT TAGTGTTATG

TTCTGATTTC TGTTGACATT CTTTTGGCTA GTAGAAGACA AAAGTAATAC ATTTATGGTA TGCAAAGCAC

TATCCTAGGT ATTTCATTGT AATATTTTAC TTACCCCTTA TCACAACTCT GATAGATTCT GCTTCTGTTA

CTAATTACAT TTTATAGAAG AGGAAACGGA GGCACAGAAA GCCTAAGTAA CTTGGTTAAA GGCATGTAGT

AAGTATCAAA TCCTGTATTT TAAACCAGGT AACATGACTT AACGAATCTG AAGCCTTCAC CACTTTAAAT

TCAAATGGAA GTTTAGAAAT GGCCAGCCAG CACCTATTTG TATGAAAGGT CATCTTTCAG AGGATAAGCA

TGTATAAAGA AGAAAAGGTA TGCAGTCGTG TTTGGATTTT ACTCCACCAT C-3'  (FRAG. NO:_) (SEQ. ID NO: 2463)
```

CD-34 Nucleic Acids and
Antisense Oligonucleotide Fragments

```
5'-AGGATGATGG TGATGGGGAA CTAAATGGGG AAATATGGAA GGTCACAGGA AAAGTTAACA CAAGTTAGCA

AAAGTTAAC ATAACACAAA AAGGTCTTGC AGGAAAAAAA AAAGAAAAGA AAAGAAAGAA AAAGTCTCCA

AGAATGGTTT GGACAGCCAA AATGAATACT TATAGTCACG TATACCTGCT CACTCCTGAC GCTTCACTCA

CACACAGCAC AGGATCTGGT GAGGCTATCA TAAATGTGC CACATTGTGG TTAAGTTTTA CCTGATTAAC

GAAATGCTCA CACTTCTAAA CTGAGGTCCT TACAGTAGAT TCCTTTTGCA AGATTGTTAC TGGCTTACAA

CTTAAAAATA AAGGAAAATC ACAAGGAAAG AAAAGTGGGG AAAAAATCGG AGGAAACTTG CCCCTGCCCT

GGCCACCGGC AAGGCTGCCA CAAAGGGGTT AAAAGTTAAG TGGAAGTGGA GCTTGAAGAA GTGGGATGGG

GCCTCTCCAG GAAAGCTGAA CGAGGCATCT GGAGCCCGAA CAAACCTCCA CCTTTTTTGG CCTCGACGGC

GGCAACCCAG CCTCCCTCCT AACGCCCTCC GCCTTTGGGA CCAACCAGGG GAGCTCAAGT TAGTAGCAGC

CAAGGAGAGG CGCTGCCTTG CCAAGACTAA AAAGGGAGGG GAGAAGAGAG GAAAAAAGCA AGAATCCCCC

ACCCCTCTCC CGGGCGGAGG GGGCGGGAAG AGCGCGTCCT GGCCAAGCCG AGTAGTGTCT TCCACTCGGT

GCGTCTCTCT AGGAGCCGCG CGGGAAGGAT GCTGGTCCGC AGGGGCGCGC GCGCAGGGCC CAGGATGCCG

CGGGGCTGGA CCGCGCTTTG CTTGCTGAGT TTGCTGC CCTTTTTTGG CCTCGACGGC GGCAACCCAG

CCTCCCTCCT AACGCCCTCC GCCTTTGGGA CCAACCAGGG GAGCTCAAGT TAGTAGCAGC CAAGGAGAGG

CGCTGCCTTG CCAAGACTAA AAAGGGAGGG GAGAAGAGAG GAAAAAAGCA AGAATCCCCC ACCCCTCTCC

CGGGCGGAGG GGGCGGGAAG AGCGCGTCCT GGCCAAGCCG AGTAGTGTCT TCCACTCGGT GCGTCTCTCT

AGGAGCCGCG CGGGAAGGAT GCTGGTCCGC AGGGGCGCGC GCGAGGGCCC AGGATGCCGC GGGGCTGGAC

CGCGCTTTGC TTGCTGAGTT TGCTGCCTTC TGGGTTCATG AGTCTTGACA CAACGGTAC TGCTACCCCA

GAGTTACCTA CCCAGGGAAC ATTTTCAAAT GTTTCTACAA ATGTATCCTA CCAAGAAACT ACAACACCTA

GTACCCTTGG AAGTACCAGC CTGCACCCTG TGTCTCAACA TGGCAATGAG GCCACAACAA ACATCACAGA

AACGACAGTC AAATTCACAT CTACCTCTGT GATAACCTCA GTTTATGGAA ACACAAACTC TTCTGTCCAG

TCACAGACCT CTGTAATCAG CACAGTGTTC ACCACCCCAG CCAACGTTTC AACTCCAGAG CAAACCTTGA

AGCCTAGCCT GTCACCTGGA AATGTTTCAG ACCTTTCAAC CACTAGCACT AGCCTTGCAA CATCTCCCAC

TAAACCCTAT ACATCATCTT CTCCTATCCT AAGTGACATC AAGGCAGAAA TCAAATGTTC AGGCATCAGA

GAAGTGAAAT TGACTCAGGG CATCTGCCTG GAGCAAAATA AGACCTCCAG CTGTGCGGAG TTTAAGAAGG

ACAGGGGAGA GGGCCTGGCC CGAGTGCTGT GTGGGGAGGA GCAGGCTGAT GCTGATGCTG GGGCCCAGGT

ATGCTCCCTG CTCCTTGCCC AGTCTGAGGT GAGGCCTCAG TGTCTACTGC TGGTCTTGGC CAACAGAACA

GAAATTTCCA GCAAACTCCA ACTTATGAAA AAGCACCAAT CTGACCTGAA AAAGCTGGGG ATCCTAGATT

TCACTGAGCA AGATGTTGCA AGCCACCAGA GCTATTCCCA AAAGACCCTG ATTGCACTGG TCACCTCGGG
```

AGCCCTGCTG GCTGTCTTGG GCATCACTGG CTATTTCCTG ATGAATCGCC GCAGCTGGAG CCCCACAGGA

GAAAGGCTGG GCGAAGACCC TTATTACACG GAAAACGGTG GAGGCCAGGG CTATAGCTCA GGACCTGGGA

CCTCCCCTGA GGCTCAGGGA AAGGCCAGTG TGAACCGAGG GGCTCAGAAA ACGGGACCG GCCAGGCCAC

CTCCAGAAAC GGCCATTCAG CAAGACAACA CGTGGTGGCT GATACCGAAT TGTGACTCGG CTAGGTGGGG

CAAGGCTGGG CAGTGTCCGA GAGAGCACCC CTCTCTGCAT CTGACCACGT GCTACCCCCA TGCTGGAGGT

GACATCTCTT ACGCCCAACC CTTCCCCACT GCACACACCT CAGAGGCTGT TCTTGGGCC CTACACCTTG

AGGAGGGGGC AGGTAAACTC CTGTCCTTTA CACATTCGGC TCCCTGGAGC CAGACTCTGG TCTTCTTTGG

GTAAACGTGT GACGGGGGAA AGCCAAGGTC TGGAGAAGCT CCCAGGAACA ATCGATGGCC TTGCAGCACT

CACACAGGAC CCCCTTCCCC TACCCCCTCC TCTCTGCCGC AATACAGGAA CCCCAGGGG AAAGATGAGC

TTTTCTAGGC TACAATTTTC TCCCAGGAAG CTTTGATTTT TACCGTTTCT TCCCTGTATT TTCTTTCTCT

ACTTTGAGGA AACCAAAGTA ACCTTTTGCA CCTGCTCTCT TGTAATGATA TAGCCAGAAA AACGTGTTGC

CTTGAACCAC TTCCCTCATC TCTCCTCCAA GACACTGTGG ACTTGGTCAC CAGCTCCTCC CTTGTTCTCT

AAGTTCCACT GAGCTCCATG TGCCCCTCT ACCATTTGCA GAGTCCTGCA CAGTTTTCTG GCTGGAGCCT

AGAACAGGCC TCCCAAGTTT TAGGACAAAC AGCTCAGTTC TAGTCTCTCT GGGGCCACAC AGAAACTCTT

TTTGGGCTCC TTTTTCTCCC TCTGGATCAA AGTAGGCAGG ACCATGGGAC CAGGTCTTGG AGCTGAGCCT

CTCACCTGTA CTCTTCCGAA AAATCCTCTT CCTCTGAGGC TGGATCCTAG CCTTATCCTC TGATCTCCAT

GGCTTCCTCC TCCCTCCTGC CGACTCCTGG GTTGAGCTGT TGCCTCAGTC CCCCAACAGA TGCTTTTCTG

TCTCTGCCTC CCTCACCCTG AGCCCCTTCC TTGCTCTGCA CCCCCATATG GTCATAGCCC AGATCAGCTC

CTAACCCTTA TCACCAGCTG CCTCTTCTGT GGGTGACCCA GGTCCTTGTT TGCTGTTGAT TTCTTTCCAG

AGGGGTTGAG CAGGGATCCT GGTTTCAATG ACGGTTGGAA ATAGAAATTT CCAGAGAAGA GAGTATTGGG

TAGATATTTT TTCTGAATAC AAAGTGATGT GTTTAAATAC TGCAATTAAA GTGATACTGA AACAC-3' (FRAG.NO:_)

(SEQ. ID NO:2466)

5'-AGGATGATGG TGATGGGGAA CTAAATGGGG AAATATGGAA GGTCACAGGA AAAGTTAACA CAAGTTAGCA

AAAAGTTAAC ATAACACAAA AAGGTCTTGC AGGAAAAAAA AAAGAAAAGA AAAGAAAGAA AAAGTCTCCA

AGAATGGTTT GGACAGCCAA AATGAATACT TATAGTCACG TATACCTGCT CACTCCTGAC GCTTCACTCA

CACACAGCAC AGGATCTGGT GAGGCTATCA CTAAATGTGC CACATTGTGG TTAAGTTTTA CCTGATTAAC

GAAATGCTCA CACTTCTAAA CTGAGGTCCT TACAGTAGAT TCCTTTTGCA AGATTGTTAC TGGCTTACAA

CTTAAAAATA AAGGAAAATC ACAAGGAAAG AAAAGTGGGG AAAAAATCGG AGGAAACTTG CCCCTGCCCT

GGCCACCGGC AAGGCTGCCA CAAAGGGGTT AAAAGTTAAG TGGAAGTGGA GCTTGAAGAA GTGGGATGGG

GCCTCTCCAG GAAAGCTGAA CGAGGCATCT GGAGCCCGAA CAAACCTCCA CCTTTTTTGG CCTCGACGGC

GGCAACCCAG CCTCCCTCCT AACGCCCTCC GCCTTTGGGA CCAACCAGGG GAGCTCAAGT TAGTAGCAGC

CAAGGAGAGG CGCTGCCTTG CCAAGACTAA AAAGGGAGGG GAGAAGAGAG GAAAAAGCA AGAATCCCCC

ACCCCTCTCC CGGGCGGAGG GGGCGGGAAG AGCGCGTCCT GGCCAAGCCG AGTAGTGTCT TCCACTCGGT

GCGTCTCTCT AGGAGCCGCG CGGGAAGGAT GCTGGTCCGC AGGGGCGCGC GCGCAGGGCC CAGGATGCCG

CGGGGCTGGA CCGCGCTTTG CTTGCTGAGT TTGCTGC-3' (FRAG. NO:_) (SEQ. ID NO:2464)

5'-CCTTTTTTGG CCTCGACGGC GGCAACCCAG CCTCCCTCCT AACGCCCTCC GCCTTTGGGA CCAACCAGGG

GAGCTCAAGT TAGTAGCAGC CAAGGAGAGG CGCTGCCTTG CCAAGACTAA AAAGGGAGGG GAGAAGAGAG

GAAAAAGCA AGAATCCCCC ACCCCTCTCC CGGGCGGAGG GGGCGGGAAG AGCGCGTCCT GGCCAAGCCG

AGTAGTGTCT TCCACTCGGT GCGTCTCTCT AGGAGCCGCG CGGGAAGGAT GCTGGTCCGC AGGGGCGCGC

GCGAGGGCCC AGGATGCCGC GGGGCTGGAC CGCGCTTTGC TTGCTGAGTT TGCTGCCTTC TGGGTTCATG

```
AGTCTTGACA ACAACGGTAC TGCTACCCCA GAGTTACCTA CCCAGGGAAC ATTTTCAAAT GTTTCTACAA
ATGTATCCTA CCAAGAAACT ACAACACCTA GTACCCTTGG AAGTACCAGC CTGCACCCTG TGTCTCAACA
TGGCAATGAG GCCACAACAA ACATCACAGA AACGACAGTC AAATTCACAT CTACCTCTGT GATAACCTCA
GTTTATGGAA ACACAAACTC TTCTGTCCAG TCACAGACCT CTGTAATCAG CACAGTGTTC ACCACCCCAG
CCAACGTTTC AACTCCAGAG ACAACCTTGA AGCCTAGCCT GTCACCTGGA AATGTTTCAG ACCTTTCAAC
CACTAGCACT AGCCTTGCAA CATCTCCCAC TAAACCCTAT ACATCATCTT CTCCTATCCT AAGTGACATC
AAGGCAGAAA TCAAATGTTC AGGCATCAGA GAAGTGAAAT TGACTCAGGG CATCTGCCTG GAGCAAAATA
AGACCTCCAG CTGTGCGGAG TTTAAGAAGG ACAGGGGAGA GGGCCTGGCC CGAGTGCTGT GTGGGGAGGA
GCAGGCTGAT GCTGATGCTG GGGCCCAGGT ATGCTCCCTG CTCCTTGCCC AGTCTGAGGT GAGGCCTCAG
TGTCTACTGC TGGTCTTGGC AACAGAACA GAAATTTCCA GCAAACTCCA ACTTATGAAA AGCACCAAT
CTGACCTGAA AAAGCTGGGG ATCCTAGATT TCACTGAGCA AGATGTTGCA AGCCACCAGA GCTATTCCCA
AAAGACCCTG ATTGCACTGG TCACCTCGGG AGCCCTGCTG GCTGTCTTGG GCATCACTGG CTATTTCCTG
ATGAATCGCC GCAGCTGGAG CCCCACAGGA GAAAGGCTGG GCGAAGACCC TTATTACACG GAAAACGGTG
GAGGCCAGGG CTATAGCTCA GGACCTGGGA CCTCCCCTGA GGCTCAGGGA AAGGCCAGTG TGAACCGAGG
GGCTCAGAAA AACGGGACCG GCCAGGCCAC CTCCAGAAAC GGCCATTCAG CAAGACAACA CGTGGTGGCT
GATACCGAAT TGTGACTCGG CTAGGTGGGG CAAGGCTGGG CAGTGTCCGA GAGAGCACCC CTCTCTGCAT
CTGACCACGT GCTACCCCCA TGCTGGAGGT GACATCTCTT ACGCCCAACC CTTCCCCACT GCACACACCT
CAGAGGCTGT TCTTGGGGCC CTACACCTTG AGGAGGGGC AGGTAAACTC CTGTCCTTTA CACATTCGGC
TCCCTGGAGC CAGACTCTGG TCTTCTTTGG GTAAACGTGT GACGGGGAA AGCCAAGGTC TGGAGAAGCT
CCCAGGAACA ATCGATGGCC TTGCAGCACT CACACAGGAC CCCCTTCCCC TACCCCTCC TCTCTGCCGC
AATACAGGAA CCCCCAGGGG AAAGATGAGC TTTTCTAGGC TACAATTTTC TCCCAGGAAG CTTTGATTTT
TGCAATTAAA GTGATACTGA AACAC-3' (FRAG. No:_) (SEQ. ID NO:2465)
```

Eotaxin Antisense Nucleic Acids and
Oligonucleotide Fragments

```
5'-GCATTTTTC AAGTTTTATG ATTTATTTAA CTTGTGGAAC AAAAATAAAC CAGAAACCAC CACCTCTCAC
GCCAAAGCTC ACACCTTCAG CCTCCAACAT GAAGGTCTCC GCAGCACTTC TGTGGCTGCT GCTCATAGCA
GCTGCCTTCA GCCCCAGGG GCTCGCTGGG CCAGCTTCTG TCCCAACCAC CTGCTGCTTT AACCTGGCCA
ATAGGAAGAT ACCCCTTCAG CGACTAGAGA GCTACAGGAG AATCACCAGT GGCAAATGTC CCCAGAAAGC
TGTGATCTTC AAGACCAAAC TGGCCAAGGA TATCTGTGCC GACCCCAAGA AGAAGTGGGT GCAGGATTCC
ATGAAGTATC TGGACCAAAA ATCTCCAACT CCAAAGCCAT AAATAATCAC CATTTTTGAA ACCAAACCAG
AGCCTGAGTG TTGCCTAATT TGTTTTCCCT TCTTACAATG CATTCTGAGG TAACCTCATT ATCAGTCCAA
AGGGCATGGG TTTTATTATA TATATATATA TTTTTTTTTT AAAAAAAAAC GTATTGCATT TAATTTATTG
AGGCTTTAAA ACTTATCCTC CATGAATATC AGTTATTTTT AAACTGTAAA GCTTTGTGCA GATTCTTTAC
CCCCTGGGAG CCCCAATTCG ATCCCCTGTC ACGTGTGGGC AATGTTCCCC CTCTCCTCTC TTCCTCCCTG
GAATCTTGTA AAGGTCCTGG CAAAGATGAT CAGTATGAAA ATGTCATTGT TCTTGTGAAC CCAAAGTGTG
ACTCATTAAA TGGAAGTAAA TGTTGTTTTA GGAAATAC ATGAAGGTCT CCGCAGCACT TCTGTGGCTG
CTGCTCATAG CAGCTGCCTT CAGCCCCCAG GGGCTCGCTG GCCAGCTTC TGTCCCAACC ACCTGCTGCT
TTAACCTGGC CAATAGGAAG ATACCCCTTC AGCGACTAGA GAGCTACAGG AGAATCACCA GTGGCAAATG
TCCCCAGAAA GCTGTGATCT TCAAGACCAA ACTGGCCAAG GATATCTGTG CCGACCCCAA GAAGAAGTGG
```

-continued

```
GTGCAGGATT CCATGAAGTA TCTGGACCAA AAATCTCCAA CTCCAAAGCC ATAA CCACATATTC CCCTCCTTTT
CCAAGGCAAG ATCCAGATGG ATTAAAAAAT GTACCAAGTC CCTCCTACTA GCTTGCCTCT CTTCTGTTCT
GCTTGACTTC CTAGGATCTG GAATCTGGTC AGCAATCAGG AATCCCTTCA TCGTGACCCC CGCATGGGCA
AAGGCTTCCC TGGAATCTCC CACACTGTCT GCTCCCTATA AAAGGCAGGC AGATGGGCCA GAGGAGCAGA
GAGGCTGAGA CCAACCCAGA AACCACCACC TCTCACGCCA AAGCTCACAC CTTCAGCCTC AACATGAAG
GTCTCCGCAG CACTTCTGTG GCTGCTGCTC ATAGCAGCTG CCTTCAGCCC CCAGGGGCTC GCTGGGCCAG
GTAAGCCCCC CAACTCCTTA CAGGAAAGGT AAGGTAACCA CCTCCAGGCT ACTAGGTCAG CAAGAATCTT
TACAGACTCA CTGCAAATTC TCCATTTGAA AAATAGGGAA ACAGGTTTTG TGGGTGGACA AGAAATGCCT
CAACCGTCAC ATCCAGTCAC TGGAAGAGCC AGAACTAGAA AGCTCCCGAG TCTTTTCCCC ACATTCAAGA
GGGCCGCTGG GTGCATCCTT ACCCAGCTAT CCTTACAGTG TTTGGGAATG GGGAATGGCT CTGTCTTACT
GTGGGCATGG TGGGCATTTT TGGCAGTGGG AGAGAAGGAA AATCTGTTGA TTAGAAGCTC AGTATGTTAA
TTCGACTCCA GGACAGCTTT CAGAGACAGT GGCTAAGAGA GAACGAGGT CCCAGGGGAT CTCTTGAGGT
GACTTATTTT GACACTCTTT GGGAAAGTTA TCTAGGAGAT TTGTTCCATA ACTCATTTTC CCATACTCTG
GTGACAAATT TACTGAGTGT ATCGGTCCCA CTGAGCCAGT GCATAGCATG GTAACAAACA GTTCTAAATT
ATCAATGACT TAACAGAATT AACTAAATTA ACAAAAGTTA CTTTCTCACT TGTACTAAAT ATCTATAATG
TATGGGCTCA GGCTTCTGCA TTTTATACTC AGGATTCTAG ACTGATGGAG AAGTTGCCAT GTGGGGGAAC
ATTGATGGAT ACTGTGATAA AGCAGAAGAA AGCTCTCAGG AGTCTTGCAT AGGCAATGCA CTGTGGCTCA
AAAATGACAC CCATCACTTT GTCTCCTTCT TTATTGATCA AAACTAATTA ATGCCTCAA CCAAACAAAA
GTGGCCAAGA AATGCAAGTC TACCTTGTGT CTCAAACAG AGGATGGAGA ATATTTGGTG AAAATTACCA
TGACCATCAC ATGGCCACGT AGGTCTTTAT AATGACAGAG CTAGCATTTG TCACATTGAC CAAGCTTTGT
CCATACACTC TACAGTAATG ATGAGTCCTC AGTGCACAGG GGAGGATGCT GAAGACACAG GACAGCATCC
TCCAGACACA TAAGACTTCA GAGCAGAGGG ATTCTCCCTC CACCTCTCGC AATTCCTTGC TTTCTCCTAA
CTTCCTTTAC AAAGTCATGC TTGGAAATGT CTATGTATCA TCATGTGGCT CATTTTTTTC TCTGTTCATT
TTTTTTCCCC AAAATTCAGC TTCTGTCCCA ACCACCTGCT GCTTTAACCT GGCCAATAGG AAGATACCCC
TTCAGCGACT AGAGAGCTAC AGGAGAATCA CCAGTGGCAA ATGTCCCCAG AAAGCTGTGA TGTAAGTAAA
TAAAGTTCAC CCTCCCCTAG ACAAAAAAT AATGTCTAGG GCACAGAGTC AAGAACTGTG GGAGTCATAG
ACTCTGATAG TTTGACCTCT ATGGTCCAAT TCATTAATTT TCACAAGTGA GTGTTCACTC CCAGCTCCCT
GCCTGGGAGA TTGCTGTAGT CATATCAATT TCTTCAAGTC AAGAGCAAAG ATGGTTTTAC TGGGCCTTTA
AGAGCAGCAA CTAACCCAAG AGTCTCATCC TTCCTCCTCT CCGTAGCAAC CCTTTGTCCA GGGGCAGATG
GTCCTTAAAT ATTTAGGGTC AAATGGGCAG AATTTTCAAA AACAATCCTT CCAATTGCAT CCTGATTCTC
CCCACAGCTT CAAGACCAAA CTGGCCAAGG ATATCTGTGC CGACCCCAAG AAGAAGTGGG TGCAGGATTC
CATGAAGTAT CTGGACCAAA AATCTCCAAC TCCAAAGCCA TAAATAATCA CCATTTTTGA AACCAAACCA
GAGCCTGAGT GTTGCCTAAT TTGTTTTCCC TTCTTACAAT GCATTCTGAG GTAACCTCAT TATCAGTCCA
AAGGGCATGG GTTTTATTAT ATATATATAT ATATATTTTT TTTTAAAAAA AAACGTATTG CATTTAATTT
ATTGAGGCTT TAAAACTTAT CCTCCATGAA TATCAGTTAT TTTTAAACTG TAAAGCTTTG TGCAGATTCT
TTACCCCCTG GGAGCCCCAA TTCGATCCCC TGTCACGTGT GGGCAATGTT CCCCCTCTCC TCTCTTCCTC
CCTGGAATCT TGTAAAGGTC CTGGCAAAGA TGATCAGTAT GAAAATGTCA TTGTTCTTGT GAACCCAAAG
TGTGACTCAT TAAATGGAAG TAATGTTGTT TTAGGAATAC ATAAAGTATG TGCATATTTT ATTATAGTCA
CTAGTTGTAA TTTTTTTGTG GGAAATCCAC ACTGAGCTGA GGGGG-3' (FRAG. NO_) (SEQ. ID
NO:2494)
```

```
5'-GCATTTTTTC AAGTTTTATG ATTTATTTAA CTTGTGGAAC AAAAATAAAC CAGAAACCAC CACCTCTCAC
GCCAAAGCTC ACACCTTCAG CCTCCAACAT GAAGGTCTCC GCAGCACTTC TGTGGCTGCT GCTCATAGCA
GCTGCCTTCA GCCCCCAGGG GCTCGCTGGG CCAGCTTCTG TCCCAACCAC CTGCTGCTTT AACCTGGCCA
ATAGGAAGAT ACCCCTTCAG CGACTAGAGA GCTACAGGAG AATCACCAGT GGCAAATGTC CCCAGAAAGC
TGTGATCTTC AAGACCAAAC TGGCCAAGGA TATCTGTGCC GACCCCAAGA AGAAGTGGGT GCAGGATTCC
ATGAAGTATC TGGACCAAAA ATCTCCAACT CCAAAGCCAT AAATAATCAC CATTTTTGAA ACCAAACCAG
AGCCTGAGTG TTGCCTAATT TGTTTTCCCT TCTTACAATG CATTCTGAGG TAACCTCATT ATCAGTCCAA
AGGGCATGGG TTTTATTATA TATATATATA TTTTTTTTTT AAAAAAAAAC GTATTGCATT TAATTTATTG
AGGCTTTAAA ACTTATCCTC CATGAATATC AGTTATTTTT AAACTGTAAA GCTTTGTGCA GATTCTTTAC
CCCCTGGGAG CCCCAATTCG ATCCCCTGTC ACGTGTGGGC AATGTTCCCC CTCTCCTCTC TTCCTCCCTG
GAATCTTGTA AAGGTCCTGG CAAAGATGAT CAGTATGAAA ATGTCATTGT TCTTGTGAAC CCAAAGTGTG
ACTCATTAAA TGGAAGTAAA TGTTGTTTTA GGAATAC-3' (FRAG.NO:_) (SEQ. ID NO:2491)
5'-ATGAAGGTCT CCGCAGCACT TCTGTGGCTG CTGCTCATAG CAGCTGCCTT CAGCCCCCAG GGGCTCGCTG
GGCCAGCTTC TGTCCCAACC ACCTGCTGCT TTAACCTGGC AATAGGAAG ATACCCCTTC AGCGACTAGA
GAGCTACAGG AGAATCACCA GTGGCAAATG TCCCCAGAAA GCTGTGATCT TCAAGACCAA CTGGCCAAG
GATATCTGTG CCGACCCCAA GAAGAAGTGG GTGCAGGATT CCATGAAGTA TCTGGACCAA AAATCTCCAA
CTCCAAAGCC ATAA-3' (FRAG. NO:_) (SEQ. ID NO:2492)
5'-CCACATATTC CCCTCCTTT CCAAGGCAAG ATCCAGATGG ATTAAAAAAT GTACCAAGTC CCTCCTACTA
GCTTGCCTCT CTTCTGTTCT GCTTGACTTC CTAGGATCTG GAATCTGGTC AGCAATCAGG AATCCCTTCA
TCGTGACCCC CGCATGGGCA AAGGCTTCCC TGGAATCTCC CACACTGTCT GCTCCCTATA AAAGGCAGGC
AGATGGGCCA GAGGAGCAGA GAGGCTGAGA CCAACCCAGA AACCACCACC TCTCACGCCA AAGCTCACAC
CTTCAGCCTC CAACATGAAG GTCTCCGCAG CACTTCTGTG GCTGCTGCTC ATAGCAGCTG CCTTCAGCCC
CCAGGGGCTC GCTGGGCCAG GTAAGCCCCC CAACTCCTTA CAGGAAAGGT AAGGTAACCA CCTCCAGGCT
ACTAGGTCAG CAAGAATCTT TACAGACTCA CTGCAAATTC TCCATTTGAA AAATAGGGAA ACAGGTTTTG
TGGGTGGACA AGAAATGCCT CAACCGTCAC ATCCAGTCAC TGGAAGAGCC AGAACTAGAA AGCTCCCGAG
TCTTTTCCCC ACATTCAAGA GGGCCGCTGG GTGCATCCTT ACCCAGCTAT CCTTACAGTG TTTGGGAATG
GGGAATGGCT CTGTCTTACT GTGGGCATGG TGGGCATTTT TGGCAGTGGG AGAGAAGGAA AATCTGTTGA
TTAGAAGCTC AGTATGTTAA TTCGACTCCA GGACAGCTTT CAGAGACAGT GGCTAAGAGA GAACGAGGT
CCCAGGGGAT CTCTTGAGGT GACTTATTTT GACACTCTTT GGGAAAGTTA TCTAGGAGAT TTGTTCCATA
ACTCATTTTC CCATACTCTG GTGACAAATT TACTGAGTGT ATCGGTCCCA CTGAGCCAGT GCATAGCATG
GTAACAAACA GTTCTAAATT ATCAATGACT TAACAGAATT AACTAAATTA ACAAAAGTTA CTTTCTCACT
TGTACTAAAT ATCTATAATG TATGGGCTCA GGCTTCTGCA TTTTATACTC AGGATTCTAG ACTGATGGAG
AAGTTGCCAT GTGGGGAAC ATTGATGGAT ACTGTGATAA AGCAGAAGAA AGCTCTCAGG AGTCTTGCAT
AGGCAATGCA CTGTGGCTCA AAAATGACAC CCATCACTTT GTCTCCTTCT TTATTGATCA AAACTAATTA
ATGCCTCCAA CCAAACAAAA GTGGCCAAGA ATGCAAGTC TACCTTGTGT CTCAAAACAG AGGATGGAGA
ATATTTGGTG AAAATTACCA TGACCATCAC ATGGCCACGT AGGTCTTTAT AATGACAGAG CTAGCATTTG
TCACATTGAC CAAGCTTTGT CCATACACTC TACAGTAATG ATGAGTCCTC AGTGCACAGG GGAGGATGCT
GAAGACACAG GACAGCATCC TCCAGACACA TAAGACTTCA GAGCAGAGGG ATTCTCCCTC CACCTCTCGC
AATTCCTTGC TTTCTCCTAA CTTCCTTTAC AAAGTCATGC TTGGAAATGT CTATGTATCA TCATGTGGCT
```

-continued

```
CATTTTTTTC TCTGTTCATT TTTTTTCCCC AAAATTCAGC TTCTGTCCCA ACCACCTGCT GCTTTAACCT

GGCCAATAGG AAGATACCCC TTCAGCGACT AGAGAGCTAC AGGAGAATCA CCAGTGGCAA ATGTCCCCAG

AAAGCTGTGA TGTAAGTAAA TAAAGTTCAC CCTCCCCTAG ACAAAAAAAT AATGTCTAGG GCACAGAGTC

AAGAACTGTG GGAGTCATAG ACTCTGATAG TTTGACCTCT ATGGTCCAAT TCATTAATTT TCACAAGTGA

GTGTTCACTC CCAGCTCCCT GCCTGGGAGA TTGCTGTAGT CATATCAATT TCTTCAAGTC AAGAGCAAAG

ATGGTTTTAC TGGGCCTTTA AGAGCAGCAA CTAACCCAAG AGTCTCATCC TTCCTCCTCT CCGTAGCAAC

CCTTTGTCCA GGGGCAGATG GTCCTTAAAT ATTTAGGGTC AAATGGGCAG AATTTTCAAA AACAATCCTT

CCAATTGCAT CCTGATTCTC CCCACAGCTT CAAGACCAAA CTGGCCAAGG ATATCTGTGC CGACCCCAAG

AAGAAGTGGG TGCAGGATTC CATGAAGTAT CTGGACCAAA AATCTCCAAC TCCAAAGCCA TAAATAATCA

CCATTTTTGA AACCAAACCA GAGCCTGAGT GTTGCCTAAT TTGTTTTCCC TTCTTACAAT GCATTCTGAG

GTAACCTCAT TATCAGTCCA AAGGGCATGG GTTTTATTAT ATATATATAT ATATATTTTT TTTTAAAAAA

AAACGTATTG CATTTAATTT ATTGAGGCTT TAAAACTTAT CCTCCATGAA TATCAGTTAT TTTTAAACTG

TAAAGCTTTG TGCAGATTCT TTACCCCCTG GGAGCCCCAA TTCGATCCCC TGTCACGTGT GGGCAATGTT

CCCCCTCTCC TCTCTTCCTC CCTGGAATCT TGTAAAGGTC CTGGCAAAGA TGATCAGTAT GAAAATGTCA

TTGTTCTTGT GAACCCAAAG TGTGACTCAT TAAATGGAAG TAATGTTGTT TTAGGAATAC ATAAAGTATG

TGCATATTTT ATTATAGTCA CTAGTTGTAA TTTTTTTGTG GGAAATCCAC ACTGAGCTGA GGGGG-3' (FRAG.NO:_)
```

(SEQ. ID NO:2493)

FK-506 Binding Protein Nucleic Acids and
Oligonucleotide Fragments

```
5'-GCCAGGTCGC TGTTGGTCCA CGCCGCCCGT CGCGCCGCCC GCCCGCTCAG CGTCCGCCGC CGCCATGGGA

GGCCGGAGCC GAGCCGGGGT CGGGCAGCAG CAGGGACCCC CCAGAGGCGG GGCCTGTGGG ACCGCTATGG

GCGTGGAGAT CGAGACCATC TCCCCCGGAG ACGGAAGGAC ATTCCCCAAG AAGGGCCAAA CGTGTGTGGT

GCACTACACA GGAATGCTCC AAAATGGGAA GAAGTTTGAT TCATCCAGAG ACAGAAACAA ACCTTTCAAG

TTCAGAATTG GCAAACAGGA AGTCATCAAA GGTTTTGAAG AGGGTGCAGC CCAGATGAGC TTGGGGCAGA

GGGCGAAGCT GACCTGCACC CCTGATGTGG CATATGGAGC CACGGGCCAC CCCGGTGTCA TCCCTCCCAA

TGCCACCCTC ATCTTTGACG TGGAGCTGCT CAACTTAGAG TGAAGGCAGG AAGGAACTCA AGGTGGCTGG

AGATGGCTGC TGCTCACCCT CCTAGCCTGC TCTGCCACTG GGACGGCTCC TGCTTTTGGG GCTCTTGATC

AGTGTGCTAA CCTCACTGCC TCATGGCATC ATCCATTCTC TCTGCCCAAG TTGCTCTGTA TGTGTTCGTC

AGTGTTCATG CGAATTCTTG CTTGAGGAAA CTTCGGTTGC AGATTGAAGC ATTTCAGGTT GTGCATTTTG

TGTGATGCAT GTAGTAGCCT TTCCTGATGA CAGAACACAG ATCTCTTGTT CGCACAATCT ACACTGCCTT

ACCTTCACTT AAACCACACA CACAAGGTGC TCAGACATGA AATGTACATG GCGTACCGTA CACAGAGGGA

CTTGAGCCAG TTACCTTTGC TGTCACTTTC TCTCTTATAA ATTCTGTTAG CTGCTCACTT AAACAATGTC

CTCTTTGAGA AAATGTAAAA TAAAGGCTCT GTGCTTGACA GAATTCGGGC CGCCGCCAGG TCGCTGTTGG

TCCACGCCGC CCGTCGCGCC GCCCGCCCGC TCAGCGTCCG CCGCCGCCAT GGGAGTGCAG GTGGAAACCA

TCTCCCCAGG AGACGGGCGC ACCTTCCCCA AGCGCGGCCA GACCTGCGTG GTGCACTACA CCGGGATGCT

TGAAGATGGA AAGAAATTTG ATTCCTCCCG GGACAGAAAC AAGCCCTTTA AGTTTATGCT AGGCAAGCAG

GAGGTGATCC GAGGCTGGGA AGAAGGGGTT GCCCAGATGA GTGTGGGTCA GAGAGCCAAA CTGACTATAT

CTCCAGATTA TGCCTATGGT GCCACTGGGC ACCCAGGCAT CATCCCACCA ATGCCACTC TCGTCTTCGA

TGTGGAGCTT CTAAAACTGG AATGACAGGA ATGGCCTCCT CCCTTAGCTC CCTGTTCTTG GATCTGCCAT

GGAGGGATCT GGTGCCTCCA GACATGTGCA CATGAGTCCA TATGGAGCTT TTCCTGATGT TCCACTCCAC
```

-continued

TTTGTATAGA CATCTGCCCT GACTGAATGT GTTCTGTCAC TCAGCTTTGC TTCCGACACC TCTGTTTCCT
CTTCCCCTTT CTCCTCGTAT GTGTGTTTAC CTAAACTATA TGCCATAAAC CTCAAGTTAT TCATTTTATT
TTGTTTTCAT TTTGGGGTGA AGATTCAGTT TCAGTCTTTT GGATATAGGT TTCCAATTAA GTACATGGTC
AAGTATTAAC AGCACAAGTG GTAGGTTAAC ATTAGAATAG GAATTGGTGT TGGGGGGGGG GTTTGCAAGA
ATATTTATT TTAATTTTTT GGATGAAATT TTTATCTATT ATATATTAAA CATTCTTGCT GCTGCGCTGC
AAAGCCATAG CAGATTTGAG GCGCTGTTGA GGACTGAATT ACTCTCCAAG TTGAGAGATG TCTTTGGGTT
AAATTAAAAG CCCTACCTAA AACTGAGGTG GGGATGGGGA GAGCCTTTGC CTCCACCATT CCCACCCACC
CTCCCCTTAA ACCCTCTGCC TTTGAAAGTA GATCATGTTC ACTGCAATGC TGGACACTAC AGGTATCTGT
CCCTGGGCCA GCAGGGACCT CTGAAGCCTT CTTTGTGGCC TTTTTTTTTT TTCATCCTGT GGTTTTTCTA
ATGGACTTTC AGGAATTTTG TAATCTCATA ACTTTCCAAG CTCCACCACT TCCTAAATCT TAAGAACTTT
AATTGACAGT TTCAATTGAA GGTGCTGTTT GTAGACTTAA CACCCAGTGA AGCCCAGCC ATCATGACAA
ATCCTTGAAT GTTCTCTTAA GAAAATGATG CTGGTCATCG CAGCTTCAGC ATCTCCTGTT TTTTGATGCT
TGGCTCCCTC TGCTGATCTC AGTTTCCTGG CTTTTCCTCC CTCAGCCCCT TCTCACCCCT TTGCTGTCCT
GTGTAGTGAT TTGGTGAGAA ATCGTTGCTG CACCCTTCCC CCAGCACCAT TTATGAGTCT CAAGTTTTAT
TATTGCAATA AAAGTGCTTT ATGCCCGAAT TC GCCGCCGCCA TGGGAGTGCA GGTGGAAACC ATCTCCCCAG
GAGACGGGCG CACCTTCCCC AAGCGCGGCC AGACCTGCGT GGTGCACTAC ACCGGGATGC TTGAAGATGG
AAAGAAATTT GATTCCTCCC GGGACAGAAA CAAGCCCTTT AAGTTTATGC TAGGCAAGCA GGAGGTGATC
CGAGGCTGGG AACAAGGGGT TGCCCAGATG AGTGTGGGTC AGAGAGCCAA ACTGACTATA TCTCCAGATT
ATGCCTATGG TGCCACTGGG CACCCAGGCA TCATCCCACC ACATGCCACT CTCGTCTTCG ATGTGGAGCT
TCTAAAACTG GAATGACAGG AATGGCCTCC TCCCTTAGCT CCCTGTTCTT GGATCTGCCR TGGAGGGATC
TGGTGCCTCC AGACATGTGC ACATGARTCC ATATGGAGCT TTTCCTGATG TTCCACTCCA CTTTGTATAG
ACATCTGCCC TGACTGAATG TGTTCTGTCA CTCAGCTTTG CTTCCGACAC CTCTGTTTCC TCTTCCCCTT
TCTCCTCGTA TGTGTGTTTA CCTAAACTAT ATGCCATAAA CCTCAAGTTA TTCA-3' (FRAG.NO:_) (SEQ. ID
NO:2499)
5'-GCCAGGTCGC TGTTGGTCCA CGCCGCCCGT CGCGCCGCCC GCCCGCTCAG CGTCCGCCGC CGCCATGGGA-3'
(FRAG. No:_)(SEQ. ID NO: 2495)
5'-GGCCGGAGCC GAGCCGGGGT CGGGCAGCAG CAGGGACCCC CCAGAGGCGG GGCCTGTGGG CCGCTATGG
GCGTGGAGAT CGAGACCATC TCCCCCGGAG ACGGAAGGAC ATTCCCCAAG AAGGGCCAAA CGTGTGTGGT
GCACTACACA GGAATGCTCC AAAATGGGAA GAAGTTTGAT TCATCCAGAG ACAGAAACAA ACCTTTCAAG
TTCAGAATTG GCAAACAGGA AGTCATCAAA GGTTTTGAAG AGGGTGCAGC CCAGATGAGC TTGGGGCAGA
GGGCGAAGCT GACCTGCACC CCTGATGTGG CATATGGAGC CACGGGCCAC CCCGGTGTCA TCCCTCCCAA
TGCCACCCTC ATCTTTGACG TGGAGCTGCT CAACTTAGAG TGAAGGCAGG AAGGAACTCA AGGTGGCTGG
AGATGGCTGC TGCTCACCCT CCTAGCCTGC TCTGCCACTG GGACGGCTCC TGCTTTTGGG GCTCTTGATC
AGTGTGCTAA CCTCACTGCC TCATGGCATC ATCCATTCTC TCTGCCCAAG TTGCTCTGTA TGTGTTCGTC
AGTGTTCATG CGAATTCTTG CTTGAGGAAA CTTCGGTTGC AGATTGAAGC ATTTCAGGTT GTGCATTTTG
TGTGATGCAT GTAGTAGCCT TTCCTGATGA CAGAACACAG ATCTCTTGTT CGCACAATCT ACACTGCCTT
ACCTTCACTT AAACCACACA CACAAGGTGC TCAGACATGA AATGTACATG GCGTACCGTA CACAGAGGGA
CTTGAGCCAG TTACCTTTGC TGTCACTTTC TCTCTTATAA ATTCTGTTAG CTGCTCACTT AAACAATGTC
CTCTTTGAGA AAATGTAAAA TAAAGGCTCT GTGCTTGACA-3' (FRAG. NO:_) (SEQ ID NO:2496)

-continued

```
5'-GAATTCGGGC CGCCGCCAGG TCGCTGTTGG TCCACGCCGC CGTCGCGCC GCCCGCCCGC TCAGCGTCCG

CCGCCGCCAT GGGAGTGCAG GTGGAAACCA TCTCCCCAGG AGACGGGCGC ACCTTCCCCA AGCGCGGCCA

GACCTGCGTG GTGCACTACA CCGGGATGCT TGAAGATGGA AAGAAATTTG ATTCCTCCCG GGACAGAAAC

AAGCCCTTTA AGTTTATGCT AGGCAAGCAG GAGGTGATCC GAGGCTGGGA AGAAGGGGTT GCCCAGATGA

GTGTGGGTCA GAGAGCCAAA CTGACTATAT CTCCAGATTA TGCCTATGGT GCCACTGGGC ACCCAGGCAT

CATCCCACCA CATGCCACTC TCGTCTTCGA TGTGGAGCTT CTAAAACTGG AATGACAGGA ATGGCCTCCT

CCCTTAGCTC CCTGTTCTTG GATCTGCCAT GGAGGGATCT GGTGCCTCCA GACATGTGCA CATGAGTCCA

TATGGAGCTT TTCCTGATGT TCCACTCCAC TTTGTATAGA CATCTGCCCT GACTGAATGT GTTCTGTCAC

TCAGCTTTGC TTCCGACACC TCTGTTTCCT CTTCCCCTTT CTCCTCGTAT GTGTGTTTAC CTAAACTATA

TGCCATAAAC CTCAAGTTAT TCATTTTATT TTGTTTTCAT TTTGGGGTGA AGATTCAGTT TCAGTCTTTT

GGATATAGGT TTCCAATTAA GTACATGGTC AAGTATTAAC AGCACAAGTG GTAGGTTAAC ATTAGAATAG

GAATTGGTGT TGGGGGGGGG GTTTGCAAGA ATATTTTATT TTAATTTTTT GGATGAAATT TTTATCTATT

ATATATTAAA CATTCTTGCT GCTGCGCTGC AAAGCCATAG CAGATTTGAG GCGCTGTTGA GGACTGAATT

ACTCTCCAAG TTGAGAGATG TCTTTGGGTT AAATTAAAAG CCCTACCTAA AACTGAGGTG GGGATGGGGA

GAGCCTTTGC CTCCACCATT CCCACCCACC CTCCCCTTAA ACCCTCTGCC TTTGAAAGTA GATCATGTTC

ACTGCAATGC TGGACACTAC AGGTATCTGT CCCTGGGCCA GCAGGGACCT CTGAAGCCTT CTTTGTGGCC

TTTTTTTTTT TTCATCCTGT GGTTTTTCTA ATGGACTTTC AGGAATTTTG TAATCTCATA ACTTTCCAAG

CTCCACCACT TCCTAAATCT TAAGAACTTT AATTGACAGT TTCAATTGAA GGTGCTGTTT GTAGACTTAA

CACCCAGTGA AAGCCCAGCC ATCATGACAA ATCCTTGAAT GTTCTCTTAA GAAAATGATG CTGGTCATCG

CAGCTTCAGC ATCTCCTGTT TTTTGATGCT TGGCTCCCTC TGCTGATCTC AGTTTCCTGG CTTTTCCTCC

CTCAGCCCCT TCTCACCCCT TTGCTGTCCT GTGTAGTGAT TTGGTGAGAA ATCGTTGCTG CACCCTTCCC

CCAGCACCAT TTATGAGTCT CAAGTTTTAT TATTGCAATA AAAGTGCTTT ATGCCCGAAT TC-3' (FRAG.NO:_)

(SEQ. ID NO:2497)

5' GCCGCCGCCA TGGGAGTGCA GGTGGAAACC ATCTCCCCAG GAGACGGGCG CACCTTCCCC AAGCGCGGCC

AGACCTGCGT GGTGCACTAC ACCGGGATGC TTGAAGATGG AAAGAAATTT GATTCCTCCC GGGACAGAAA

CAAGCCCTTT AAGTTTATGC TAGGCAAGCA GGAGGTGATC CGAGGCTGGG AAGAAGGGGT TGCCCAGATG

AGTGTGGGTC AGAGAGCCAA ACTGACTATA TCTCCAGATT ATGCCTATGG TGCCACTGGG CACCCAGGCA

TCATCCCACC ACATGCCACT CTCGTCTTCG ATGTGGAGCT TCTAAAACTG GAATGACAGG AATGGCCTCC

TCCCTTAGCT CCCTGTTCTT GGATCTGCCR TGGAGGGATC TGGTGCCTCC AGACATGTGC ACATGARTCC

ATATGGAGCT TTTCCTGATG TTCCACTCCA CTTTGTATAG ACATCTGCCC TGACTGAATG TGTTCTGTCA

CTCAGCTTTG CTTCCGACAC CTCTGTTTCC TCTTCCCCTT TCTCCTCGTA TGTGTGTTTA CCTAAACTAT

ATGCCATAAA CCTCAAGTTA TTCA-3' (FRAG. NO:_) (SEQ. ID NO:2498)
``` wherein B is adenosine, or, more preferably, replaces adenosine and is an "equivame\\lent" or a "universal" base, and adenosine $A_{2a}$ receptor agonist or only minimally antagonist, an adenosine $A_{2b}$ receptor antagonist, an adenosine $A_3$ receptor antagonist, or an adenosine $A_1$ receptor antagonist. Similarly, adenosine (A) may always be replaced by an "alternative", "equivalent" and/or "universal" base having a small fraction, preferably less than 0.3 of the activity of adenosine at the adenosine receptor(s), as described above.

In one preferred embodiment, the links between neighboring mononucleotides are phosphodiester links. In another preferred, at least one mononucleotide phosphodiester residue of the anti-sense oligonucleotide(s) is substituted by a methylphosphonate, phosphotriester, phosphorothioate, phosphorodithioate, boranophosphate, formacetal, thioformacetal, thioether, carbonate, carbamate, sulfate, sulfonate, sulfamate, sulfonamide, sulfone, sulfite, sulfoxide, sulfide, hydroxylamine, 2'-O-methyl, methylene (methyimino), methyleneoxy (methylimino), phosphoramidate residues, and combinations thereof. The oligos having one or more phosphodiester residues substituted by one or more of the other residues are generally longer lasting, given that these residues are more resistant to hydrolysis than the phosphodiester residue. In some cases up to about 10%, about 30%, about 50%, about 75%, and even all phosphodiester residues may be substituted (100%). Typically, the multiple target anti-sense oligonucleotide (oligo) of the invention comprises at least about 7 mononucleotides, in some instances up to 60 and more mononucleotides, preferably about 10 to about 36, and more preferably about 12 to about 21 mononucleotides. However, other lengths are also suitable depending on the length of the target macromolecule. Examples of the MTA oligos of the invention are provided in Table 3 below, which includes ninety-four sequences (SEQ ID NOS.: 2316 through 2410).

TABLE 3

MTA Oligos, Location Targeted & Target

| MTA Oligo | SEQ. ID No. | Location | Compound Targeted | Target |
|---|---|---|---|---|
| HUMNFKBH65A AS | | | | |
| CCC GGC CCC GCC TCG TGC C | 3019 | 5' = 1 | EPI 2192 | |
| CGT CCB TCC CGC CGG CCC | 3020 | 5' = 28(AUG) | EPI 2193 | |
| GCC CCG CTG CTT GGG CTG CTC TGC CGG G | 3021 | 5' = 65 | EPI 2194 | |
| TCT GTG CTC CTC TCG CCT GCC | 3022 | 5' = 137 | EPI 2195 | |
| TGG TGC GGT CGG TCT TGG TGG | 3023 | 5' = 159 | EPI 2196 | |
| CTG TCC CTG GTC CTG TG | 3024 | 5' = 196 | EPI 2197 | |
| GGT CCC GCT TCT TC | 3025 | 5' = 362 | EPI 2198 | |
| CCC GTT GTT GTT GGT CTG G | 3026 | 5' = 401 | EPI 2199 | |
| TGT CCT CTT TCT CC | 3027 | 5' = 656 | EPI 2200 | |
| GCC TCG GGC CTC CC | 3028 | 5' = 697 | EPI 2201 | |
| GGC TGG GGT CTG CGT | 3029 | 5' = 769 | EPI 2202 | |
| GGC CGG GGG TCG GTG GGT CCG CTG | 3030 | 5' = 953 | EPl 2203 | |
| GGG CTG GGG TGC TGG CTT GGG G | 3031 | 5' = 1022 | EPI 2204 | |
| GGG GCT GGG GCC TGC GCC | 3032 | 5' = 1208 | EPI 2205 | |
| GCC TGG GTG GGC TTG GGG GC | 3033 | 5' = 1272 | EPI 2206 | |
| GCT GGG TCT GTC CTG TTG CC | 3034 | 5' = 1362 | EPI 2207 | |
| CTT GTG TCG GGG GCC | 3035 | 5' = 1451 | EPI 2208 | |
| GCT GGG TCG GGG GGC CTC TGC CCT GTC | 3036 | 5' = 1511 | EPI 2209 | |
| GCC CCG GGG CCC CC | 3037 | 5' = 1550 | EPI 2210 | |
| TGG CTC CCC CCT CC | 3038 | 5' = 1772 | EPI 2211 | |
| GCT CCC CCC TTT CC | 3039 | 5' = 1863 | EPI 2212 | |
| CGG ACG AAG ACA GAG A | 3040 | 5' = 1979 | EPI 2213 | |
| GGC TTT GTC GGC TC | 3041 | 5' = 2011 | EPI 2214 | |
| GCC TGC TCT CCC CC | 3042 | 5' = 2312 | EPI 2215 | |
| CCC GGC CCC GCC BCG BBC C | 3043 | intron | EPI 2192-01A | HSU50136C4Synth |
| CCC GGC CCC GCC BCG | 3044 | intron | EPI 2192-01B | |
| CCC GGC CCC GCC BCG BBC C | 3045 | 5'untr | EPI 2192-02A | HUMLIPOX5LO |
| CCC GGC CCC GCC BCG | 3046 | 5'untr | EPI 2192-02B | |
| CCC GBC CCC GCC TCB BG | 3047 | trans | EPI 2192-03A | HSNFKBS Subunit |
| CCC GBC CCC GCC TC | 3048 | trans | EPI 2192-03B | |
| CCG GCC CCC CCT C | 3049 | 5'untr | EPI 2192-04 | TGFβR1 |
| CCC GBB CCC GCB TBG TGC C | 3050 | 5'trans | EPI 2192-05A | HSU58198I1 enhan |
| CCC CCB TBG TGC C | 3051 | 5'untr | EPI 2192-05B | |
| CCC GGB CCC BCC BBG TGC C | 3052 | 3'trans | EPI 2192-06 | HSVECAD |
| CBG BBC CCG CCT CCT GCC | 3053 | intron | EPI 2192-07A | NFKB2 |
| C CCC CCT CCT CCC | 3054 | intron | EPI 2192-07B | NFKD2 |
| CCG GCB CCG CCT CBT GCC | 3055 | 5'trans | EPI 2192-08 | Carboxypep |
| CCG GCC CCG CCB CBT GCC | 3056 | 3'trans | EPI 2192-09 | HumADRA2Co2AdrKid |
| CCC GBC CCC GBC TCG | 3057 | 5'untrs | EPI 2192-10 | HUMFK506B |
| CCC GGC CBC GBC TCG | 3058 | 5'untrs | EPI 2192-11 | HSNBARKS1βAdrKin |
| CCC GGC CCB GCC TBG | 3059 | 5'UTR | EPI 2192-12 | HSNFXN1 (NFKB1) |
| CCC GGC BCB GBC TCC TBC C | 3060 | 3'UTR | EPI 2192-13 | HSILF (transcrp. Factor ILF) |
| CCC GGC CCC GCC BCG | 3061 | | EPI-2192-14 | NFKB/C4Syn/5-LO/TGFBrcc1 MTA |
| CCC GGC CCC GCC BCG | 3062 | | EPI-2192-15 | NFKB/C4Syn/5-LOMTA |
| TCC BTG CCG CGG GC | 3063 | 3' trans | EPI-2193-01 | METOncogene |
| TCC BTG CCB CGG GCC | 3064 | 3' trans | EPI-2193-02 | HSFGR2 (IG) |
| TCC BTG CCB CGG GCC | 3065 | mid cod | EPI-2193-03 | 5-LO |
| TCC BTG CCB CBG GCC | 3066 | mid cod | EPI-2193-04 | HUMTK14 |
| GTC CBT GBC CCG G | 3067 | 3'trans | EPI-2193-05 | HUMTNFR |
| TC CBT GBD GCG GG | 3068 | AUG | | Probl.HUMPTCH cardiacK + channel |
| TCT GBG CTC CTC TBB CCT GGG | 3069 | intr | EPI-2195-01 | humC5PAcytotox. Ser. Protease |
| CTG TGC BCC TBB CBC CTG GG | 3070 | intr | EPI-2195-02 | HSINOSXO8induc.NO5 |
| TGT GBT CCB CTB GBC TGC G | 3071 | | EPI-2195-03 | HUMACHRM2musc.m2 acetylch.rec. |

TABLE 3-continued

MTA Oligos, Location Targeted & Target

| MTA Oligo | SEQ. ID No. | Location | Compound Targeted | Target |
|---|---|---|---|---|
| TCT GTB CTC BBC TCB CCT G | 3072 | | EPI-2195-04 | e86371s1 Neurokinin3Recept |
| TGC TCC TCB CBB CTG GG | 3073 | | EPI-2195-05 | HUMMIP1 Amacro inflam.factor |
| CTC CTC TBG CCT GG | 3074 | | EPI-2195-06 | HSNBARKS4 β-Adr Rec Kinase |
| GTG CTC BB TCB BCT GGG | 3075 | | EPI-2195-07 | HSTNFR2506TNF R2 |
| CTG CBC CBB TCB CCT GGG | 3076 | | EPI-2195-08 | humfkbp fk506 binding proc. |
| TCT GTG CBC CTC TBG BCT | 3077 | exon | EPI-2195-09 | HSNBARKS1β-Adr. Recept. Kinase |
| CTC TBB TCC TBB CBC CTC G | 3078 | intron | EPI-2195-10 | HUMIL8 |
| TCT GCT BBT CBC BCB TCG G | 3079 | | EPI-2195-11 | HSU50157 PDE4 |
| GTG CBC CBC TCB CCT G | 3080 | intron/exon | EPI-2195-12 | IL-2 R |
| CTG TGC BCC TCT C | 3081 | 3'UTR | EPI-2203-05 | IL-6 R HSIL6R |
| CBG TGC BCC BCT CBC CTG | 3082 | intr/ex | EPI-2203-06A | HSIL2rG6 |
| G TGC BCC BCT CBC CTG | 3083 | inter/ex | EPI-2203-06B | HSIL2rG6 |
| CBC CTC TCB CCT GGG | 3084 | coding | EPI-2203-07A | HUMIL71 |
| C CTC TCB CCT GCC | 3085 | coding | EPI-2203-07B | IL-7 HUMIL71 |
| GCT CCB CTC GCC T | 3086 | coding | EPI-2203-08 | IL-6 R HSI6REC |
| TGC TCC TCB CGC C | 3087 | intron PDGF A | EPI-2303-09 | Chain HUMPDGFAB |
| GTT GTT GBT CTG G | 3088 | 3'utr | EPI-2199-01 | GATA-4Transcrip Factor for IL-5 |
| CGT TGB BBT TGG TCT TGC | 3089 | Coding | EPI-2199-02 | TNFα HUMTNFA |
| GGT TGT TGB TGB TCT G | 3090 | Par 5'UTR | EPI-2199-03 | HSSUBP1G (Sub Pr) |
| GGG TTB BBG TTG BTC TGG | 3091 | Coding | EPI-2199-04 | NeutrophilAdh. R HUMNARIA |
| GGG TTB BBG TTG BTC TGG | 3092 | HSHM2 | EPI-2199-05 | m2 Muscarinic R |
| TTG TTG TBG BTC TGG | 3093 | HUML1CAM | EPI-2199-06 | L1 LeukAadhProt |
| GGG TBG BBG BGT CCG CTG | 3094 | coding | EPI-2203-01 | HUMGATA2A |
| GGG TCB GBG GBT CBG CTC | 3095 | 571424S2 | EPI-2303-02 | IGE cps |
| GGG TBG GTG GGT C | 3096 | coding | EPI-2203-03 | HSGCSFR2 |
| GGG TCG GBG GGT CBG C | 3097 | HUMITGF | EPI-2203-04 | TGPβ3 |
| GGG TGG GCT T | 3098 | HUMNK65PRO | EPI-2206-01 | NPKB/NK & TCell Activating Prot |
| GGG TGG GCT TGG G | 3099 | HUMPERFEB | EPI 2206-02 | NFKB/Prostagl EP3 Rec |
| CCTGGGTGGGBBTGGC | 3100 | | EPI 2206-03 | HSNP2B/GCSF NFKB/GranuLocCSF/ Transcr. FactorNP2B |
| CCTCGBTCGGCBTGGC | 3101 | | EPI-2206-04 | HUMLAP/NFKB Leuk.Adhes.Prot |
| GCCTGBGTGBBCTTGCC | 3102 | | EPI2206-05 | NFKB/Endothel N2 S63833 |
| CCCAVGVCCVCCCAGGC | 3103 | | EPI 2206-06 | NFKBAS13/B Lymph SerThrProt.Kinase |
| AGCCCACCCAGGC | 3104 | | EPI2206-07 | NFKBAS13/GCSF1 HSGCSFR1Rec |
| BCCTGGGTGGGCTB | 3105 | | EPI-2206-08 | NFKBAS13/GCSF1/ NK7TCBLLACT.Prot |
| GGTGGGCTTGGG | 3106 | | EPI 2206-09 | NFKBAS13/ HSTGFB1 TGFB |
| CCBBGGTCGGCTTGGG | 3107 | | EPI 2206-10 | NFKBAS13/ HSTGPB1 TGPB1 |
| CTGGGTGGGBBTGGG | 3108 | | EPI 2206-11 | NFKBAS13/ HSGCSFR1 GCSFR1 |
| CCBGGGTGGGCTTGG | 3109 | | EPI 2206-12 | NFKBAS13/HUMCD30A LymphActAntigCoding |
| GGGTGGGCTTGG | 3110 | | EPI-2206-12B | NFKBAS13/HUMCD30A |
| CCTGBGTGBGCBTGGG | 3111 | | EPI 2206-13 | NFKBAS13/HUMCAM1V VascEndoth.Cell Adh.Molec |

B: Universal Base

The MTA oligos of Table 3 are suitable for use with two or more of the targets listed in Table 4 below.

TABLE 4

Targets for the MTA Oligos of Table 3

| Compound | Target |
| --- | --- |
| EPI 2010 | Adenosine A1 receptor |
| EPI 2045 | Adenosine A3 receptor |
| EPI 2873, EPI 2193 | NFκB |
| EPI 1873 | Interleukin-1 |
| EPI 1857 | Interleukin-5 |
| EPI 2945 | Interleukin-4 |
| EPI 2977 | Interleukin-8 |
| EPI 2031 | 5-Lipoxygenase |
| EPI 1898 | Leukotriene C-4 Synthase |
| EPI 1856 | Eotaxin |
| EPI 1131 | ICAM |
| EPI 1085 | VCAM |
| EPI 2085 | TNFα |
| EPI 1908 | PAF |
| EPI 1925 | IL-4 receptor |
| EPI 2643 | β2 aderenergic receptor kinase |
| EPI 2934 | Tryptase |
| EPI 2033 | Major Basic Protein |
| EPI 2795 | Eosinophil Peroxidase |

NfκB: nuclear factor κB
ICAM: intracellular adhesion molecule
VCAM: vascular cell adhesion molecule
TNF: tumor necrosis factor
PAF: platelet activating factor The mRNA sequence of the targeted protein may be derived from the nucleotide sequence of the gene expressing the protein, whether for existing targets or those to be found in the future. Sequences for many target genes of different systems are presently known. See, GenBank data base, NIH, the entire sequences of which are incorporated here by reference. The sequences of those genes, whose sequences are not yet available, may be obtained by isolating the target segments applying technology known in the art. Once the sequence of the gene, its RNA and/or the protein are known, anti-sense oligonucleotides are produced as described above and utilized to validate the target by in vivo administration and testing for a reduction of the production of the targeted protein in accordance with standard techniques, and of specific functions. As already described above, the anti-sense oligonucleotides may be of any suitable length, e.g., from about 7 to about 60 nucleotides in length, depending on the particular target being bound and the mode of delivery thereof. The anti-sense oligonucleotide preferably is directed to an mRNA region containing a junction between intron and exon or to regions vicinal to the junction. Where the anti-sense oligonucleotide is directed to an intron/exon junction, it may either entirely overlie the junction or may be sufficiently close to the junction to inhibit splicing out of the intervening exon during processing of precursor mRNA to mature $mRNA_1$ e.g., with the 3' or 5' terminus of the anti-sense oligonucleotide being positioned within about, for example, 10, 5, 3, or 2 nucleotide of the intron/exon junction. Also preferred are anti-sense oligonucleotides which overlap the initiation codon and, more generally, those that target the coding region of the target mRNA. When practicing the present invention, the anti-sense oligonucleotides administered may be related in origin to the species to which it is administered. When treating humans, human anti-sense may be used if desired. Anti-sense oligos to endogenous sequences from other species, however, are also encompassed.

Pharmaceutical compositions comprising an anti-sense oligonucleotide as given above effective to reduce expression of an $A_1$ or $A_3$ adenosine receptor by passing through a cell membrane and binding specifically with mRNA encoding an $A_1$ or $A_3$ adenosine receptor in the cell so as to prevent its translation are another aspect of the present invention. Such compositions are provided in a suitable pharmaceutically acceptable carrier, e.g., sterile pyrogen-free saline solution. The anti-sense oligonucleotides may be formulated with a hydrophobic carrier capable of passing through a cell membrane, e.g., in a liposome, with the liposomes carried in a pharmaceutically acceptable aqueous carrier. The oligonucleotides may also be coupled to a substance which inactivates $mRNA_1$ such as a ribozyme. Such oligonucleotides may be administered to a subject to inhibit the activation of a target, such as the adenosine receptors, which subject is in need of such treatment for any of the reasons discussed herein. Furthermore, the pharmaceutical formulation may also contain chimeric molecules comprising anti-sense oligonucleotides attached to molecules which are known to be internalized by cells. These oligonucleotide conjugates utilize cellular uptake pathways to increase cellular concentrations of oligonucleotides. Examples of macromolecules used in this manner include transferrin, asialoglycoprotein (bound to oligonucleotides via polylysine) and streptavidin. In the pharmaceutical formulation, the anti-sense compound may be contained within a lipid particle or vesicle, such as a liposome or microcrystal. The particles may be of any suitable structure, such as unilamellar or plurilamellar, so long as the anti-sense oligonucleotide is contained therein. Positively charged lipids such as N-[1-(2,3-dioleoyloxi) propyl]-N,N,N-trimethylammoniumethylsulfate, or "DOTAP," are particularly preferred for such particles and vesicles. The preparation of such lipid particles is well known. See, e.g., U.S. Pat. No. 4,880,635 to Janoff et al.; U.S. Pat. No. 4,906,477 to Kurono et al.; U.S. Pat. No. 4,911,928 to Wallach; U.S. Pat. No. 4,917,951 to Wallach; U.S. Pat. No. 4,920,016 to Allen et al.; U.S. Pat. No. 4,921,757 to Wheatley et al.; etc.

Subjects may be administered the active composition by any means which transports the anti-sense nucleotide composition to the lung. The anti-sense compounds are particularly disclosed herein may be administered to the lungs of a patient by any suitable means, but are preferably administered by generating an aerosol comprised of respirable particles, the respirable particles comprised of the anti-sense compound, which particles the subject inhales. The respirable particles may be liquid or solid. The particles may optionally contain other therapeutic ingredients. Particles comprised of anti-sense compound for practicing the present invention should include particles of respirable size: that is, particles of a size sufficiently small to pass through the mouth and larynx upon inhalation and into the bronchi and alveoli of the lungs. In general, particles ranging from about 0.5 to about 10 microns in size are respirable. Particles of non respirable size which are included in the aerosol tend to deposit in the throat and be swallowed, and the quantity of non-respirable particles in the aerosol is preferably minimized. For nasal administration, a particle size in the range of 10–500 :m is preferred to ensure retention in the nasal cavity. Thus, particles of about 4, about 10, about 25, about 50 to about 75, about 100, about 250, about 500, and other specific ranges therewithin, are preferred. Others, however, are also contemplated within the confines of this invention.

Liquid pharmaceutical compositions of active compound for producing an aerosol can be prepared by combining the anti-sense compound with a suitable vehicle, such as sterile pyrogen free water. Other therapeutic compounds may optionally be included. Solid particulate compositions containing respirable dry particles of micronized anti-sense compound may be prepared by grinding dry anti-sense compound with a mortar and pestle, and then passing the micronized composition through a 400 mesh screen to break up or separate out large agglomerates. A solid particulate composition comprised of the anti-sense compound may optionally contain a dispersant which serves to facilitate the formation of an aerosol. A suitable dispersant is lactose, which may be blended with the anti-sense compound in any suitable ratio (e.g., a 1 to 1 ratio by weight). Again, other therapeutic compounds may also be included.

The dosage of the anti-sense compound administered will depend upon the disease being treated, the condition of the subject, the particular formulation, the route of administration, the timing of administration to a subject, etc. In general, intracellular concentrations of the oligonucleotide of from about 0.01, about 0.05, about 0.1, about 0.2, about 1 to about 5 μM, about 50 μM, about 100 μM or more, and more particularly about 0.2 to about 0.5 μM, are desired. For administration to a subject such as a human, a dosage of from about 0.0 1, about 0.1 or about 1 mg/Kg up to about 50, about 100, or about 150 mg/Kg and even higher doses are typically employed depending on the route of administration as is known in the art. Depending on the solubility of the particular formulation of active compound administered, the daily dose may be divided among one or several unit dose administrations. Administration of the anti-sense compounds may be carried out therapeutically (i.e., as a rescue treatment) or prophylactically. Aerosols of liquid particles comprising the anti-sense compound may be produced by any suitable means, such as with a nebulizer. See, e.g., U.S. Pat. No. 4,501,729. Nebulizers are commercially available devices which transform solutions or suspensions of the active ingredient into a therapeutic aerosol mist either by means of acceleration of a compressed gas, typically air or oxygen, through a narrow venturi orifice or by means of ultrasonic agitation. Suitable formulations for use in nebulizers consist of the active ingredient in a liquid carrier, the active ingredient comprising up to 40% w/w of the formulation, but preferably less than 20% w/w. The carrier is typically water or a dilute aqueous alcoholic solution, preferably made isotonic with body fluids by the addition of, for example, sodium chloride. Optional additives include preservatives if the formulation is not prepared sterile, for example, methyl hydroxybenzoate, antioxidants, flavoring agents, volatile oils, buffering agents and surfactants.

In one preferred embodiment, the pharmaceutical composition comprises nucleic acid(s) which comprise the anti-sense oligo(s) described above and one or more surfactants. Suitable surfactants or surfactant components for enhancing the uptake of the anti-sense oligonucleotides of the invention include synthetic and natural as well as full and truncated forms of surfactant protein $A_1$ surfactant protein B, surfactant protein C, surfactant protein D and surfactant Protein E, di-saturated phosphatidylcholine (other than dipalmitoyl), dipaimitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolaaine, lysophosphatidylcholine, palniitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palrnitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants may be used either as a single, or as part of a multiple component, surfactant in a formulation, or as covalently bound additions to the 5' and/or 3' ends of the anti-sense oligo(s). Aerosols of solid particles comprising the active compound may likewise be produced with any solid particulate medicament aerosol generator. Aerosol generators for administering solid particulate medicaments to a subject produce particles which are respirable, as explained above, and generate a volume of aerosol containing a predetermined metered dose of a medicament at a rate suitable for human administration. One illustrative type of solid particulate aerosol generator is an insufflator. Suitable formulations for administration by insufflation include finely comminuted powders which may be delivered by means of an insufflator or taken into the nasal cavity in the manner of a snuff. In the insufflator, the powder (e.g., a metered dose thereof effective to carry out the treatments described herein) is contained in capsules or cartridges, typically made of gelatin or plastic, which are either pierced or opened in situ and the powder delivered by air drawn through the device upon inhalation or by means of a manually-operated pump. The powder employed in the insufilator consists either solely of the active ingredient or of a powder blend comprising the active ingredient, a suitable powder diluent, such as lactose, and an optional surfactant. The active ingredient typically comprises from 0.1 to 100 w/w of the formulation. A second type of illustrative aerosol generator comprises a metered dose inhaler. Metered dose inhalers are pressurized aerosol dispensers, typically containing a suspension or solution formulation of the active ingredient in a liquefied propellant. During use these devices discharge the formulation thrcugh a valve adapted to deliver a metered volume, typically from 10 to 150 :l, to produce a fine paricle spray containing the active ingredient. Suitable propellants include certain chlorofluorocarbon compounds, for example, dichlorodifiuoromethane, trichlorofluoromethane, dichlorotetrafluoroetnane and mixtures thereof. The formulation may additionally contain one or more co-solvents, for example, ethanol, surfactants, such as oleic acid or sorbitan trioleate, antioxidants and suitable flavoring agents. The aerosol, whether formed from solid or liquid particles, may be produced by the aerosol generator for example at a rate of from about 10, about 30, about 70 to about 100, about 150, about 150 liters per minute more preferably from about 30 to 150 liters per minute, and most preferably about 60 liters per minute. Aerosols containing greater amounts of medicament, however, may be administered more rapidly as is known in the art.

The relevant disclosures of all scientific publications and patent references cited in this patent are specifically intended to be incorporated herein by reference, particularly in reference to preparatory methods and technologies which are enabling of the invention. The following examples are provided to illustrate the present invention, and should not be construed as limiting thereon.

EXAMPLES

In the following examples, :M means micromolar, ml means milliliters, :m means micrometers, mm means

Example 1
Design and Synthesis of Anti-sense Oligonucleotides

The design of anti-sense oligonucleotides against the $A_1$ and $A_3$ adenosine receptors may require the solution of the complex secondary structure of the target $A_1$ receptor mRNA and the target $A_3$ receptor mRNA. After generating this structure, anti-sense nucleotide are designed which target regions of mRNA which might be construed to confer functional activity or stability to the mRNA and which optimally may overlap the initiation codon. Other target sites are readily usable. As a demonstration of specificity of the anti-sense effect, other oligonucleotides not totally complementary to the target $mRNA_1$ but containing identical nucleotide compositions on a w/w basis, are included as controls in anti-sense experiments.

The mRNA secondary structure of the adenosine $A_1$ receptor was analyzed and used as described above, to design a phosphorothioate anti-sense oligonucleotide. The anti-sense oligonucleotide which was synthesized was designated $HAdA_1AS$ and had the following sequence: 5'-GAT GGA GGG GGG CAT GGC GGG-3' (SEQ ID NO:1). As a control, a mismatched phosphorothioate anti-sense nucleotide designated HAdA1MM1 was synthesized with the following sequence: 5'-GTA GCA GGC GGG GAT GGG GGC-3' (SEQ ID NO:2). Each oligonucleotide had identical base content and general sequence structure. Homology searches in GENBANK (release 85.0) and EMBL (release 40.0) indicated that the anti-sense oligonucleotide was specific for the human and rabbit adenosine $A_1$ receptor genes, and that the mismatched control was not a candidate for hybridization with any known gene sequence.

The secondary structure of the adenosine $A_3$ receptor mRNA was similarly analyzed and used as described above to design two phosphorothioate anti-sense oligonucleotides. The first anti-sense oligonucleotide (HAdA3AS1) synthesized had the following sequence: 5'-GTT GTT GGG CAT CTT GCC-3' (SEQ ID NO:3). As a control, a mismatched phosphorothioate anti-sense oligonucleotide (HAdA3MM1) was synthesized, having the following sequence: 5'-GTA CTT GCG GAT CTA GGC-3' (SEQ ID NO:4). A second phosphorothioate anti-sense oligonucleotide (HAdA3AS2) was also designed and synthesized, haling the following sequence: 5'-GTG GGC CTA GCT CTC GCC-3' (SEQ ID NO:5). Its control oligonucleotide (HAdA3MM2) had the sequence: 5'-GTC GGG GTA CCT GTC GGC-3' (SEQ ID NO:6). Phosphorothioate oligonucleotides were synthesized on an Applied Biosystems Model 396 Oligonucleotide Synthesizer, and purified using NENSORB chromatography (DuPont, MD).

Example 2
In Vivo Testing of Adenosine $A_1$ Receptor Anti-sense Oligos

The anti-sense oligonucleotide against the human $A_1$ receptor (SEQ ID NO:1) described above. was tested for efficacy in an in vitro model utilizing lung adenocarcinoma cells HTB-54. HTB-54 lung adenocarcinoma cells were demonstrated to express the $A_1$ adenosine receptor using standard northern blotting procedures and receptor probes designed and synthesized in the laboratory.

HTB-54 human lung adenocarcinoma cells (106/100 mm tissue culture dish) were exposed to 5.0:M HAdA1AS or HAdA1MM1 for 24 hours, with a fresh change of media and oligonucleotides after 12 hours of incubation. Following 24 hour exposure to the oligonucleotides, cells were harvested and their RNA extracted by standard procedures. A 21-mer probe corresponding to the region of mRNA targeted by the anti-sense (and therefore having the same sequence as the anti-sense, but not phosphorothioated) was synthesized and used to probe northern blots of RNA prepared from HAdA1AS-treated, HAdA1MM1-treated and non-treated HTB-54 cells. These blots showed clearly that HAdA1AS but not HAdA1MM1 effectively reduced human adenosine receptor mRNA by >50%. This result showed that HAdA1AS is a good candidate for an anti-asthma drug since it depletes intracellular mRNA for the adenosine $A_1$ receptor, which is involved in asthma.

Example 3
In Vivo Efficacy of Adenosine $A_1$ Receptor Anti-sense Oligos

A fortuitous homology between the rabbit and human DNA sequences within the adenosine A, gene overlapping the initiation codon permitted the use of the phosphorothioate anti-sense oligonucleotides initially designed for use against the human adenosine $A_1$ receptor in a rabbit model. Neonatal New Zealand white Pasteurella-free rabbits were immunized intraperitoneally within 24 hours of birth with 312 antigen units/ml house dustmite (D. farinae) extract (Berkeley Biologicals, Berkeley, Calif.), mixed with 10% kaolin. Immunizations were repeated weekly for the first month and then biweekly for the next 2 months. At 3–4 months of age, eight sensitized rabbits were anesthetized and relaxed with a mixture of ketamine hydrochloride (44 mg/kg) and acepromazine maleate (0.4 mg/kg) administered intramuscularly. The rabbits were then laid supine in a comfortable position on a small molded, padded animal board and intubated with a 4.0-mm intratracheal tube (Mallinkrodt, Inc., Glens Falls, N.Y.). A polyethylene catheter of external diameter 2.4 mm with an attached latex balloon was passed into the esophagus and maintained at the same distance (approximately 16 cm) from the mouth throughout the experiments. The intratracheal tube was attached to a heated Fleisch pneumotachograph (size 00; DOM Medical, Richmond, Va.), and flow was measured using a Validyne differential pressure transducer (Model DP-45161927; Validyne Engineering Corp., Northridge, Calif.) driven by a Gould carrier amplifier (Model 11-4113; Gould Electronic, Cleveland, Ohio). The esophageal balloon was attached to one side of the differential pressure transducer, and the outflow of the intratracheal tube was connected to the opposite side of the pressure transducer to allow recording of transpulmonary pressure. Flow was integrated to give a continuous tidal volume, and measurements of total lung resistance (RL) and dynamic compliance (Cdyn) were calculated at isovolumetric and flow zero points, respectively, using an automated respiratory analyzer (Model 6; Buxco, Sharon, Conn.). Animals were randomized and on Day 1 pretreatment values for PC50 were obtained for aerosolized adenosine. Anti-sense (HAdA1AS) or mismatched control (HAdA1MM) oligonucleotides were dissolved in sterile physiological saline at a concentration of 5000 :g (5 mg) per 1.0 ml. Animals were subsequently administered the aerosolized anti-sense or mismatch oligonucleotide via the intratracheal tube (approximately 5000 :g in a volume of 1.0 ml), twice daily for two days. Aerosols of either saline, adenosine, or anti-sense or mismatch oligonucleotides were generated by an ultrasonic nebulizer (DeVilbiss, Somerset, Pa.), producing aerosol droplets 80% of which were smaller than 5 :m in diameter. In the first arm of the experiment, four randomly selected allergic rabbits were administered anti-sense oligonucleotide and four the mismatched control oligonucleotide. On the morning of the third day, PC50 values (the concentration of aerosolized adenosine in mg/ml required to reduce the dynamic compliance of the bronchial airway 50% from the baseline value) were obtained and compared to PC50 values obtained for these animals prior to exposure to oligonucleotide. Following a 1 week interval, animals were crossed over, with those previously administered mismatch control oligonucleotide now administered anti-sense oligonucleotide, and those previously treated with anti-sense oligonucleotide now administered mismatch control oligonucleotide. Treatment methods and measurements were identical to those employed in the first arm of the experiment. It should be noted that in six of the eight animals treated with anti-sense oligonucleotide, adenosine-mediated broachoconstriction could not be obtained up to the limit of solubility of adenosine, 20 mg/ml. For the purpose of calculation, PC50 values for these animals were set at 20 mg/ml. The values given therefore represent a minimum figure for anti-sense effectiveness. Actual effectiveness was higher. The results of this experiment are illustrated in Table 5 below.

TABLE 5

Effect of Adenosine $A_1$ Receptor Anti-sense Oligo upon PC50 Values in Asthmatic Rabbits

| Mismatch Control | | $A_1$ Receptor Anti-sense Oligo | |
|---|---|---|---|
| Pre Oligo-nucleotide | Post Oligo-nucleotide | Pre Oligo-nucleotide | Post Oligo-nucleotide |
| 3.56 ± 1.02 | 5.16 ± 1.03 | 2.36 ± 0.68 | >19.5 ± 0.34** |

The results are presented as the mean (n = 8) ± SEM.
The significance was determined by repeated-measures analysis of variance (ANOVA), and Tukey's protected test.
**Significantly different from all other groups, $p < 0.01$ In both arms of the experiment, animals receiving the anti-sense oligonucleotide showed an order of magnitude increase in the dose of aerosolized adenosine required to reduce dynamic compliance of the lung by 50%. No effect of the mismatched control oligonucleotide upon PC50 values was observed. No toxicity was observed in any animal receiving either anti-sense or control inhaled oligonucleotide. These results show clearly hat the lung has exceptional potential as a target for anti-sense oligonucleotide-based therapeutic intervention in lung disease. They further show, in a model system which closely resembles human asthma, that downregulation of the adenosine $A_1$ receptor largely eliminates adenosine-mediated bronchoconstriction in asthmatic airways. Bronchial hyperresponsiveness in the allergic rabbit model of human asthma is an excellent endpoint for anti-sense intervention since the tissues involved in this response lie near to the point of contact with aerosolized oligonucleotides, and the model closely simulates an important human disease.

Example 4
Specificity of $A_1$-adenosine Receptor Anti-sense Oligonucleotide

At the conclusion of the cross-over experiment of Example 3 above, air-way smooth muscle from all rabbits was quantitatively analyzed for adenosine $A_1$ receptor number. As a control for the specificity of the anti-sense oligonucleotide, adenosine $A_2$ receptors, which should not have been affected, were also quantified. Airway smooth muscle tissue was dissected from each rabbit and a membrane fraction prepared according to the method of Kleinstein et al. (Kleinstein, J. and Glossmann, H., Naunyn-Schmiedeberg's Arch. Pharmacol. 305: 191–200 (1978)), the relevant portion of which is hereby incorporated in its entirety by reference, with slight modifications. Crude plasma membrane preparations were stored at 70 EC until the time of assay. Protein content was determined by the method of Bradford (M. Bradford, Anal. Biochem. 72, 240–254 (1976), the relevant portion of which is hereby incorporated in its entirety by reference). Frozen plasma membranes were thawed at room temperature and were incubated with 0.2 U/ml adenosine deaminase for 30 minutes at 37 EC to remove endogenous adenosine. The binding of [$^3$H] DPCPX ($A_1$ receptor-specific) or [$^3$H] CGS-21680 ($A_1$ receptor-specific) was measured as previously described by Ali et al. (Ali, S. et al., J. Pharmacol. Exp. Ther. 268, Am. J. Physiol 266, L271–277 (1994), the relevant portion of which is hereby incorporated in its entirety by reference). The animals treated with adenosine $A_1$ anti-sense oligonucleotide in the cross-over experiment had a nearly 75% decrease in $A_1$ receptor number compared to controls, as assayed by specific binding of the $A_1$-specific antagonist DPCPX. There was no change in adenosine $A_2$ receptor number, as assayed by specific binding of the $A_2$ receptor-specific agonist 2-[p-(2-carboxyethyl)-phenethylamino]-5'-(N-ethylcarboxamido) adenosine (CGS-21630). This is illustrated in Table 6 below.

TABLE 6

Specificity of Action of Adenosine $A_1$ Receptor Oligonucleotide Anti-sense

| | Mismatch Control Oligonucleotide | $A_1$ Anti-sense Oligonucleotide |
|---|---|---|
| $A_1$-Specific Binding | 1105 ± 48** | 293 ± 18 |
| $A_2$-Specific Binding | 302 ± 22 | 442 ± 171 |

The results are presented as the mean (n = 8) ± SEM.
The significance was determined by repeated-measures analysis of variance (ANOVA), and Tukey's protected test
**Significantly different from mismatch control, $p < 0.01$.

The above results illustrate the effectiveness of a anti-sense oligonucleotides in treating airway disease. Since the anti-sense oligos described above eliminate the receptor systems responsible for adenosine-mediated bronchoconstriction, it may be less imperative to eliminate adenosine from them. However, it would be preferable to eliminate adenosine from even these oligonucleotides to reduce the dose needed to attain a similar effect. Described above are other anti-sense oligonucleotides targeting mRNA of proteins involved in inflammation. Adenosine has been eliminated from their nucleotide content to prevent its liberation during degradation.

Example 5
Anti-sense Oligos Directed to Other Target Nucleic Acids

This work was conducted to demonstrate that the present invention is broadly applicable to anti-sense oligonucleotides ("oligos") specific to nucleic acid targets broadly. The following experimental studies were conducted to show that the method of the invention is broadly suitable for use with anti-sense oligos designed as taught by this application and targeted to any and all adenosine receptor mRNAs. For this purpose, various anti-sense oligos were porepared to adenosine receptor mRNAs exemplified by the adenosine $A_1$, $A_{2b}$ and $A_3$ receptor mRNAs. Anti-sense Oligo I was disclosed above (SEQ. ID NO:1). Five additional anti-sense phosphorothioate oligos were designed asnd synthesized as indicated above.

1—Oligo II (SEQ. ID NO: 7) also targeted to the adenosine $A_1$ receptor, but to a different region than Oligo I.

2—Oligo V (SEQ. ID NO: 10) targeted to the adenosine $A_{2b}$ receptor.
3—Oligos III (SEQ. ID NO: 8) and IV (SEQ. ID NO: 9) targeted to different regions of the adenosine $A_3$ receptor.
4—Oligo I-PD (SEQ. ID NO: 1681)(a phosphodiester oligo of the same sequence as Oligo I).

These anti-sense oligos were designed for therapy on a selected species as described above and are generally specific for that species, unless the segment of the target mRNA of other species happens to contain a similar sequences. All anti-sense oligos were prepared as described below, and tested in vivo in a rabbit model for bronchoconstriction, inflammation and allergy, which have breathing difficulties and impeded lung airways, as is the case in ailments such as asthma, as described in the above-identified application.

Example 6
Design & Sequences of Other Anti-sense Oligos

Six oligos and their effects in a rabbit model were studied and the results of these studies are reported and discussed below. Five of these oligos were selected for this study to complement the data on Oligo I (SEQ ID NO: 1) provided in Examples 1 to 4 above. This oligo is anti-sense to one region of the adenosine $A_1$ receptor RNA. The oligos tested are identified as anti-sense Oligos I (SEQ ID NO: 1) and II (SEQ. ID No: 7) targeted to a different region of the adenosine $A_1$ receptor $mRNA_1$ Oligo V (SEQ. ID No:8) targeted to the adenosine $A_{2b}$ receptor $mRNA_1$ and anti-sense Oligos III and IV (SEQ. ID NOS: 9 and 10) targeted to two different regions of the adenosine $A_3$ receptor mRNA. The sixth oligo (Oligo I-PD) is a phosphodiester version of Oligo I (SEQ. ID NO:1). The design and synthesis of these anti-sense oligos was performed in accordance with Example 1 above.

(I) Anti-sense Oligo I

The anti-sense oligonucleotide I referred to in Examples 1 to 4above is targeted to the human $A_1$ adenosine receptor mRNA (EPI 2010). Anti-sense oligo I is 21 nucleotide long, overlaps the initiation codon, and has the following sequence:5'-GAT GGA GGG CGG CAT GGC GGG-3' (SEQ.ID NO:1). The oligo I was previously shown to abrogate the adenosine-induced bronchoconstriction in allergic rabbits, and to reduce allergen-induced airway obstruction and bronchial hyperresponsiveness (BHR), as discussed above and shown by Nyce, J. W. & Metzger, W. J., Nature, 385:721 (1977), the relevant portions of which reference are incorporated in their entireties herein by reference.

(II) Anti-sense Oligo II

A phosphorothioate anti-sense oligo (SEQ. ID NO:7) was designed in accordance with the invention to target the rabbit adenosine $A_1$ receptor mRNA region +936 to +956 relative to the initiation codon (start site). The anti-sense oligo II is 21 nucleotide long, and has the following sequence: 5'-CTC GTC GCC GTC GCC GGC GGG-3' (SEQ. ID NO:7).

(III) Anti-sense Oligo III

A phosphorothioate anti-sense oligo other than that provided in Example 1 above (SEQ. ID NO:8) was designed in accordance with the invention to target the anti-sense $A_3$ receptor mRNA region +3 to +22 relative to the initiation codon start site. The anti-sense oligo III is 20 nucleotide long, and has the following sequence: 5'-GGG TGG TGC TAT TGT CGG GC-3' (SEQ. ID NO:8).

(IV) Anti-sense Oligo IV

Yet another phosphorothioate anti-sense oligo (SEQ. ID NO:9) was designed in accordance with the invention to target the adenosine $A_3$ receptor mRNA region +386 to +401 relative to the initiation codon (start site). The anti-sense oligo IV is 15 nucleotide long, and has the following sequence: 5'-GGC CCA GGG CCA GCC-3' (SEQ. ID NO:9)

(V) Anti-sense Oligo V

A phosphorothioate anti-sense oligo (SEQ. ID NO:10) was designed in accordance with the invention to target the adenosine $A_{2b}$ receptor mRNA region −21 to −1 relative to the initiation codon (start site). The anti-sense oligonucleotide V is 21 nucleotide long, and has the following sequence: 5'-GGC CGG GCC AGC CGG GCC CGG-3' (SEQ. ID NO:10).

(VI) $A_1$ Mismatch Oligos

Two different mismatched oligonucleotides having the following sequences were used as controls for anti-sense oligo I(SEQ. ID NO: 1) described in Example 5 above: $A_1$ MM2:5'-GTA GGT GGC GGG CAA GGC GGG-3' (SEQ. ID NO:2421), and $A_1$ MM3:5'-GAT GGA GGC GGG CAT GGC GGG-3' (SEQ. ID NO:2422). Anti-sense oligo I and the two mismatch anti-sense oligos had identical base content and general sequence structure. Homology searches in GENBANK (release 85.0) and EMBL (release 40.0) indicated that the anti-sense oligo I was specific, not only for the human, but also for the rabbit, adenosine $A_1$ receptor genes, and that the mismatched controls were not candidates for hybridization with any known human or animal gene sequence.

(VII) Anti-sense Oligo $A_1$-PD (Oligo VI)

A phosphodiester anti-sense oligo (Oligo VI; SEQ. ID NO:2420) having the same nucleotide sequence as Oligo I was designed as disclosed in the above-identified application. Anti-sense oligo I-PD is 21 nucleotide long, overlaps the initiation codon, and has the following sequence: 5'-GAT GGA GGG CGG CAT GGC GGG-3' (SEQ. ID NO:2420).

III) Controls

Each rabbit was administered 5.0 ml aerosolized sterile saline following the same schedule as for the anti-sense oligos in (II), (III), and (IV) above.

Example 7
Synthesis of Anti-sense Oligos

Phosphorothioate anti-sense oligos having the sequences described in (a) above, were synthesized on an Applied Biosystems Model 396 Oligonucleotide Synthesizer, and purified using NENSORB chromatography (DuPont, DE). TETD (tetraethylthiuram disulfide) was used as the sulfurizing agent during the synthesis. Anti-sense oligonucleotide II (SEQ. ID NO:7), anti-sense oligonucleotide III (SEQ. ID NO: 8) and anti-sense oligonucleotide IV (SEQ. ID NO: 9) were each synthesized and purified in this manner.

Example 8
Preparation of Allergic Rabbits

Neonatal New Zealand white Pasturella-free rabbits were immunized intraperitoneally within 24 hours of birth with 0.5 ml of 312 antigen units/ml house dust mite (D. farinae) extract (Berkeley Biologicals, Berkeley, Calif.) mixed with 10% kaolin as previously described (Metzger, W. J., in Late Phase Allergic Reactions, Dorsch, W., Ed., CRC Handbook, pp. 347–362, CRC Press, Boca Raton (1990); Ali, S., Metzger, W. J. and Mustafa, S. J., Am. J. Resp. Crit. Care Med. 149: 908 (1994)), the relevant portions of which are incorporated in their entireties here by reference. Immunizations were repeated weekly for the first month and then biweekly until the age of 4 months. These rabbits preferentially produce allergen-specific IgE antibody, typically respond to aeroallergen challenge with both an early and late-phase asthmatic response, and show bronchial hyper responsiveness (BHR). Monthly intraperitoneal administration of allergen (312 units dust mite allergen, as above)

continues to stimulate and maintain allergen-specific IgE antibody and BHR. At 4 months of age, sensitized rabbits were prepared for aerosol administration as described by Ali et al. (Ali, S., Metzger, W. J. and Mustafa, S. J., Am. J. Resp. Crit. Care Med. 149 (1994)), the relevant section being incorporated in its entirety here by reference.

Dose-response Studies

Example 9

Experimental Setup

Aerosols of either adenosine (0–20 mg/ml), or anti-sense or one of two mismatch oligonucleotides (5 mg/ml) were separately prepared with an ultrasonic nebulizer (Model 646, DeVilbiss, Somerset, Pa.), which produced aerosol droplets, 80% of which were smaller than 5 :m in diameter. Equal volumes of the aerosols were administered directly to the lungs via an intratracheal tube. The animals were randomized, and administered aerosolized adenosine. Day 1 pre-treatment values for sensitivity to adenosine were calculated as the dose of adenosine causing a 50% loss of compliance ($PC_{50}$ Adenosine). The animals were then administered either the aerosolized anti-sense or one of the mismatch anti-sense oligos via the intratracheal tube (5 mg/1.0 ml), for 2 minutes, twice daily for 2 days (total dose, 20 mg). Post-treatment $PC_{50}$ values were recorded (post-treatment challenge) on the morning of the third day. The results of these studies are provided in Example 21 below.

Example 10

Crossover Experiments

For some experiments utilizing anti-sense oligo I (SEQ ID NO: 1) and a corresponding mismatch control oligonucleotide A1MM2, following a 2 week interval, the animals were crossed over, with those previously administered the mismatch control $A_1MM2$, now receiving the anti-sense oligo I, and those previously treated with the anti-sense oligo I, now receiving the mismatch control $A_1MM2$ oligo. The number of animals per group was as follows. For mismatch $A_1MM2$ (Control 1), n=7, since one animal was lost in the second control arm of the experiment due to technical difficulties, for mismatch $A_1MM3$ n=4 (Control 2) and for $A_1AS$ anti-sense oligo I, n=8. The $A_1MM3$ oligo-treated animals were analyzed separately and were not part of the cross-over experiment. The treatment methods and measurements employed following the cross-over were identical to those employed in the first arm of the experiment. In 6 of the 8 animals treated with the anti-sense oligo I (SEQ. ID NO: 1), no $PC_{50}$ value could be obtained for adenosine doses of up to 20 mg/ml, which is the limit of solubility of adenosine. Accordingly, the $PC_{50}$ values for these animals were assumed to be 20 mg/ml for calculation purposes. The values given, therefore, represent a minimum figure for the effectiveness of the anti-sense oligonucleotides of the invention. Other groups of allergic rabbits (n=4 for each group) were administered 0.5 or 0.05 mg doses of the anti-sense oligo I (SEQ ID NO: 1), or the $A_1MM2$ oligo in the manner and according to the schedule described above (the total doses being 2.0 or 0.2 mg). The results of these studies are provided in Example 22 below.

Example 11

Anti-sense Oligo Formulation

Each one of anti-sense oligos were separately solubilized in an aqueous solution and administered as described for anti-sense oligo I (SEQ. ID No:1) in (e) above, in four 5 mg aliquots (20 mg total dose) by means of a nebulizer via endotracheal tube, as described above. The results obtained for anti-sense oligo I and its mismatch controls confirmed that the mismatch controls are equivalent to saline, as described in Example 19 below and in Table 1 of Nyce & Metzger, Nature 385: 721–725 (1997). Because of this finding, saline was used as a control for pulmonary function studies employing anti-sense oligos II, III and IV (SEQ. IS NOS; 7, 8 and 9).

Example 12

Specificity of Oligo I for Adenosine $A_1$ Receptor (Receptor Binding Studies)

Tissue from airway smooth muscle was dissected to primary, secondary and tertiary bronchi from rabbits which had been administered 20 mg oligo I (SEQ ID NO: 1) in 4 divided doses over a period of 48 hours as described above. A membrane fraction was prepared according to the method of Ali et al. (Ali, S., et al., Am. J. Resp. Crit. Care Med. 149: 908 (1994), the relevant section relating to the preparation of the membrane fraction is incorporated in its entirety hereby by reference). The protein content was determined by the method of Bradford and plasma membranes were incubated with 0.2 U/ml adenosine deaminase for 30 minutes at 37 EC to remove endogenous adenosine. See, Bradford, M. M. Anal. Biochem. 72, 240–254 (1976), the relevant portion of which is hereby incorporated in its entirety by reference. The binding of [$^3$H]DPCPX, [$^3$H]NPC17731, or [$^3$H]CGS-21680 was measured as described by Jarvis et al. See, Jarvis, M. F., et al., Pharmacol. Exptl. Ther. 251, 888–893 (1989), the relevant portion of which is fully incorporated herein by reference. The results of this study are shown in Table 8 and discussed in Example 20 below.

Example 13

Pulmonary Function Measurements (Compliance $c_{DYN}$ and Resistance)

At 4 months of age, the immunized animals were anesthetized and relaxed with 1.5 ml of a mixture of ketamine HCl (35 mg/kg) and acepromazine maleate (1.5 mg/kg) administered intramuscularly. After induction of anesthesia, allergic rabbits were comfortably positioned supine on a soft molded animal board. Salve was applied to the eyes to prevent drying, and they were closed. The animals were then intubated with a 4.0 mm intermediate high-low cuffed Murphy 1 endotracheal tube (Mallinckrodt, Glen Falls, N.Y.), as previously described by Zavala and Rhodes. See, Zavala and Rhodes, Proc. Soc. Exp. Biol. Med. 144: 509–512 (1973), the relevant portion of which is incorporated herein by reference in its entirety. A polyethylene catheter of OD 2.4 mm (Becton Dickinson, Clay Adams, Parsippany N.J.) with an attached thin-walled latex balloon was passed into the esophagus and maintained at the same distance (approximately 16 cm) from the mouth throughout the experiment. The endotracheal tube was attached to a heated Fleisch pneumotach (size 00; DEM Medical, Richmond, Va.), and the flow (v) measured using a Validyne differential pressure transducer (Model DP-45-16-1927, Validyne Engineering, Northridge, Calif.), driven by a Gould carrier amplifier (Model 11-4113, Gould Electronics, Cleveland, Ohio). An esophageal balloon was attached to one side of the Validyne differential pressure transducer, and the other side was attached to the outflow of the endotracheal tube to obtain transpulmonary pressure ($P_{tp}$). The flow was integrated to yield a continuous tidal volume, and the measurements of total lung resistance ($R_t$) and dynamic compliance ($C_{dyn}$) were made at isovolumetric and zero flow points. The flow, volume and pressure were recorded on an eight channel Gould 2000 W high-frequency recorder and $C_{dyn}$ was calculated using the total volume and the difference in $P_{tp}$ at zero flow, and . $R_t$ was calculated as the ratio of Ptp and V at midtidal lung volumes. These calculations were made automatically with the Buxco automated pulmonary mechanics respiratory analyzer (Model 6, Buxco Electronics, Sharon, Conn.), as previously described by Giles et al. See, Giles et al., Arch. Int. Pharmacodyn. Ther. 194: 213–232 (1971), the relevant portion of which describing these calculations is incorporated in toto hereby by reference. The results obtained upon administration of oligo II on allergic rabbits are shown and discussed in Example 26 below.

Example 14
Measurement of Bronchial Hyperresponsiveness (BHR)

Each allergic rabbit was administered histamine by aerosol to determine their baseline hyperresponsiveness. Aerosols of either saline or histamine were generated using a DeVilbiss nebulizer (DeVilbiss, Somerset, Pa.) for 30 seconds and then for 2 minutes at each dose employed. The ultrasonic nebulizer produced aerosol droplets of which 80% were <5 micron in diameter. The histamine aerosol was administered in increasing concentrations (0.156 to 80 mg/ml) and measurements of pulmonary function were made after each dose. The B4R was then determined by calculating the concentration of histamine (mg/ml) required to reduce the $C_{dyn}$ 50% from baseline ($PC_{50\ Histamine}$).

Example 15
Cardiovascular Effect of Anti-sense Oligo I

The measurement of cardiac output and other cardiovascular parameters using CardiomaxJ utilizes the principal of thermal dilution in which the change in temperature of the blood exiting the heart after a venous injection of a known volume of cool saline is monitored. A single rapid injection of cool saline was made into the right atrium via cannulation of the right jugular vein, and the corresponding changes in temperature of the mixed injectate and blood in the aortic arch were recorded via cannulation of the carotid artery by a temperature-sensing miniprobe. Twelve hours after the allergic rabbits had been treated with aerosols of oligo I (EPI 2010; SEQ. ID NO: 1) as described in (d) above, the animals were anesthetized with 0.6 ml/kg of 80% Ketamine and 20% Xylazinc. This time point coincides with previous data showing efficacy for SEQ. ID NO: 1, as is clearly shown by Nyce & Metzger, (1997), supra, the pertinent disclosure being incorporated in its entirety here by reference. A thermocouple was then inserted into the left carotid artery of each rabbit, and was then advanced 6.5 cm and secured with a silk ligature. The right jugular vein was then cannulated and a length of polyethylene tubing was inserted and secured. A thermodilution curve was then established on a CardiomaxJ II (Columbus Instruments, Ohio) by injecting sterile saline at 20 EC to determine the correctness of positioning of the thermocouple probe. After establishing the correctness of the position of the thermocouple, the femoral artery and vein were isolated. The femoral vein was used as a portal for drug injections, and the femoral artery for blood pressure and heart rate measurements. Once constant baseline cardiovascular parameters were established, CardiomaxJ measurements of blood pressure, heart rate, cardiac output, total peripheral resistance, and cardiac contractility vere made.

Example 16
Duration of Action of Oligo I (SEQ. ID NO: 1)

Eight allergic rabbits received initially increasing log doses of adenosine by means of a nebulizer via an intratracheal tube as described in (f) above, beginning with 0.156 mg/ml until compliance was reduced by 50% ($PC_{50\ Adenosine}$) to establish a baseline. Six of the rabbits then received four 5 mg aerosolized doses of (SEQ. ID NO: 1) as described above. Two rabbits received equivalent amounts of saline vehicle as controls. Beginning 18 hours after the last treatment, the $PC_{50\ Adenosine}$ values were tested again. After this point, the measurements were continued for all animals each day, for up to 10 days. The results of this study are discussed in Example 25 below.

Example 17
Reduction of Adenosine $A_{2b}$ Receptor Number by Anti-sense Oligo V Sprague Dawley rats were administered 2.0 mg respirable anti-sense oligo V (SEQ ID NO:10) three times over two days using an inhalation chamber as described above. Twelve hours after the last administration, lung parenchymal tissue was dissected and assayed for adenosine $A_{2b}$ receptor binding using [311]-NECA as described by Nyce & Metzger (1997), supra. Controls were conducted by administration of equal volumes of saline. The results are significant at $p<0.05$ using Student's paired t test, and are discussed in Example 28 below.

Example 18
Comparison of Oligo I & Corresponding Phosphodiester Oligo VI (SEQ. ID NO:1681)

Oligo I (SEQ ID NO:1) countered the effects of adenosine and eliminated sensitivity to it for adenosine amounte up to 20 mg adenosine/5.0 ml (the limit of solubility of adenosine). Oligo VI (SEQ ID NO:1681), the phosphodiester version of the oligonucleotide sequence, was completely ineffective when tested in the same manner. Both compounds have identical sequence, differing only in the presence of phosphorothioate. residues in Oligo I (SEQ ID NO:1), and were delivered as an aerosol as described above and in Nyce & Metzger (1997), supra. Significantly different at $p<0.001$, Student's paired t test. The results are discussed in Example 29 below.

Results Obtained for Anti-sense Oligo I (SEQ. ID NO: 1)

Example 19
Results of Prior Work

The nucleotide sequence and other data for anti-sense oligo I (SEQ. ID NO: 1), which is specific for the adenosine A receptor, were provided above. The experimental data showing the effectiveness of oligo I in down regulating the receptor number and activity were also provided above. Further information on the characteristics and activities of anti-sense oligo I is provided in Nyce, J. W. and Metzger, W. J., Nature 385:721 (1957), the relevant parts of which relating to the following results are incorporated in their entireties herein by reference. The Nyce & Metzger (1997) publication provided data showing that the anti-sense oligo I (SEQ. ID NO: 1):

(1) The anti-sense oligo I reduces the number of adenosine $A_1$ receptors in the bronchial smooth muscle of allergic rabbits in a dose-dependent manner as may be seen in Table 5 below.

(2) Anti-sense Oligo I attenuates adenosine-induced bronchoconstriction and allergen-induced bronchoconstriction.

(3) The Oligo I attenuates bronchial hyperresponsiveness as measured by $PC_{50}$ histamine, a standard measurement to assess bronchial hyperresponsiveness. This result clearly demonstrates anti-inflammatory activity of the anti-sense oligo I as is shown in Table 5 above.

(4) As expected, because it was designed to target it, the anti-sense oligo I is totally specific for the adenosine $A_1$ receptor, and has no effect at all at any dose on either the very closely related adenosine $A_2$ receptor or the related bradykinin $B_2$ receptor. This is seen in Table 5 below.

(5) In contradistinction to the above effects of the Oligo I, the mismatch control molecules MM2 and MM3 (SEQ. ID NO:1682 and SEQ. ID NO:1683) which have identical base composition and molecular weight but differed from the anti-sense oligo I (SEQ ID NO: 1) by 6 and 2 mismatches, respectively. These mismatches, which are the minimum possible while still retaining identical base composition, produced absolutely no effect upon any of the targeted receptors ($A_1$, $A_2$ or $B_2$).

These results, along with a complete lack of prior art on the use of anti-sense oligonucleotides, such as oligo I, targeted to the adenosine $A_1$ receptor, are unexpected results. The showings presented in this patent clearly enable and demonstrate the effectiveness, for their intended use, of the claimed agents and method for treating a disease or condition associated with lung airway, such as bronchoconstriction, inflammation, allergy(ies), and the like.

Example 20
Oligo I Significantly Reduces Response to Adenosine Challenge

The receptor binding experiment is described in Example 12 above, and the results shown in Table 5 below which shows the binding characteristics of the adenosine $A_1$-selective ligand [$_3$H]DPCPX and the bradykinin $E_{-2}$-selective ligand [$^3$H]NPC 17731 in membranes isolated from airway smooth muscle of $A_1$ adenosine receptor and $B_2$ bradykinin receptor anti-sense- and mismatch-treated allergic rabbits.

Example 21
Dose-response Effect of Oligo I

Anti-sense oligo I (SEQ ID NO:1) was found to reduce the effect of adenosine administration to the animal in a dose-dependent manner over the dose range tested as shown in Table 6 below.

TABLE 6

| Dose-Response Effect to Anti-sense Oligo I | |
|---|---|
| Total Dose (mg) | $PC_{50\ Adenosine}$ (mg Adenosine) |
| Anti-sense Oligo I | |
| 0.2 | 8.32 ± 7.2 |
| 2.0 | 14.0 ± 7.2 |
| 20 | 19.5 ± 0.34 |
| $A_1$MM2 oligo (control) | |
| 0.2 | 2.51 ± 0.46 |
| 2.0 | 3.13 ± 0.71 |
| 20 | 3.25 ± 0.34 |

The above results were studied with the Student's paired t test and found to be statistically different. p = 0.05

The oligo I (SEQ. ID NO:1), an anti-adenosine $A_1$ receptor oligo, acts specifically on the adenosine $A_1$ receptor, but not on the adenosine $A_2$ receptors. These results stem from the treatment of rabbits with anti-sense oligo I (SEQ. ID NO.1) or mismatch control oligo (SEQ. ID NO:1682; $A_1$MM2) as described in Example 9 above and in Nyce & Metzger (1997), supra (four doses of 5 mg spaced 8 to 12 hours apart via nebulizer via endotracheal tube), bronchial smooth muscle tissue excised and the number of adenosine $A_1$ and adenosine $A_2$ receptors determined as reported in Nyce & Metzger (1997), supra.

TABLE 5

| | Binding characteristics of Three Anti-Sense Oligos | | | |
|---|---|---|---|---|
| | $A_1$ receptor | | $B_1$ receptor | |
| Treatment[1] | Kd | $B_{max}$ | Kd | Bmax |
| Adenosine $A_1$ Receptor | | | | |
| 20 mg | 0.36 ± 0.029 nM | 19 ± 1.52 fmoles* | 0.39 ± 0.031 nM | 14.8 ± 0.99 fmoles |
| 2 mg | 0.38 ± 0.030 nM | 32 ± 2.56 fmoles* | 0.41 ± 0.028 nM | 15.5 ± 1.08 |
| 0.2 mg | 0.37 ± 0.030 nM | 49 ± 3.43 fmoles | 0.34 ± 0.024 nM | 15.0 ± 1.06 |
| $A_1$MM1 (Control) | | | | |
| 20 mg | 0.34 ± 0.027 nM | 52.0 ± 3.64 fmoles | 0.35 ± 0.024 nM | 14.0 ± 1.0 fmoles |
| 2 mg | 0.37 ± 0.033 nM | 51.8 ± 3.88 fmoles | 0.38 ± 0.028 nM | 14.6 ± 1.02 |
| $B_2$A(Bradykinin Receptor) | | | | |
| 20 mg | 0.36 ± 0.028 nM | 45.0 ± 3.15 fmoles | 0.38 ± 0.027 nM | 8.7 ± 0.62 |
| 2 mg | 0.39 ± 0.035 nM | 44.3 ± 2.90 fmoles | 0.34 ± 0.024 nM | 11.9 ± 0.76 |
| 0.2 mg | 0.40 ± 0.028 nM | 47.0 ± 3.76 fmoles | 0.35 ± 0.028 nM | 15.1 ± 1.05 fmoles |
| $B_2$MM | | | | |
| 20 mg | 0.39 ± 0.031 nM | 42.0 ± 2.94 fmoles | 0.41 ± 0.029 nM | 14.0 ± 0.98 fmoles |
| 2 mg | 0.41 ± 0.035 nM | 40.0 ± 3.20 fmoles | 0.37 ± 0.030 nM | 14.8 ± 0.99 fmoles |
| 0.2 mg | 0.37 ± 0.029 nM | 43.0 ± 3.14 fmoles | 0.36 ± 0.025 nM | 15.1 ± 1.35 fmoles |
| Saline Control | 0.37 ± 0.041 | 46.0 ± 5.21 | 0.39 ± 0.047 nM | 14.2 ± 1.35 fmoles |

[1]Refers to total oligo administered in four equivalently divided doses over a 48 hour period. Treatments and analyses were performed as described in methods. Significance was determined by repeated-measures analysis of variance (ANOVA), and Tukey's protected t test. n = 4–6 for all groups.
*Significantly different from mismatch control- and saline-treated groups. p < 0.001;
**Significantly different from mismatch control- and saline-treated groups p < 0.05.

Example 22
Specificity of Oligo I (SEQ. ID NO:1) for Target Gene Product

Oligo I (SEQ. ID No:1) is specific for the adenosine $A_1$ receptor whereas its mismatch controls had no activity. FIG. 1 depicts the results obtained from the cross-over experiment described in Example 10 above and in Nyce & Metzger (1997), supra. The two mismatch controls (SEQ. ID NO:1682 and SEQ. ID NO:1683) evidenced no effect on the $PC_{50\ Adenosine}$ value. On the contrary, the administration of anti-sense oligo I (SEQ. ID NO:1) showed a seven-fold increase in the $PC_{50\ Adenosine}$ value. The results clearly indicate that the anti-sense oligo I (SEQ. ID NO: 1) reduces the response (attenuates the sensitivity) to exogenously administered adenosine when compared with a saline control. The results provided in Table 6 above clearly establish that the effect of the anti-sense oligo I is dose dependent (see, column 3 of Table 5). The Oligo I was also shown to be totally specific for the adenosine $A_1$ receptor, (see, top 3 rows of Table), inducing no activity at either the closely related adenosine $A_2$ receptor or the bradykinin $B_2$ receptor (see, lines 8–10 of Table 6 above). In addition, the results shown in Table 6 establish that the anti-sense oligo I (SEQ. ID NO:1) decreases sensitivity to adenosine in a dose dependent manner, and that it does this in an anti-sense oligo-dependent manner since neither of two mismatch control oligonucleotides ($A_1$MM2; SEQ. ID NO:1682 and $A$ MM3; SEQ. ID NO;1683) show any effect on $PC_{50\ Adenosine}$ values or on attenuating the number of adenosine $A_1$ receptors.

Example 23
Effect on Aeroallergen-induced Bronchoconstriction & Inflammation The Oligo I (SEQ. ID NO:1) was shown to significantly reduce the histamine-induced effect in the rabbit model when compared to the mismatch oligos. The effect of the anti-sense Oligo I (SEQ. ID No:1) and the mismatch oligos ($A_1$MM2, SEQ. ID NO:1682 and $A_1$MM3, SEQ. ID NO:1682) on allergen-induced airway obstruction and bronchial hyperresponsiveness was assessed in allergic rabbits. The effect of the anti-sense oligo I (SEQ. ID NO:1) on allergen-induced airway obstruction was assessed. As calculated from the area under the plotted curvet the anti-sense oligo I significantly inhibited allergen-induced airway obstruction when compared with the mismatched control (55%, $p<0.05$; repeated measures $ANOVA_1$ and Tukey's t test). A complete lack of effect was induced by the mismatch oligo $A_1$MM2 (Control) on allergen induced airway obstruction. The effect of the anti-sense oligo I (SEQ. ID NO:1) on allergen-induced BHR was determined as above. As calculated from the $PC_{50\ Histamine}$ value, the anti-sense oligo I (SEQ. ID NO:1) significantly inhibited allergen-induced BHR in allergic rabbits when compared to the mismatched control (61%, $p<0.05$; repeated measures $ANOVA_1$ Tukey's t test). A complete lack of effect of the $A_1$MM mismatch control on allergen-induced BHR was observed. The results indicated that anti-sense oligo I (SEQ. ID NO: 1) is effective to protect against aeroallergen-induced bronchoconstriction (house dust mite). In addition, the anti-sense oligo I (SEQ. ID NO:1) was also found to be a potent inhibitor of dust mite-induced bronchial hyper responsiveness, as shown by its effects upon histamine sensitivity which indicates anti-inflammatory activity for anti-sense oligo I (SEQ. ID NO:1).

Example 24
Anti-sense Oligo I is Free of Deleterious Side Effects

The Oligo I (SEQ. ID NO:1) was shown to be free of side effects that might be toxic to the recipient. No changes in arterial blood pressure, cardiac output stroke volume, heart rate, total peripheral resistance or heart Contractility (dPdT) were observed following administration of 2.0 or 20 mg oligo I (SEQ. ID NO:1). The addition, the results of the measurement of cardiac output (CO), stroke volume (SV), mean arterial pressure (MAP), heart rate (HR), total peripheral resistance (TPR), and contractility (dPdT) with a CardiomaxJ apparatus (Columbus Instruments, Ohio) were assessed. These results evidenced that oligo I (SEQ. ID NO:1) has no detrimental effect upon critical cardiovascular parameters. More particularly, this oligo does not cause hypotension. This finding is of particular importance because other phosphorothioate anti-sense oligonucleotides have been shown in the past to induce hypotension in some model systems. Furthermore, the adenosine $A_1$ receptor plays an important role in sinoatrial conduction within the heart. Attenuation of the adenosine $A_1$ receptor by anti-sense oligo I (SEQ. ID NO:1) might be expected to result, therefore, in deleterious extrapulmonary activity in response to the downregulation of the receptor. This is not the case. The anti-sense oligo I (SEQ. ID NO:1) does not produce any deleterious intrapulmonary effects and renders the administration of the low doses of the present anti-sense oligo free of unexpected, undesirable side effects. This demonstrates that when oligo I (SEQ. ID NO: 1) is administered directly to the lung, it does not reach the heart in significant quantities to cause deleterious effects. This is in contrast to traditional adenosine receptor antagonists like theophylline which do escape the lung and can cause deleterious, even life-threatening effects outside the lung.

Example 25
Long Lasting Effect of Oligo I

The Oligo I (SEQ. ID NO:1) evidenced a long lasting effect as evidenced by the $PC_{50}$ and Resistance values obtained upon its administration prior to adenosine challenge. The duration of the effect was measured for with respect to the $PC_{50}$ of adenosine anti-sense oligo I when administered in four equal doses of 5 mg each by means of a nebulizer via an endotracheal tube, as described above. The effect of the agent is significant over days 1 to 8 after administration. When the effect of the anti-sense oligo I (SEQ. ID NO:1) had disappeared, the animals were administered saline aerosols (controls), and the $PC_{50\ Adenosine}$ values for all animals were measured again. Saline-treated animals showed base line $PC_{50}$ adenosine values (n=6). The duration of the effect (with respect to Resistance) was measured for six allergic rabbits which were administered 20 mg of anti-sense oligo I (SEQ. ID NO: 1) as described above, upon airway resistance measured as also described above. The mean calculated duration of effect was 8.3 days for both $PC_{50}$ adenosine ($p<0.05$) and resistance ($p<0.05$). These results show that anti-sense oligo I (SEQ. ID NO:1) has an extremely long duration of action, which is completely unexpected.

Example 26
Anti-sense Oligo II

Anti-sense oligo II, targeted to a different region of the adenosine $A_1$ receptor $mRNA_1$ was found to be highly active against the adenosine $A_1$-mediated effects. The experiment measured the effect of the administration of anti-sense oligo II (SEQ. ID NO:7) upon compliance and resistance values when 20 mg anti-sense oligo II or saline (control) were administered to two groups of allergic rabbits as described above. Compliance and resistance values were measured following an administration of adenosine or saline as described above in Example 13. The effect of the anti-sense oligo of the invention was different from the control in a statistically significant manner, p<0.05 using paired t-test, compliance; p<0.01 for resistance. The results showed that anti-sense oligo II (SEQ. ID NO:7), which targets the adenosine $A_1$ receptor, effectively maintains compliance and reduces resistance upon adenosine challenge.

Example 27
Antisense Oligos III and IV

Oligos III (SEQ. ID NO:8) and IV (SEQ. ID NO:9) were shown to be in fact specifically targeted to the adenosine $A_3$ receptor by their effect on reducing inflammation and the number of inflammatory cells present upon separate administration of 20 mg of the anti-sense oligos III (SEQ. ID NO:8) and IV (SEQ. ID NO:9) to allergic rabbits as described above. The number of inflammatory cells was determined in their bronchial lavage fluid 3 hours later by counting at least 100 viable cells per lavage. The effect of anti-sense oligos III (SEQ. ID NO:8) and IV (SEQ. ID NO:9) upon granulocytes, and upon total cells in bronchial lavage were assessed following exposure to dust mite allergen. The results showed that the anti-sense oligo IV (SEQ. ID NO:9) and anti-sense oligo III (SEQ. ID NO:8) are very potent anti-inflammatory agents in the asthmatic lung following exposure to dust mite allergen. As is known in the art, granulocytes, especially eosinophils, are the primary inflammatory cells of asthma, and the administration of anti-sense oligos III (SEQ. ID NO:8) and IV (SEQ. ID NO:9) reduced their numbers by 40% and 66%, respectively. Furthermore, anti-sense oligos IV (SEQ. ID NO:9) and III (SEQ. ID NO:8) also reduced the total number of cells in the bronchial lavage fluid by 40% and 80%, respectively. This is also an important indicator of anti-inflammatory activity by the present anti-adenosine $A_3$ agents of the invention. Inflammation is known to underlie bronchial hyperresponsiveness and allergen-induced bronchoconstriction in asthma. Both anti-sense oligonucleotides III (SEQ. ID NO:8) and IV (SEQ. ID NO:9), which are targeted to the adenosine $A_3$ receptor, are representative of an important new class of anti-inflammatory agents which may be designed to specifically target the lung receptors of each species.

Example 28
Anti-sense Oligo V

The anti-sense oligo V (SEQ. ID NO:10), targeted to the adenosine $A_{2b}$ adenosine receptor mRNA was shown to be highly effective at countering adenosine $A_{2b}$-mediated effects and at reducing the number of adenosine $A_{2b}$ receptors present to less than half.

Example 29
Unexpected Superiority of Substituted Over Phosphodiester-residue Oligo I-DS (SEQ. ID NO:1681)

Oligos I (SEQ. ID NO:1) and I-DS (SEQ. ID NO:1681) were separately administered to allergic rabbits as described above, and the rabbits were then challenged with adenosine. The phosphodiester oligo I-DS (SEQ. ID NO: 1681) was statistically significantly less effective in countering the effect of adenosine whereas oligo I (SEQ. ID NO:1) showed high effectiveness, evidencing a $PC_{50\ Adenosine}$ of 20 mg.

Example 30
Anti-sense Oligo VI

For the present work, I designed an additional anti-sense phosphorothioate oligo targeted to the adenosine $A_1$ receptor (Oligo VI). This anti-sense oligo was designed for therapy on a selected species as described in the above patent application and is generally specific for that species, unless the segment of the adenosine receptor mRNA of other species elected happens to have a similar sequence. The anti-sense oligos were prepared as described below, and tested in vivo in a rabbit model for bronchoconstriction, inflammation and lung allergy, which have breathing difficulties and impeded lung airways, as is the case in ailments such as asthma, as described in the above-identified application. One additional oligo and its effect in a rabbit model was studied and the results of the study are reported and discussed below. The present oligo (anti-sense oligo VI) was selected for this study to complement the data on SEQ ID NO: 1 (Oligo I), which is anti-sense to the adenosine $A_1$ receptor mRNA provided in the above-identified patent application. This additional oligo is identified as anti-sense Oligo VI, and is targeted to a different region of the adenosine $A_1$ receptor mRNA than Oligo I. The design and synthesis of this anti-sense oligo was performed in accordance with the teaching, particularly Example 1, of the above-identified patent application. The anti-sense Oligo VI is a phosphorothioate designed to target the coding region of the rabbit adenosine $A_1$ receptor mRNA region +964 to +984 relative to the initiation codon (start site). The Oligo VI was prepared as described in the above-indicated application, and is 20 nucleotides long. The Oligo VI is directed to the adenosine $A_1$ receptor gene, and has the following sequence: 5'-CGC CGG CGG GTG CGG GCC GG-3' (SEQ. ID NO:__). The phosphorothioate anti-sense Oligo VI having the sequence described in (5) above, was synthesized on an Applied Biosystems Model 396 Oligonucleotide Synthesizer, and purified using NENSORB chromatography (DuPont, Del.). TETD (tetraethylthiuram disulfide) was used as the sulfurizing agent during the synthesis.

Example 31
Preparation of Allergic Rabbits

Neonatal New Zealand white Pasturella-free rabbits were immunized intraperitoneally within 24 hours of birth with 0.5 ml of 312 antigen units/ml house dust mite (D. farinae) extract (Berkeley Biologicals, Berkeley, Calif.) mixed with 10% kaolin as previously described (Metzger, W. J., in Late Phase Allergic Reactions, Dorsch, W., Ed., CRC Handbook, pp 347–362, CRC Press, Boca Raton, 1990; Ali, S. Et al., Am. J. Resp. Crit. Care Med. 149: 908 (1994)). The immunizations were repeated weekly for the first month and then bi-weekly until the animals were 4 months old. These rabbits preferentially produce allergen-specific IgE antibody, typically respond to aeroallergen challenge with both an early and late-phase asthmatic response, and show bronchial hyper responsiveness (BHR). Monthly intraperitoneal administration of allergen (312 units dust mite allergen, as above) continues to stimulate and maintain allergen-specific IgE antibody and BHR. At 4 months of age, sensitized rabbits were prepared for aerosol administration as described by Ali et al. (1994), supra.

Example 32
Adenosine Aerosol Preparation

An adenosine aerosol (20 mg/ml) was prepared with an ultrasonic nebulizer (Model 646, DeVilbiss, Somerset, Pa.), which produced aerosol droplets, 80% of which were smaller than 5 :m in diameter. Equal volumes of the aerosols were administered directly to the lungs via an intratracheal tube to all three rabbits. The animals were then administered the aerosolized adenosine and Day 1 pre-treatment values for sensitivity to adenosine were calculated as the dose of adenosine causing a 50% loss of compliance ($PC_{50}$ Adenosine). The animals were then administered the aerosolized anti-sense via the intratracheal tube (5 mg/1.0 ml), for 2 minutes, twice daily for 2 days (total dose, 20 mg). Post-treatment $PC_{50}$ values were recorded (post-treatment challenge) on the morning of the third day. The results of these studies are provided in (9) below.

Example 33
Anti-sense Oligo Formulation

Each one of anti-sense oligos were separately solubilized in an aqueous solution and administered as described for anti-sense oligo I in (e) above, in four 5 mg aliquots (20 mg total dose) by means of a nebulizer via endotracheal tube, as described above.

Example 34
Oligo VI Reduces Response to Adenosine Challenge as Well or Better than Oligo I Oligo VI was tested in three allergic rabbits of the characteristics and readied as described in (7) above and in the above-indicated patent application. Oligo VI targets a section of the coding region of the $A_1$ receptor which is different from Oligo I. Both these target sequences were selected randomly from many possible coding region target sequences. The three rabbits were treated identically as previously indicated for Oligo I. Briefly, 5 mg of Oligo VI were nebulized to the rabbits twice per day at 8 hour intervals, for two days. Thereafter, $PC_{50}$ adenosine studies were performed on the morning of the third day and compared to pre-treatment $PC_{50}$ values. This protocol is described in more detail in Nyce and Metzger (Nyce & Metzger, Nature 385: 721–725 (1997)). The results obtained for the three rabbits are shown in Table 7 below.

TABLE 7

$PC_{50}$ Adenosine before & after
Aerosolized Adenosine Treatment

| Treatment Time | $PC_{50}$ Adenosine (mg) |
| --- | --- |
| Pre-treatment | 3.0 ± 2.1 |
| Post-treatment | >20.0* |

*maximum achievable dose due to adenosine insolubility in saline

All three animals treated with Oligo VI completely eliminated sensitivity to adenosine up to the measurable level of the agent shown in Table 7 above. That is, the administration of the Oligo VI abrogated the adenosine-induced bronchoconstriction in the three allergic rabbits. The actual efficacy of Oligo VI is, therefore, greater than could be measured in the experimental system used. By comparing with the previously submitted results for the Oligo I, it may be seen that the Oligo VI was found to be as effective, or more, than Oligo I.

Example 34
Conclusions

The work described and results discussed in the examples clearly indicates that all anti-sense oligonucleotides designed in accordance with the teachings of the above-identified application were found to be highly effective at countering or reducing effects mediated by the receptors they are targeted to. That is, each and all of the two anti-sense oligos targeting an adenosine $A_1$ receptor $mRNA_1$ anti-sense oligo targeting an adenosine $A_{2b}$ receptor $mRNA_1$ and the 2 anti-sense oligos targeting an $A_3$ receptor mRNA were shown capable of countering the effect of exogenously administered adenosine which is mediated by the specific receptor they are targeted to. The activity of the anti-sense oligos of this invention, moreover, is specific to the target and substitutively fails to inhibit another target. In addition, the results presented also show that the administration of the present agents results in extremely low or non-existent deleterious side effects or toxicity. This represents 100% success in providing agents that are highly effective and specific in the treatment of bronchoconstriction and/or inflammation. This invention is broadly applicable in the same manner to all gene(s) and corresponding mRNAs encoding proteins involved in or associated with airway diseases. A comparison of the phosphodiester and a version of the same oligonucleotide wherein the phosphodiester bonds are substituted with phosphorothioate bonds evidenced an unexpected superiority for the phosphothiorate oligonucleotide over the phosphodiester anti-sense oligo.

Example 35
In Vivo Response to Adenosine Challenge With & Without Oligo I Pretreatment Two hyper responsive monkeys (ascaris sensitive) were challenged with inhaled adenosine, with and without pre-treatment with anti-sense oligo I (SEQ.ID NO: 1). The $PC_{40}$ adenosine was calculated from the data collected as being equivalent to that amount of adenosine in mg that causes a 40% decrease in dynamic compliance in hyper-responsive airways. The Oligo I (SEQ. ID NO:1; EPI 2010) was subsequently administered at 10 mg/day for 2 days by inhalation. On the third day, the PC adenosine was again measured. The $PC_{40}$ adenosine value prior to treatment with Oligo I was compared side-by-side with to the $PC_{40}$ adenosine taken after administration of Oligo I (Figure not shown). The results of the experiment conducted with two animals showed that any sensitivity to adenosine was completely eliminated by the administration of the oligo of this invention in one animal, and substantially reduced in the second.

Example 36
Extension of the Experimental Results

The method of the present invention is also practiced with anti-sense oligonucleotides targeted to many genes, mRNAs and their corresponding proteins as described above, in essentially the same manner as given above, for the treatment of various conditions in the lungs. Examples of these are Human A2a adenosine receptor, Human A2b adenosine receptor, Human IgE receptor β, Human Fc-epsilon receptor CD23 antigen (IgE receptor), Human IgE receptor, α subunit, Human IgE receptor, Fc epsilon R, Human histidine decarboxylase, Human beta tryptase, Human tryptase-I, Human prostaglandin D synthase, Human cyclooxygenase-2, Human eosinophil cationic protein, Human eosinophil derived neurotoxin, Human eosinophil peroxidase, Human intercellular adhesion molecule-1 (CAM-1), Human vascular cell adhesion molecule 1 (VCAM-1), Human endothelial leukocyte adhesion molecule (ELAM-1), Human P Selectin, Human endothelial monocyte activating factor, Human IL3, Human IL4, Human IL5, Human IL6, Human monocyte-derived neutrophil chemotactic factor, Human neutrophil elastase (medullasin), Human neutrophil oxidase factor, Human cathepsin G, Human defensin 1, Human defensin 3, Human macrophage inflammatory protein-1-alpha, Human muscarinic acetylcholine receptor HM1, Human muscarinic acetylcholine receptor HM3, Human fibronectin, Human interleukin 8, Human GM-CSF, Human tumor necrosis factor α, Human leukotriene C4 synthase, Human major basic protein, and many more.

The foregoing examples are illustrative of the present invention, and are not to be construed as limiting thereof. The invention is defined by the following claims, with equivalents of the claims to be included therein.

SEQUENCE LISTING (3111 sequences)

SEQ ID NO: 1 - DNA (cDNA), 21 bp; single-stranded, linear
gatggagggcggcatggcggg

SEQ ID NO: 2 - DNA (cDNA), 21 bp; single-stranded, linear
gtagcaggcggggatgggggc

SEQ ID NO: 3 - DNA (cDNA), 18 bp; single-stranded, linear
gttgttgggcatcttgcc

SEQ ID NO: 4 - DNA (cDNA), 18 bp; single-stranded, linear
gtacttgcggatctaggc

SEQ ID NO: 5 - DNA (cDNA), 18 bp; single-stranded, linear
gtgggcctagctctcgcc

SEQ ID NO: 6 - DNA (cDNA), 18 bp; single-stranded, linear
gtcggggtacctgtcggc

SEQ ID NO: 7 - DNA (cDNA), 21 bp; single-stranded, linear
ctcgtcgccgtcgccggcggg

SEQ ID NO: 8 - DNA (cDNA), 20 bp; single-stranded, linear
gggtggtgctattgtcgggc

SEQ ID NO: 9 - DNA (cDNA), 15 bp; single-stranded, linear
ggcccagggccagcc

SEQ ID NO: 10 - DNA (cDNA), 21 bp; single-stranded, linear
ggccgggccagccgggcccgg

SEQ ID NO: 11 - DNA (cDNA), 50 bp; single-stranded, linear
gcggcctggaaagctgagatggagggcggcatggcgggcacaggctgggc

SEQ ID NO: 12 - DNA (cDNA), 49 bp; single-stranded, linear
cggcctggaaagctgagatggagggcggcatggcgggcacaggctgggc

SEQ ID NO: 13 - DNA (cDNA), 48 bp; single-stranded, linear
ggcctggaaagctgagatggagggcggcatggcgggcacaggctgggc

SEQ ID NO: 14 - DNA (cDNA), 47 bp; single-stranded, linear
gcctggaaagctgagatggagggcggcatggcgggcacaggctgggc

SEQ ID NO: 15 - DNA (cDNA), 46 bp; single-stranded, linear
cctggaaagctgagatggagggcggcatggcgggcacaggctgggc

SEQ ID NO: 16 - DNA (cDNA), 45 bp; single-stranded, linear
ctggaaagctgagatggagggcggcatggcgggcacaggctgggc

SEQ ID NO: 17 - DNA (cDNA), 44 bp; single-stranded, linear
tggaaagctgagatggagggcggcatggcgggcacaggctgggc

SEQ ID NO: 18 - DNA (cDNA), 43 bp; single-stranded, linear
ggaaagctgagatggagggcggcatggcgggcacaggctgggc

SEQ ID NO: 19 - DNA (cDNA), 42 bp; single-stranded, linear
gaaagctgagatggagggcggcatggcgggcacaggctgggc

SEQ ID NO: 20 - DNA (cDNA), 41 bp; single-stranded, linear
aaagctgagatggagggcggcatggcgggcacaggctgggc

SEQ ID NO: 21 - DNA (cDNA), 40 bp; single-stranded, linear
aagctgagatggagggcggcatggcgggcacaggctgggc

SEQ ID NO: 22 - DNA (cDNA), 39 bp; single-stranded, linear
agctgagatggagggcggcatggcgggcacaggctgggc

SEQ ID NO: 23 - DNA (cDNA), 38 bp; single-stranded, linear
gctgagatggagggcggcatggcgggcacaggctgggc

SEQ ID NO: 24 - DNA (cDNA), 37 bp; single-stranded, linear
ctgagatggagggcggcatggcgggcacaggctgggc

SEQ ID NO: 25 - DNA (cDNA), 36 bp; single-stranded, linear
tgagatggagggcggcatggcgggcacaggctgggc

SEQ ID NO: 26 - DNA (cDNA), 35 bp; single-stranded, linear
gagatggagggcggcatggcgggcacaggctgggc

SEQ ID NO: 27 - DNA (cDNA), 34 bp; single-stranded, linear
agatggagggcggcatggcgggcacaggctgggc

SEQ ID NO: 28 - DNA (cDNA), 33 bp; single-stranded, linear
gatggagggcggcatggcgggcacaggctgggc

SEQ ID NO: 29 - DNA (cDNA), 32 bp; single-stranded, linear
atggagggcggcatggcgggcacaggctgggc

SEQ ID NO: 30 - DNA (cDNA), 31 bp; single-stranded, linear
tggagggcggcatggcgggcacaggctgggc

SEQ ID NO: 31 - DNA (cDNA), 30 bp; single-stranded, linear
ggagggcggcatggcgggcacaggctgggc

SEQ ID NO: 32 - DNA (cDNA), 29 bp; single-stranded, linear
gagggcggcatggcgggcacaggctgggc

SEQ ID NO: 33 - DNA (cDNA), 28 bp; single-stranded, linear
agggcggcatggcgggcacaggctgggc

SEQ ID NO: 34 - DNA (cDNA), 27 bp; single-stranded, linear
gggcggcatggcgggcacaggctgggc

SEQ ID NO: 35 - DNA (cDNA), 26 bp; single-stranded, linear
ggcggcatggcgggcacaggctgggc

SEQ ID NO: 36 - DNA (cDNA), 25 bp; single-stranded, linear
gcggcatggcgggcacaggctgggc

SEQ ID NO: 37 - DNA (cDNA), 24 bp; single-stranded, linear
cggcatggcgggcacaggctgggc

SEQ ID NO: 38 - DNA (cDNA), 23 bp; single-stranded, linear
ggcatggcgggcacaggctgggc

SEQ ID NO: 39 - DNA (cDNA), 22 bp; single-stranded, linear
gcatggcgggcacaggctgggc

SEQ ID NO: 40 - DNA (cDNA), 21 bp; single-stranded, linear
catggcgggcacaggctgggc

SEQ ID NO: 41 - DNA (cDNA), 20 bp; single-stranded, linear
atggcgggcacaggctgggc

SEQ ID NO: 42 - DNA (cDNA), 19 bp; single-stranded, linear
tggcgggcacaggctgggc

SEQ ID NO: 43 - DNA (cDNA), 18 bp; single-stranded, linear
ggcgggcacaggctgggc

SEQ ID NO: 44 - DNA (cDNA), 17 bp; single-stranded, linear
gcgggcacaggctgggc

SEQ ID NO: 45 - DNA (cDNA), 16 bp; single-stranded, linear
cgggcacaggctgggc

SEQ ID NO: 46 - DNA (cDNA), 15 bp; single-stranded, linear
gggcacaggctgggc

SEQ ID NO: 47 - DNA (cDNA), 14 bp; single-stranded, linear
ggcacaggctgggc

SEQ ID NO: 48 - DNA (cDNA), 13 bp; single-stranded, linear
gcacaggctgggc

SEQ ID NO: 49 - DNA (cDNA), 12 bp; single-stranded, linear
cacaggctgggc

SEQ ID NO: 50 - DNA (cDNA), 11 bp; single-stranded, linear
acaggctgggc

SEQ ID NO: 51 - DNA (cDNA), 10 bp; single-stranded, linear
caggctgggc

SEQ ID NO: 52 - DNA (cDNA), 9 bp; single-stranded, linear
aggctgggc

SEQ ID NO: 53 - DNA (cDNA), 51 bp; single-stranded, linear
ggcggcctggaaagctgagatggagggcggcatggcgggcacaggctgggc

SEQ ID NO: 54 - DNA (cDNA), 50 bp; single-stranded, linear
ggcggcctggaaagctgagatggagggcggcatggcgggcacaggctggg

SEQ ID NO: 55 - DNA (cDNA), 49 bp; single-stranded, linear
ggcggcctggaaagctgagatggagggcggcatggcgggcacaggctgg

SEQ ID NO: 56 - DNA (cDNA), 48 bp; single-stranded, linear
ggcggcctggaaagctgagatggagggcggcatggcgggcacaggctg

SEQ ID NO: 57 - DNA (cDNA), 47 bp; single-stranded, linear
ggcggcctggaaagctgagatggagggcggcatggcgggcacaggct

SEQ ID NO: 58 - DNA (cDNA), 46 bp; single-stranded, linear
ggcggcctggaaagctgagatggagggcggcatggcgggcacaggc

SEQ ID NO: 59 - DNA (cDNA), 45 bp; single-stranded, linear
ggcggcctggaaagctgagatggagggcggcatggcgggcacagg

SEQ ID NO: 60 - DNA (cDNA), 44 bp; single-stranded, linear
ggcggcctggaaagctgagatggagggcggcatggcgggcacag

SEQ ID NO: 61 - DNA (cDNA), 43 bp; single-stranded, linear
ggcggcctggaaagctgagatggagggcggcatggcgggcaca

SEQ ID NO: 62 - DNA (cDNA), 42 bp; single-stranded, linear
ggcggcctggaaagctgagatggagggcggcatggcgggcac

SEQ ID NO: 63 - DNA (cDNA), 41 bp; single-stranded, linear
ggcggcctggaaagctgagatggagggcggcatggcgggca

SEQ ID NO: 64 - DNA (cDNA), 40 bp; single-stranded, linear
ggcggcctggaaagctgagatggagggcggcatggcgggc

SEQ ID NO: 65 - DNA (cDNA), 39 bp; single-stranded, linear
ggcggcctggaaagctgagatggagggcggcatggcggg

SEQ ID NO: 66 - DNA (cDNA), 38 bp; single-stranded, linear
ggcggcctggaaagctgagatggagggcggcatggcgg

SEQ ID NO: 67 - DNA (cDNA), 37 bp; single-stranded, linear
ggcggcctggaaagctgagatggagggcggcatggcg

SEQ ID NO: 68 - DNA (cDNA), 36 bp; single-stranded, linear
ggcggcctggaaagctgagatggagggcggcatggc

SEQ ID NO: 69 - DNA (cDNA), 35 bp; single-stranded, linear
ggcggcctggaaagctgagatggagggcggcatgg

SEQ ID NO: 70 - DNA (cDNA), 34 bp; single-stranded, linear
ggcggcctggaaagctgagatggagggcggcatg

SEQ ID NO: 71 - DNA (cDNA), 33 bp; single-stranded, linear
ggcggcctggaaagctgagatggagggcggcat

SEQ ID NO: 72 - DNA (cDNA), 32 bp; single-stranded, linear
ggcggcctggaaagctgagatggagggcggca

SEQ ID NO: 73 - DNA (cDNA), 31 bp; single-stranded, linear
ggcggcctggaaagctgagatggagggcggc

SEQ ID NO: 74 - DNA (cDNA), 30 bp; single-stranded, linear
ggcggcctggaaagctgagatggagggcgg

SEQ ID NO: 75 - DNA (cDNA), 29 bp; single-stranded, linear
ggcggcctggaaagctgagatggagggcg

SEQ ID NO: 76 - DNA (cDNA), 28 bp; single-stranded, linear
ggcggcctggaaagctgagatggagggc

SEQ ID NO: 77 - DNA (cDNA), 27 bp; single-stranded, linear
ggcggcctggaaagctgagatggaggg

SEQ ID NO: 78 - DNA (cDNA), 26 bp; single-stranded, linear
ggcggcctggaaagctgagatggagg

SEQ ID NO: 79 - DNA (cDNA), 25 bp; single-stranded, linear
ggcggcctggaaagctgagatggag

SEQ ID NO: 80 - DNA (cDNA), 24 bp; single-stranded, linear
ggcggcctggaaagctgagatgga

SEQ ID NO: 81 - DNA (cDNA), 23 bp; single-stranded, linear
ggcggcctggaaagctgagatgg

SEQ ID NO: 82 - DNA (cDNA), 22 bp; single-stranded, linear
ggcggcctggaaagctgagatg

SEQ ID NO: 83 - DNA (cDNA), 21 bp; single-stranded, linear
ggcggcctggaaagctgagat

SEQ ID NO: 84 - DNA (cDNA), 20 bp; single-stranded, linear
ggcggcctggaaagctgaga

SEQ ID NO: 85 - DNA (cDNA), 19 bp; single-stranded, linear
ggcggcctggaaagctgag

SEQ ID NO: 86 - DNA (cDNA), 18 bp; single-stranded, linear
ggcggcctggaaagctga

SEQ ID NO: 87 - DNA (cDNA), 17 bp; single-stranded, linear
ggcggcctggaaagctg

SEQ ID NO: 88 - DNA (cDNA), 16 bp; single-stranded, linear
ggcggcctggaaagct

SEQ ID NO: 89 - DNA (cDNA), 15 bp; single-stranded, linear
ggcggcctggaaagc

SEQ ID NO: 90 - DNA (cDNA), 14 bp; single-stranded, linear
ggcggcctggaaag

SEQ ID NO: 91 - DNA (cDNA), 13 bp; single-stranded, linear
ggcggcctggaaa

SEQ ID NO: 92 - DNA (cDNA), 12 bp; single-stranded, linear
ggcggcctggaa

SEQ ID NO: 93 - DNA (cDNA), 11 bp; single-stranded, linear
ggcggcctgga

SEQ ID NO: 94 - DNA (cDNA), 10 bp; single-stranded, linear
ggcggcctgg

SEQ ID NO: 95 - DNA (cDNA), 50 bp; single-stranded, linear; identical to SEQ ID NO: 11

SEQ ID NO: 96 - DNA (cDNA), 49 bp; single-stranded, linear
gcggcctggaaagctgagatggagggcggcatggcgggcacaggctggg

SEQ ID NO: 97 - DNA (cDNA), 48 bp; single-stranded, linear
gcggcctggaaagctgagatggagggcggcatggcgggcacaggctgg

SEQ ID NO: 98 - DNA (cDNA), 47 bp; single-stranded, linear
gcggcctggaaagctgagatggagggcggcatggcgggcacaggctg

SEQ ID NO: 99 - DNA (cDNA), 46 bp; single-stranded, linear
gcggcctggaaagctgagatggagggcggcatggcgggcacaggct

SEQ ID NO: 100 - DNA (cDNA), 45 bp; single-stranded, linear
gcggcctggaaagctgagatggagggcggcatggcgggcacaggc

SEQ ID NO: 101 - DNA (cDNA), 44 bp; single-stranded, linear
gcggcctggaaagctgagatggagggcggcatggcgggcacagg

SEQ ID NO: 102 - DNA (cDNA), 43 bp; single-stranded, linear
gcggcctggaaagctgagatggagggcggcatggcgggcacag

SEQ ID NO: 103 - DNA (cDNA), 42 bp; single-stranded, linear
gcggcctggaaagctgagatggagggcggcatggcgggcaca

SEQ ID NO: 104 - DNA (cDNA), 41 bp; single-stranded, linear
gcggcctggaaagctgagatggagggcggcatggcgggcac

SEQ ID NO: 105 - DNA (cDNA), 40 bp; single-stranded, linear
gcggcctggaaagctgagatggagggcggcatggcgggca

SEQ ID NO: 106 - DNA (cDNA), 39 bp; single-stranded, linear
gcggcctggaaagctgagatggagggcggcatggcgggc

SEQ ID NO: 107 - DNA (cDNA), 38 bp; single-stranded, linear
gcggcctggaaagctgagatggagggcggcatggcggg

SEQ ID NO: 108 - DNA (cDNA), 37 bp; single-stranded, linear
gcggcctggaaagctgagatggagggcggcatggcgg

SEQ ID NO: 109 - DNA (cDNA), 36 bp; single-stranded, linear
gcggcctggaaagctgagatggagggcggcatggcg

SEQ ID NO: 110 - DNA (cDNA), 35 bp; single-stranded, linear
gcggcctggaaagctgagatggagggcggcatggc

SEQ ID NO: 111 - DNA (cDNA), 34 bp; single-stranded, linear
gcggcctggaaagctgagatggagggcggcatgg

SEQ ID NO: 112 - DNA (cDNA), 33 bp; single-stranded, linear
gcggcctggaaagctgagatggagggcggcatg

SEQ ID NO: 113 - DNA (cDNA), 32 bp; single-stranded, linear
gcggcctggaaagctgagatggagggcggcat

SEQ ID NO: 114 - DNA (cDNA), 31 bp; single-stranded, linear
gcggcctggaaagctgagatggagggcggca

SEQ ID NO: 115 - DNA (cDNA), 30 bp; single-stranded, linear
gcggcctggaaagctgagatggagggcggc

SEQ ID NO: 116 - DNA (cDNA), 29 bp; single-stranded, linear
gcggcctggaaagctgagatggagggcgg

SEQ ID NO: 117 - DNA (cDNA), 28 bp; single-stranded, linear
gcggcctggaaagctgagatggagggcg

SEQ ID NO: 118 - DNA (cDNA), 27 bp; single-stranded, linear
gcggcctggaaagctgagatggagggc

SEQ ID NO: 119 - DNA (cDNA), 26 bp; single-stranded, linear
gcggcctggaaagctgagatggaggg

SEQ ID NO: 120 - DNA (cDNA), 25 bp; single-stranded, linear
gcggcctggaaagctgagatggagg

SEQ ID NO: 121 - DNA (cDNA), 24 bp; single-stranded, linear
gcggcctggaaagctgagatggag

SEQ ID NO: 122 - DNA (cDNA), 23 bp; single-stranded, linear
gcggcctggaaagctgagatgga

SEQ ID NO: 123 - DNA (cDNA), 22 bp; single-stranded, linear
gcggcctggaaagctgagatgg

SEQ ID NO: 124 - DNA (cDNA), 21 bp; single-stranded, linear
gcggcctggaaagctgagatg

SEQ ID NO: 125 - DNA (cDNA), 20 bp; single-stranded, linear
gcggcctggaaagctgagat

SEQ ID NO: 126 - DNA (cDNA), 19 bp; single-stranded, linear
gcggcctggaaagctgaga

SEQ ID NO: 127 - DNA (cDNA), 18 bp; single-stranded, linear
gcggcctggaaagctgag

SEQ ID NO: 128 - DNA (cDNA), 17 bp; single-stranded, linear
gcggcctggaaagctga

SEQ ID NO: 129 - DNA (cDNA), 16 bp; single-stranded, linear
gcggcctggaaagctg

SEQ ID NO: 130 - DNA (cDNA), 15 bp; single-stranded, linear
gcggcctggaaagct

SEQ ID NO: 131 - DNA (cDNA), 14 bp; single-stranded, linear
gcggcctggaaagc

SEQ ID NO: 132 - DNA (cDNA), 13 bp; single-stranded, linear
gcggcctggaaag

SEQ ID NO: 133 - DNA (cDNA), 12 bp; single-stranded, linear
gcggcctggaaa

SEQ ID NO: 134 - DNA (cDNA), 11 bp; single-stranded, linear
gcggcctggaa

SEQ ID NO: 135 - DNA (cDNA), 10 bp; single-stranded, linear
gcggcctgga

SEQ ID NO: 136 - DNA (cDNA), 49 bp; single-stranded, linear; identical to SEQ ID NO: 12

SEQ ID NO: 137 - DNA (cDNA), 48 bp; single-stranded, linear
cggcctggaaagctgagatggagggcggcatggcgggcacaggctggg

SEQ ID NO: 138 - DNA (cDNA), 47 bp; single-stranded, linear
cggcctggaaagctgagatggagggcggcatggcgggcacaggctgg

SEQ ID NO: 139 - DNA (cDNA), 46 bp; single-stranded, linear
cggcctggaaagctgagatggagggcggcatggcgggcacaggctg

SEQ ID NO: 140 - DNA (cDNA), 45 bp; single-stranded, linear
cggcctggaaagctgagatggagggcggcatggcgggcacaggct

SEQ ID NO: 141 - DNA (cDNA), 44 bp; single-stranded, linear
cggcctggaaagctgagatggagggcggcatggcgggcacaggc

SEQ ID NO: 142 - DNA (cDNA), 43 bp; single-stranded, linear
cggcctggaaagctgagatggagggcggcatggcgggcacagg

SEQ ID NO: 143 - DNA (cDNA), 42 bp; single-stranded, linear
cggcctggaaagctgagatggagggcggcatggcgggcacag

SEQ ID NO: 144 - DNA (cDNA), 41 bp; single-stranded, linear
cggcctggaaagctgagatggagggcggcatggcgggcaca

SEQ ID NO: 145 - DNA (cDNA), 40 bp; single-stranded, linear
cggcctggaaagctgagatggagggcggcatggcgggcac

SEQ ID NO: 146 - DNA (cDNA), 39 bp; single-stranded, linear
cggcctggaaagctgagatggagggcggcatggcgggca

SEQ ID NO: 147 - DNA (cDNA), 38 bp; single-stranded, linear
cggcctggaaagctgagatggagggcggcatggcgggc

SEQ ID NO: 148 - DNA (cDNA), 37 bp; single-stranded, linear
cggcctggaaagctgagatggagggcggcatggcggg

SEQ ID NO: 149 - DNA (cDNA), 36 bp; single-stranded, linear
cggcctggaaagctgagatggagggcggcatggcgg

SEQ ID NO: 150 - DNA (cDNA), 35 bp; single-stranded, linear
cggcctggaaagctgagatggagggcggcatggcg

SEQ ID NO: 151 - DNA (cDNA), 34 bp; single-stranded, linear
cggcctggaaagctgagatggagggcggcatggc

SEQ ID NO: 152 - DNA (cDNA), 33 bp; single-stranded, linear
cggcctggaaagctgagatggagggcggcatgg

SEQ ID NO: 153 - DNA (cDNA), 32 bp; single-stranded, linear
cggcctggaaagctgagatggagggcggcatg

SEQ ID NO: 154 - DNA (cDNA), 31 bp; single-stranded, linear
cggcctggaaagctgagatggagggcggcat

SEQ ID NO: 155 - DNA (cDNA), 30 bp; single-stranded, linear
cggcctggaaagctgagatggagggcggca

SEQ ID NO: 156 - DNA (cDNA), 29 bp; single-stranded, linear
cggcctggaaagctgagatggagggcggc

SEQ ID NO: 157 - DNA (cDNA), 28 bp; single-stranded, linear
cggcctggaaagctgagatggagggcgg

SEQ ID NO: 158 - DNA (cDNA), 27 bp; single-stranded, linear
cggcctggaaagctgagatggagggcg

SEQ ID NO: 159 - DNA (cDNA), 26 bp; single-stranded, linear
cggcctggaaagctgagatggagggc

SEQ ID NO: 160 - DNA (cDNA), 25 bp; single-stranded, linear
cggcctggaaagctgagatggaggg

SEQ ID NO: 161 - DNA (cDNA), 24 bp; single-stranded, linear
cggcctggaaagctgagatggagg

SEQ ID NO: 162 - DNA (cDNA), 23 bp; single-stranded, linear
cggcctggaaagctgagatggag

SEQ ID NO: 163 - DNA (cDNA), 22 bp; single-stranded, linear
cggcctggaaagctgagatgga

SEQ ID NO: 164 - DNA (cDNA), 21 bp; single-stranded, linear
cggcctggaaagctgagatgg

SEQ ID NO: 165 - DNA (cDNA), 20 bp; single-stranded, linear
cggcctggaaagctgagatg

SEQ ID NO: 166 - DNA (cDNA), 19 bp; single-stranded, linear
cggcctggaaagctgagat

SEQ ID NO: 167 - DNA (cDNA), 18 bp; single-stranded, linear
cggcctggaaagctgaga

SEQ ID NO: 168 - DNA (cDNA), 17 bp; single-stranded, linear
cggcctggaaagctgag

SEQ ID NO: 169 - DNA (cDNA), 16 bp; single-stranded, linear
cggcctggaaagctga

SEQ ID NO: 170 - DNA (cDNA), 15 bp; single-stranded, linear
cggcctggaaagctg

SEQ ID NO: 171 - DNA (cDNA), 14 bp; single-stranded, linear
cggcctggaaagct

SEQ ID NO: 172 - DNA (cDNA), 13 bp; single-stranded, linear
cggcctggaaagc

SEQ ID NO: 173 - DNA (cDNA), 12 bp; single-stranded, linear
cggcctggaaag

SEQ ID NO: 174 - DNA (cDNA), 11 bp; single-stranded, linear
cggcctggaaa

SEQ ID NO: 175 - DNA (cDNA), 10 bp; single-stranded, linear
cggcctggaa

SEQ ID NO: 176 - DNA (cDNA), 48 bp; single-stranded, linear; identical to SEQ ID NO: 13

SEQ ID NO: 177 - DNA (cDNA), 47 bp; single-stranded, linear
ggcctggaaagctgagatggagggcggcatggcgggcacaggctggg

SEQ ID NO: 178 - DNA (cDNA), 46 bp; single-stranded, linear
ggcctggaaagctgagatggagggcggcatggcgggcacaggctgg

SEQ ID NO: 179 - DNA (cDNA), 45 bp; single-stranded, linear
ggcctggaaagctgagatggagggcggcatggcgggcacaggctg

SEQ ID NO: 180 - DNA (cDNA), 44 bp; single-stranded, linear
ggcctggaaagctgagatggagggcggcatggcgggcacaggct

SEQ ID NO: 181 - DNA (cDNA), 43 bp; single-stranded, linear
ggcctggaaagctgagatggagggcggcatggcgggcacaggc

SEQ ID NO: 182 - DNA (cDNA), 42 bp; single-stranded, linear
ggcctggaaagctgagatggagggcggcatggcgggcacagg

SEQ ID NO: 183 - DNA (cDNA), 41 bp; single-stranded, linear
ggcctggaaagctgagatggagggcggcatggcgggcacag

SEQ ID NO: 184 - DNA (cDNA), 40 bp; single-stranded, linear
ggcctggaaagctgagatggagggcggcatggcgggcaca

SEQ ID NO: 185 - DNA (cDNA), 39 bp; single-stranded, linear
ggcctggaaagctgagatggagggcggcatggcgggcac

SEQ ID NO: 186 - DNA (cDNA), 38 bp; single-stranded, linear
ggcctggaaagctgagatggagggcggcatggcgggca

SEQ ID NO: 187 - DNA (cDNA), 37 bp; single-stranded, linear
ggcctggaaagctgagatggagggcggcatggcgggc

SEQ ID NO: 188 - DNA (cDNA), 36 bp; single-stranded, linear
ggcctggaaagctgagatggagggcggcatggcggg

SEQ ID NO: 189 - DNA (cDNA), 35 bp; single-stranded, linear
ggcctggaaagctgagatggagggcggcatggcgg

SEQ ID NO: 190 - DNA (cDNA), 34 bp; single-stranded, linear
ggcctggaaagctgagatggagggcggcatggcg

SEQ ID NO: 191 - DNA (cDNA), 33 bp; single-stranded, linear
ggcctggaaagctgagatggagggcggcatggc

SEQ ID NO: 192 - DNA (cDNA), 32 bp; single-stranded, linear
ggcctggaaagctgagatggagggcggcatgg

SEQ ID NO: 193 - DNA (cDNA), 31 bp; single-stranded, linear
ggcctggaaagctgagatggagggcggcatg

SEQ ID NO: 194 - DNA (cDNA), 30 bp; single-stranded, linear
ggcctggaaagctgagatggagggcggcat

SEQ ID NO: 195 - DNA (cDNA), 29 bp; single-stranded, linear
ggcctggaaagctgagatggagggcggca

SEQ ID NO: 196 - DNA (cDNA), 28 bp; single-stranded, linear
ggcctggaaagctgagatggagggcggc

SEQ ID NO: 197 - DNA (cDNA), 27 bp; single-stranded, linear
ggcctggaaagctgagatggagggcgg

SEQ ID NO: 198 - DNA (cDNA), 26 bp; single-stranded, linear
ggcctggaaagctgagatggagggcg

SEQ ID NO: 199 - DNA (cDNA), 25 bp; single-stranded, linear
ggcctggaaagctgagatggagggc

SEQ ID NO: 200 - DNA (cDNA), 24 bp; single-stranded, linear
ggcctggaaagctgagatggaggg

SEQ ID NO: 201 - DNA (cDNA), 23 bp; single-stranded, linear
ggcctggaaagctgagatggagg

SEQ ID NO: 202 - DNA (cDNA), 22 bp; single-stranded, linear
ggcctggaaagctgagatggag

SEQ ID NO: 203 - DNA (cDNA), 21 bp; single-stranded, linear
ggcctggaaagctgagatgga

SEQ ID NO: 204 - DNA (cDNA), 20 bp; single-stranded, linear
ggcctggaaagctgagatgg

SEQ ID NO: 205 - DNA (cDNA), 19 bp; single-stranded, linear
ggcctggaaagctgagatg

SEQ ID NO: 206 - DNA (cDNA), 18 bp; single-stranded, linear
ggcctggaaagctgagat

SEQ ID NO: 207 - DNA (cDNA), 17 bp; single-stranded, linear
ggcctggaaagctgaga

SEQ ID NO: 208 - DNA (cDNA), 16 bp; single-stranded, linear
ggcctggaaagctgag

SEQ ID NO: 209 - DNA (cDNA), 15 bp; single-stranded, linear
ggcctggaaagctga

SEQ ID NO: 210 - DNA (cDNA), 14 bp; single-stranded, linear
ggcctggaaagctg

SEQ ID NO: 211 - DNA (cDNA), 13 bp; single-stranded, linear
ggcctggaaagct

SEQ ID NO: 212 - DNA (cDNA), 12 bp; single-stranded, linear
ggcctggaaagc

SEQ ID NO: 213 - DNA (cDNA), 11 bp; single-stranded, linear
ggcctggaaag

SEQ ID NO: 214 - DNA (cDNA), 10 bp; single-stranded, linear
ggcctggaaa

SEQ ID NO: 215 - DNA (cDNA), 47 bp; single-stranded, linear; identical to SEQ ID NO: 14

SEQ ID NO: 216 - DNA (cDNA), 46 bp; single-stranded, linear
gcctggaaagctgagatggagggcggcatggcgggcacaggctggg

SEQ ID NO: 217 - DNA (cDNA), 45 bp; single-stranded, linear
gcctggaaagctgagatggagggcggcatggcgggcacaggctgg

SEQ ID NO: 218 - DNA (cDNA), 44 bp; single-stranded, linear
gcctggaaagctgagatggagggcggcatggcgggcacaggctg

SEQ ID NO: 219 - DNA (cDNA), 43 bp; single-stranded, linear
gcctggaaagctgagatggagggcggcatggcgggcacaggct

SEQ ID NO: 220 - DNA (cDNA), 42 bp; single-stranded, linear
gcctggaaagctgagatggagggcggcatggcgggcacaggc

SEQ ID NO: 221 - DNA (cDNA), 41 bp; single-stranded, linear
gcctggaaagctgagatggagggcggcatggcgggcacagg

SEQ ID NO: 222 - DNA (cDNA), 40 bp; single-stranded, linear
gcctggaaagctgagatggagggcggcatggcgggcacag

SEQ ID NO: 223 - DNA (cDNA), 39 bp; single-stranded, linear
gcctggaaagctgagatggagggcggcatggcgggcaca

SEQ ID NO: 224 - DNA (cDNA), 38 bp; single-stranded, linear
gcctggaaagctgagatggagggcggcatggcgggcac

SEQ ID NO: 225 - DNA (cDNA), 37 bp; single-stranded, linear
gcctggaaagctgagatggagggcggcatggcgggca

SEQ ID NO: 226 - DNA (cDNA), 36 bp; single-stranded, linear
gcctggaaagctgagatggagggcggcatggcgggc

SEQ ID NO: 227 - DNA (cDNA), 35 bp; single-stranded, linear
gcctggaaagctgagatggagggcggcatggcggg

SEQ ID NO: 228 - DNA (cDNA), 34 bp; single-stranded, linear
gcctggaaagctgagatggagggcggcatggcgg

SEQ ID NO: 229 - DNA (cDNA), 33 bp; single-stranded, linear
gcctggaaagctgagatggagggcggcatggcg

SEQ ID NO: 230 - DNA (cDNA), 32 bp; single-stranded, linear
gcctggaaagctgagatggagggcggcatggc

SEQ ID NO: 231 - DNA (cDNA), 31 bp; single-stranded, linear
gcctggaaagctgagatggagggcggcatgg

SEQ ID NO: 232 - DNA (cDNA), 30 bp; single-stranded, linear
gcctggaaagctgagatggagggcggcatg

SEQ ID NO: 233 - DNA (cDNA), 29 bp; single-stranded, linear
gcctggaaagctgagatggagggcggcat

SEQ ID NO: 234 - DNA (cDNA), 28 bp; single-stranded, linear
gcctggaaagctgagatggagggcggca

SEQ ID NO: 235 - DNA (cDNA), 27 bp; single-stranded, linear
gcctggaaagctgagatggagggcggc

SEQ ID NO: 236 - DNA (cDNA), 26 bp; single-stranded, linear
gcctggaaagctgagatggagggcgg

SEQ ID NO: 237 - DNA (cDNA), 25 bp; single-stranded, linear
gcctggaaagctgagatggagggcg

SEQ ID NO: 238 - DNA (cDNA), 24 bp; single-stranded, linear
gcctggaaagctgagatggagggc

SEQ ID NO: 239 - DNA (cDNA), 23 bp; single-stranded, linear
gcctggaaagctgagatggaggg

SEQ ID NO: 240 - DNA (cDNA), 22 bp; single-stranded, linear
gcctggaaagctgagatggagg

SEQ ID NO: 241 - DNA (cDNA), 21 bp; single-stranded, linear
gcctggaaagctgagatggag

SEQ ID NO: 242 - DNA (cDNA), 20 bp; single-stranded, linear
gcctggaaagctgagatgga

SEQ ID NO: 243 - DNA (cDNA), 19 bp; single-stranded, linear
gcctggaaagctgagatgg

SEQ ID NO: 244 - DNA (cDNA), 18 bp; single-stranded, linear
gcctggaaagctgagatg

SEQ ID NO: 245 - DNA (cDNA), 17 bp; single-stranded, linear
gcctggaaagctgagat

SEQ ID NO: 246 - DNA (cDNA), 16 bp; single-stranded, linear
gcctggaaagctgaga

SEQ ID NO: 247 - DNA (cDNA), 15 bp; single-stranded, linear
gcctggaaagctgag

SEQ ID NO: 248 - DNA (cDNA), 14 bp; single-stranded, linear
gcctggaaagctga

SEQ ID NO: 249 - DNA (cDNA), 13 bp; single-stranded, linear
gcctggaaagctg

SEQ ID NO: 250 - DNA (cDNA), 12 bp; single-stranded, linear
gcctggaaagct

SEQ ID NO: 251 - DNA (cDNA), 11 bp; single-stranded, linear
gcctggaaagc

SEQ ID NO: 252 - DNA (cDNA), 10 bp; single-stranded, linear
gcctggaaag

SEQ ID NO: 253 - DNA (cDNA), 46 bp; single-stranded, linear; identical to SEQ ID NO: 15

SEQ ID NO: 254 - DNA (cDNA), 45 bp; single-stranded, linear
cctggaaagctgagatggagggcggcatggcgggcacaggctggg

SEQ ID NO: 255 - DNA (cDNA), 44 bp; single-stranded, linear
cctggaaagctgagatggagggcggcatggcgggcacaggctgg

SEQ ID NO: 256 - DNA (cDNA), 43 bp; single-stranded, linear
cctggaaagctgagatggagggcggcatggcgggcacaggctg

SEQ ID NO: 257 - DNA (cDNA), 42 bp; single-stranded, linear
cctggaaagctgagatggagggcggcatggcgggcacaggct

SEQ ID NO: 258 - DNA (cDNA), 41 bp; single-stranded, linear
cctggaaagctgagatggagggcggcatggcgggcacaggc

SEQ ID NO: 259 - DNA (cDNA), 40 bp; single-stranded, linear
cctggaaagctgagatggagggcggcatggcgggcacagg

SEQ ID NO: 260 - DNA (cDNA), 39 bp; single-stranded, linear
cctggaaagctgagatggagggcggcatggcgggcacag

SEQ ID NO: 261 - DNA (cDNA), 38 bp; single-stranded, linear
cctggaaagctgagatggagggcggcatggcgggcaca

SEQ ID NO: 262 - DNA (cDNA), 37 bp; single-stranded, linear
cctggaaagctgagatggagggcggcatggcgggcac

SEQ ID NO: 263 - DNA (cDNA), 36 bp; single-stranded, linear
cctggaaagctgagatggagggcggcatggcgggca

SEQ ID NO: 264 - DNA (cDNA), 35 bp; single-stranded, linear
cctggaaagctgagatggagggcggcatggcgggc

SEQ ID NO: 265 - DNA (cDNA), 34 bp; single-stranded, linear
cctggaaagctgagatggagggcggcatggcggg

SEQ ID NO: 266 - DNA (cDNA), 33 bp; single-stranded, linear
cctggaaagctgagatggagggcggcatggcgg

SEQ ID NO: 267 - DNA (cDNA), 32 bp; single-stranded, linear
cctggaaagctgagatggagggcggcatggcg

SEQ ID NO: 268 - DNA (cDNA), 31 bp; single-stranded, linear
cctggaaagctgagatggagggcggcatggc

SEQ ID NO: 269 - DNA (cDNA), 30 bp; single-stranded, linear
cctggaaagctgagatggagggcggcatgg

SEQ ID NO: 270 - DNA (cDNA), 29 bp; single-stranded, linear
cctggaaagctgagatggagggcggcatg

SEQ ID NO: 271 - DNA (cDNA), 28 bp; single-stranded, linear
cctggaaagctgagatggagggcggcat

SEQ ID NO: 272 - DNA (cDNA), 27 bp; single-stranded, linear
cctggaaagctgagatggagggcggca

SEQ ID NO: 273 - DNA (cDNA), 26 bp; single-stranded, linear
cctggaaagctgagatggagggcggc

SEQ ID NO: 274 - DNA (cDNA), 25 bp; single-stranded, linear
cctggaaagctgagatggagggcgg

SEQ ID NO: 275 - DNA (cDNA), 24 bp; single-stranded, linear
cctggaaagctgagatggagggcg

SEQ ID NO: 276 - DNA (cDNA), 23 bp; single-stranded, linear
cctggaaagctgagatggagggc

SEQ ID NO: 277 - DNA (cDNA), 22 bp; single-stranded, linear
cctggaaagctgagatggaggg

SEQ ID NO: 278 - DNA (cDNA), 21 bp; single-stranded, linear
cctggaaagctgagatggagg

SEQ ID NO: 279 - DNA (cDNA), 20 bp; single-stranded, linear
cctggaaagctgagatggag

SEQ ID NO: 280 - DNA (cDNA), 19 bp; single-stranded, linear
cctggaaagctgagatgga

SEQ ID NO: 281 - DNA (cDNA), 18 bp; single-stranded, linear
cctggaaagctgagatgg

SEQ ID NO: 282 - DNA (cDNA), 17 bp; single-stranded, linear
cctggaaagctgagatg

SEQ ID NO: 283 - DNA (cDNA), 16 bp; single-stranded, linear
cctggaaagctgagat

SEQ ID NO: 284 - DNA (cDNA), 15 bp; single-stranded, linear
cctggaaagctgaga

SEQ ID NO: 285 - DNA (cDNA), 14 bp; single-stranded, linear
cctggaaagctgag

SEQ ID NO: 286 - DNA (cDNA), 13 bp; single-stranded, linear
cctggaaagctga

SEQ ID NO: 287 - DNA (cDNA), 12 bp; single-stranded, linear
cctggaaagctg

SEQ ID NO: 288 - DNA (cDNA), 11 bp; single-stranded, linear
cctggaaagct

SEQ ID NO: 289 - DNA (cDNA), 10 bp; single-stranded, linear
cctggaaagc

SEQ ID NO: 290 - DNA (cDNA), 45 bp; single-stranded, linear; identical to SEQ ID NO: 16

SEQ ID NO: 291 - DNA (cDNA), 44 bp; single-stranded, linear
ctggaaagctgagatggagggcggcatggcgggcacaggctggg

SEQ ID NO: 292 - DNA (cDNA), 43 bp; single-stranded, linear
ctggaaagctgagatggagggcggcatggcgggcacaggctgg

SEQ ID NO: 293 - DNA (cDNA), 42 bp; single-stranded, linear
ctggaaagctgagatggagggcggcatggcgggcacaggctg

SEQ ID NO: 294 - DNA (cDNA), 41 bp; single-stranded, linear
ctggaaagctgagatggagggcggcatggcgggcacaggct

SEQ ID NO: 295 - DNA (cDNA), 40 bp; single-stranded, linear
ctggaaagctgagatggagggcggcatggcgggcacaggc

SEQ ID NO: 296 - DNA (cDNA), 39 bp; single-stranded, linear
ctggaaagctgagatggagggcggcatggcgggcacagg

SEQ ID NO: 297 - DNA (cDNA), 38 bp; single-stranded, linear
ctggaaagctgagatggagggcggcatggcgggcacag

SEQ ID NO: 298 - DNA (cDNA), 37 bp; single-stranded, linear
ctggaaagctgagatggagggcggcatggcgggcaca

SEQ ID NO: 299 - DNA (cDNA), 36 bp; single-stranded, linear
ctggaaagctgagatggagggcggcatggcgggcac

SEQ ID NO: 300 - DNA (cDNA), 35 bp; single-stranded, linear
ctggaaagctgagatggagggcggcatggcgggca

SEQ ID NO: 301 - DNA, 34 bp; single-stranded, linear
ctggaaagctgagatggagggcggcatggcgggc

SEQ ID NO: 302 - DNA, 33 bp; single-stranded, linear
ctggaaagctgagatggagggcggcatggcggg

SEQ ID NO: 303 - DNA, 32 bp; single-stranded, linear
ctggaaagctgagatggagggcggcatggcgg

SEQ ID NO: 304 - DNA, 31 bp; single-stranded, linear
ctggaaagctgagatggagggcggcatggcg

SEQ ID NO: 305 - DNA, 30 bp; single-stranded, linear
ctggaaagctgagatggagggcggcatggc

SEQ ID NO: 306 - DNA, 29 bp; single-stranded, linear
ctggaaagctgagatggagggcggcatgg

SEQ ID NO: 307 - DNA, 28 bp; single-stranded, linear
ctggaaagctgagatggagggcggcatg

SEQ ID NO: 308 - DNA, 27 bp; single-stranded, linear
ctggaaagctgagatggagggcggcat

SEQ ID NO: 309 - DNA, 26 bp; single-stranded, linear
ctggaaagctgagatggagggcggca

SEQ ID NO: 310 - DNA, 25 bp; single-stranded, linear
ctggaaagctgagatggagggcggc

SEQ ID NO: 311 - DNA, 24 bp; single-stranded, linear
ctggaaagctgagatggagggcgg

SEQ ID NO: 312 - DNA, 23 bp; single-stranded, linear
ctggaaagctgagatggagggcg

SEQ ID NO: 313 - DNA, 22 bp; single-stranded, linear
ctggaaagctgagatggagggc

SEQ ID NO: 314 - DNA, 21 bp; single-stranded, linear
ctggaaagctgagatggaggg

SEQ ID NO: 315 - DNA, 20 bp; single-stranded, linear
ctggaaagctgagatggagg

SEQ ID NO: 316 - DNA, 19 bp; single-stranded, linear
ctggaaagctgagatggag

SEQ ID NO: 317 - DNA, 18 bp; single-stranded, linear
ctggaaagctgagatgga

SEQ ID NO: 318 - DNA, 17 bp; single-stranded, linear
ctggaaagctgagatgg

SEQ ID NO: 319 - DNA, 16 bp; single-stranded, linear
ctggaaagctgagatg

SEQ ID NO: 320 - DNA, 15 bp; single-stranded, linear
ctggaaagctgagat

SEQ ID NO: 321 - DNA, 14 bp; single-stranded, linear
ctggaaagctgaga

SEQ ID NO: 322 - DNA, 13 bp; single-stranded, linear
ctggaaagctgag

SEQ ID NO: 323 - DNA, 12 bp; single-stranded, linear
ctggaaagctga

SEQ ID NO: 324 - DNA, 11 bp; single-stranded, linear
ctggaaagctg

SEQ ID NO: 325 - DNA, 10 bp; single-stranded, linear
ctggaaagct

SEQ ID NO: 326 - DNA, 44 bp; single-stranded, linear; identical to SEQ ID NO: 17

SEQ ID NO: 327 - DNA, 43 bp; single-stranded, linear
tggaaagctgagatggagggcggcatggcgggcacaggctggg

SEQ ID NO: 328 - DNA, 42 bp; single-stranded, linear
tggaaagctgagatggagggcggcatggcgggcacaggctgg

SEQ ID NO: 329 - DNA, 41 bp; single-stranded, linear
tggaaagctgagatggagggcggcatggcgggcacaggctg

SEQ ID NO: 330 - DNA, 40 bp; single-stranded, linear
tggaaagctgagatggagggcggcatggcgggcacaggct

SEQ ID NO: 331 - DNA, 39 bp; single-stranded, linear
tggaaagctgagatggagggcggcatggcgggcacaggc

SEQ ID NO: 332 - DNA, 38 bp; single-stranded, linear
tggaaagctgagatggagggcggcatggcgggcacagg

SEQ ID NO: 333 - DNA, 37 bp; single-stranded, linear
tggaaagctgagatggagggcggcatggcgggcacag

SEQ ID NO: 334 - DNA, 36 bp; single-stranded, linear
tggaaagctgagatggagggcggcatggcgggcaca

SEQ ID NO: 335 - DNA, 35 bp; single-stranded, linear
tggaaagctgagatggagggcggcatggcgggcac

SEQ ID NO: 336 - DNA, 34 bp; single-stranded, linear
tggaaagctgagatggagggcggcatggcgggca

SEQ ID NO: 337 - DNA, 33 bp; single-stranded, linear
tggaaagctgagatggagggcggcatggcgggc

SEQ ID NO: 338 - DNA, 32 bp; single-stranded, linear
tggaaagctgagatggagggcggcatggcggg

SEQ ID NO: 339 - DNA, 31 bp; single-stranded, linear
tggaaagctgagatggagggcggcatggcgg

SEQ ID NO: 340 - DNA, 30 bp; single-stranded, linear
tggaaagctgagatggagggcggcatggcg

SEQ ID NO: 341 - DNA, 29 bp; single-stranded, linear
tggaaagctgagatggagggcggcatggc

SEQ ID NO: 342 - DNA, 28 bp; single-stranded, linear
tggaaagctgagatggagggcggcatgg

SEQ ID NO: 343 - DNA, 27 bp; single-stranded, linear
tggaaagctgagatggagggcggcatg

SEQ ID NO: 344 - DNA, 26 bp; single-stranded, linear
tggaaagctgagatggagggcggcat

SEQ ID NO: 345 - DNA, 25 bp; single-stranded, linear
tggaaagctgagatggagggcggca

SEQ ID NO: 346 - DNA, 24 bp; single-stranded, linear
tggaaagctgagatggagggcggc

SEQ ID NO: 347 - DNA, 23 bp; single-stranded, linear
tggaaagctgagatggagggcgg

SEQ ID NO: 348 - DNA, 22 bp; single-stranded, linear
tggaaagctgagatggagggcg

SEQ ID NO: 349 - DNA, 21 bp; single-stranded, linear
tggaaagctgagatggagggc

SEQ ID NO: 350 - DNA, 20 bp; single-stranded, linear
tggaaagctgagatggaggg

SEQ ID NO: 351 - DNA, 19 bp; single-stranded, linear
tggaaagctgagatggagg

SEQ ID NO: 352 - DNA, 18 bp; single-stranded, linear
tggaaagctgagatggag

SEQ ID NO: 353 - DNA, 17 bp; single-stranded, linear
tggaaagctgagatgga

SEQ ID NO: 354 - DNA, 16 bp; single-stranded, linear
tggaaagctgagatgg

SEQ ID NO: 355 - DNA, 15 bp; single-stranded, linear
tggaaagctgagatg

SEQ ID NO: 356 - DNA, 14 bp; single-stranded, linear
tggaaagctgagat

SEQ ID NO: 357 - DNA, 13 bp; single-stranded, linear
tggaaagctgaga

SEQ ID NO: 358 - DNA, 12 bp; single-stranded, linear
tggaaagctgag

SEQ ID NO: 359 - DNA, 11 bp; single-stranded, linear
tggaaagctga

SEQ ID NO: 360 - DNA, 10 bp; single-stranded, linear
tggaaagctg

SEQ ID NO: 361 - DNA, 43 bp; single-stranded, linear; identical to SEQ ID NO: 18

SEQ ID NO: 362 - DNA, 42 bp; single-stranded, linear
ggaaagctgagatggagggcggcatggcgggcacaggctggg

SEQ ID NO: 363 - DNA, 41 bp; single-stranded, linear
ggaaagctgagatggagggcggcatggcgggcacaggctgg

SEQ ID NO: 364 - DNA, 40 bp; single-stranded, linear
ggaaagctgagatggagggcggcatggcgggcacaggctg

SEQ ID NO: 365 - DNA, 39 bp; single-stranded, linear
ggaaagctgagatggagggcggcatggcgggcacaggct

SEQ ID NO: 366 - DNA, 38 bp; single-stranded, linear
ggaaagctgagatggagggcggcatggcgggcacaggc

SEQ ID NO: 367 - DNA, 37 bp; single-stranded, linear
ggaaagctgagatggagggcggcatggcgggcacagg

SEQ ID NO: 368 - DNA, 36 bp; single-stranded, linear
ggaaagctgagatggagggcggcatggcgggcacag

SEQ ID NO: 369 - DNA, 35 bp; single-stranded, linear
ggaaagctgagatggagggcggcatggcgggcaca

SEQ ID NO: 370 - DNA, 34 bp; single-stranded, linear
ggaaagctgagatggagggcggcatggcgggcac

SEQ ID NO: 371 - DNA, 33 bp; single-stranded, linear
ggaaagctgagatggagggcggcatggcgggca

SEQ ID NO: 372 - DNA, 32 bp; single-stranded, linear
ggaaagctgagatggagggcggcatggcgggc

SEQ ID NO: 373 - DNA, 31 bp; single-stranded, linear
ggaaagctgagatggagggcggcatggcggg

SEQ ID NO: 374 - DNA, 30 bp; single-stranded, linear
ggaaagctgagatggagggcggcatggcgg

SEQ ID NO: 375 - DNA, 29 bp; single-stranded, linear
ggaaagctgagatggagggcggcatggcg

SEQ ID NO: 376 - DNA, 28 bp; single-stranded, linear
ggaaagctgagatggagggcggcatggc

SEQ ID NO: 377 - DNA, 27 bp; single-stranded, linear
ggaaagctgagatggagggcggcatgg

SEQ ID NO: 378 - DNA, 26 bp; single-stranded, linear
ggaaagctgagatggagggcggcatg

SEQ ID NO: 379 - DNA, 25 bp; single-stranded, linear
ggaaagctgagatggagggcggcat

SEQ ID NO: 380 - DNA, 24 bp; single-stranded, linear
ggaaagctgagatggagggcggca

SEQ ID NO: 381 - DNA, 23 bp; single-stranded, linear
ggaaagctgagatggagggcggc

SEQ ID NO: 382 - DNA, 22 bp; single-stranded, linear
ggaaagctgagatggagggcgg

SEQ ID NO: 383 - DNA, 21 bp; single-stranded, linear
ggaaagctgagatggagggcg

SEQ ID NO: 384 - DNA, 20 bp; single-stranded, linear
ggaaagctgagatggagggc

SEQ ID NO: 385 - DNA, 19 bp; single-stranded, linear
ggaaagctgagatggaggg

SEQ ID NO: 386 - DNA, 18 bp; single-stranded, linear
ggaaagctgagatggagg

SEQ ID NO: 387 - DNA, 17 bp; single-stranded, linear
ggaaagctgagatggag

SEQ ID NO: 388 - DNA, 16 bp; single-stranded, linear
ggaaagctgagatgga

SEQ ID NO: 389 - DNA, 15 bp; single-stranded, linear
ggaaagctgagatgg

SEQ ID NO: 390 - DNA, 14 bp; single-stranded, linear
ggaaagctgagatg

SEQ ID NO: 391 - DNA, 13 bp; single-stranded, linear
ggaaagctgagat

SEQ ID NO: 392 - DNA, 12 bp; single-stranded, linear
ggaaagctgaga

SEQ ID NO: 393 - DNA, 11 bp; single-stranded, linear
ggaaagctgag

SEQ ID NO: 394 - DNA, 10 bp; single-stranded, linear
ggaaagctga

SEQ ID NO: 395 - DNA, 42 bp; single-stranded, linear; identical to SEQ ID NO: 19

SEQ ID NO: 396 - DNA, 41 bp; single-stranded, linear
gaaagctgagatggagggcggcatggcgggcacaggctggg

SEQ ID NO: 397 - DNA, 40 bp; single-stranded, linear
gaaagctgagatggagggcggcatggcgggcacaggctgg

SEQ ID NO: 398 - DNA, 39 bp; single-stranded, linear
gaaagctgagatggagggcggcatggcgggcacaggctg

SEQ ID NO: 399 - DNA, 38 bp; single-stranded, linear
gaaagctgagatggagggcggcatggcgggcacaggct

SEQ ID NO: 400 - DNA, 37 bp; single-stranded, linear
gaaagctgagatggagggcggcatggcgggcacaggc

SEQ ID NO: 401 - DNA, 36 bp; single-stranded, linear
gaaagctgagatggagggcggcatggcgggcacagg

SEQ ID NO: 402 - DNA, 35 bp; single-stranded, linear
gaaagctgagatggagggcggcatggcgggcacag

SEQ ID NO: 403 - DNA, 34 bp; single-stranded, linear
gaaagctgagatggagggcggcatggcgggcaca

SEQ ID NO: 404 - DNA, 33 bp; single-stranded, linear
gaaagctgagatggagggcggcatggcgggcac

SEQ ID NO: 405 - DNA, 32 bp; single-stranded, linear
gaaagctgagatggagggcggcatggcgggca

SEQ ID NO: 406 - DNA, 31 bp; single-stranded, linear
gaaagctgagatggagggcggcatggcgggc

SEQ ID NO: 407 - DNA, 30 bp; single-stranded, linear
gaaagctgagatggagggcggcatggcggg

SEQ ID NO: 408 - DNA, 29 bp; single-stranded, linear
gaaagctgagatggagggcggcatggcgg

SEQ ID NO: 409 - DNA, 28 bp; single-stranded, linear
gaaagctgagatggagggcggcatggcg

SEQ ID NO: 410 - DNA, 27 bp; single-stranded, linear
gaaagctgagatggagggcggcatggc

SEQ ID NO: 411 - DNA, 26 bp; single-stranded, linear
gaaagctgagatggagggcggcatgg

SEQ ID NO: 412 - DNA, 25 bp; single-stranded, linear
gaaagctgagatggagggcggcatg

SEQ ID NO: 413 - DNA, 24 bp; single-stranded, linear
gaaagctgagatggagggcggcat

SEQ ID NO: 414 - DNA, 23 bp; single-stranded, linear
gaaagctgagatggagggcggca

SEQ ID NO: 415 - DNA, 22 bp; single-stranded, linear
gaaagctgagatggagggcggc

SEQ ID NO: 416 - DNA, 21 bp; single-stranded, linear
gaaagctgagatggagggcgg

SEQ ID NO: 417 - DNA, 20 bp; single-stranded, linear
gaaagctgagatggagggcg

SEQ ID NO: 418 - DNA, 19 bp; single-stranded, linear
gaaagctgagatggagggc

SEQ ID NO: 419 - DNA, 18 bp; single-stranded, linear
gaaagctgagatggaggg

SEQ ID NO: 420 - DNA, 17 bp; single-stranded, linear
gaaagctgagatggagg

SEQ ID NO: 421 - DNA, 16 bp; single-stranded, linear
gaaagctgagatggag

SEQ ID NO: 422 - DNA, 15 bp; single-stranded, linear
gaaagctgagatgga

SEQ ID NO: 423 - DNA, 14 bp; single-stranded, linear
gaaagctgagatgg

SEQ ID NO: 424 - DNA, 13 bp; single-stranded, linear
gaaagctgagatg

SEQ ID NO: 425 - DNA, 12 bp; single-stranded, linear
gaaagctgagat

SEQ ID NO: 426 - DNA, 11 bp; single-stranded, linear
gaaagctgaga

SEQ ID NO: 427 - DNA, 10 bp; single-stranded, linear
gaaagctgag

SEQ ID NO: 428 - DNA, 41 bp; single-stranded, linear; identical to SEQ ID NO: 20

SEQ ID NO: 429 - DNA, 40 bp; single-stranded, linear
aaagctgagatggagggcggcatggcgggcacaggctggg

SEQ ID NO: 430 - DNA, 39 bp; single-stranded, linear
aaagctgagatggagggcggcatggcgggcacaggctgg

SEQ ID NO: 431 - DNA, 38 bp; single-stranded, linear
aaagctgagatggagggcggcatggcgggcacaggctg

SEQ ID NO: 432 - DNA, 37 bp; single-stranded, linear
aaagctgagatggagggcggcatggcgggcacaggct

SEQ ID NO: 433 - DNA, 36 bp; single-stranded, linear
aaagctgagatggagggcggcatggcgggcacaggc

SEQ ID NO: 434 - DNA, 35 bp; single-stranded, linear
aaagctgagatggagggcggcatggcgggcacagg

SEQ ID NO: 435 - DNA, 34 bp; single-stranded, linear
aaagctgagatggagggcggcatggcgggcacag

SEQ ID NO: 436 - DNA, 33 bp; single-stranded, linear
aaagctgagatggagggcggcatggcgggcaca

SEQ ID NO: 437 - DNA, 32 bp; single-stranded, linear
aaagctgagatggagggcggcatggcgggcac

SEQ ID NO: 438 - DNA, 31 bp; single-stranded, linear
aaagctgagatggagggcggcatggcgggca

SEQ ID NO: 439 - DNA, 30 bp; single-stranded, linear
aaagctgagatggagggcggcatggcgggc

SEQ ID NO: 440 - DNA, 29 bp; single-stranded, linear
aaagctgagatggagggcggcatggcggg

SEQ ID NO: 441 - DNA, 28 bp; single-stranded, linear
aaagctgagatggagggcggcatggcgg

SEQ ID NO: 442 - DNA, 27 bp; single-stranded, linear
aaagctgagatggagggcggcatggcg

SEQ ID NO: 443 - DNA, 26 bp; single-stranded, linear
aaagctgagatggagggcggcatggc

SEQ ID NO: 444 - DNA, 25 bp; single-stranded, linear
aaagctgagatggagggcggcatgg

SEQ ID NO: 445 - DNA, 24 bp; single-stranded, linear
aaagctgagatggagggcggcatg

SEQ ID NO: 446 - DNA, 23 bp; single-stranded, linear
aaagctgagatggagggcggcat

SEQ ID NO: 447 - DNA, 22 bp; single-stranded, linear
aaagctgagatggagggcggca

SEQ ID NO: 448 - DNA, 21 bp; single-stranded, linear
aaagctgagatggagggcggc

SEQ ID NO: 449 - DNA, 20 bp; single-stranded, linear
aaagctgagatggagggcgg

SEQ ID NO: 450 - DNA, 19 bp; single-stranded, linear
aaagctgagatggagggcg

SEQ ID NO: 451 - DNA, 18 bp; single-stranded, linear
aaagctgagatggagggc

SEQ ID NO: 452 - DNA, 17 bp; single-stranded, linear
aaagctgagatggaggg

SEQ ID NO: 453 - DNA, 16 bp; single-stranded, linear
aaagctgagatggagg

SEQ ID NO: 454 - DNA, 15 bp; single-stranded, linear
aaagctgagatggag

SEQ ID NO: 455 - DNA, 14 bp; single-stranded, linear
aaagctgagatgga

SEQ ID NO: 456 - DNA, 13 bp; single-stranded, linear
aaagctgagatgg

SEQ ID NO: 457 - DNA, 12 bp; single-stranded, linear
aaagctgagatg

SEQ ID NO: 458 - DNA, 11 bp; single-stranded, linear
aaagctgagat

SEQ ID NO: 459 - DNA, 10 bp; single-stranded, linear
aaagctgaga

SEQ ID NO: 460 - DNA, 40 bp; single-stranded, linear; identical to SEQ ID NO: 21

SEQ ID NO: 461 - DNA, 39 bp; single-stranded, linear
aagctgagatggagggcggcatggcgggcacaggctggg

SEQ ID NO: 462 - DNA, 38 bp; single-stranded, linear
aagctgagatggagggcggcatggcgggcacaggctgg

SEQ ID NO: 463 - DNA, 37 bp; single-stranded, linear
aagctgagatggagggcggcatggcgggcacaggctg

SEQ ID NO: 464 - DNA, 36 bp; single-stranded, linear
aagctgagatggagggcggcatggcgggcacaggct

SEQ ID NO: 465 - DNA, 35 bp; single-stranded, linear
aagctgagatggagggcggcatggcgggcacaggc

SEQ ID NO: 466 - DNA, 34 bp; single-stranded, linear
aagctgagatggagggcggcatggcgggcacagg

SEQ ID NO: 467 - DNA, 33 bp; single-stranded, linear
aagctgagatggagggcggcatggcgggcacag

SEQ ID NO: 468 - DNA, 32 bp; single-stranded, linear
aagctgagatggagggcggcatggcgggcaca

SEQ ID NO: 469 - DNA, 31 bp; single-stranded, linear
aagctgagatggagggcggcatggcgggcac

SEQ ID NO: 470 - DNA, 30 bp; single-stranded, linear
aagctgagatggagggcggcatggcgggca

SEQ ID NO: 471 - DNA, 29 bp; single-stranded, linear
aagctgagatggagggcggcatggcgggc

SEQ ID NO: 472 - DNA, 28 bp; single-stranded, linear
aagctgagatggagggcggcatggcggg

SEQ ID NO: 473 - DNA, 27 bp; single-stranded, linear
aagctgagatggagggcggcatggcgg

SEQ ID NO: 474 - DNA, 26 bp; single-stranded, linear
aagctgagatggagggcggcatggcg

SEQ ID NO: 475 - DNA, 25 bp; single-stranded, linear
aagctgagatggagggcggcatggc

SEQ ID NO: 476 - DNA, 24 bp; single-stranded, linear
aagctgagatggagggcggcatgg

SEQ ID NO: 477 - DNA, 23 bp; single-stranded, linear
aagctgagatggagggcggcatg

SEQ ID NO: 478 - DNA, 22 bp; single-stranded, linear
aagctgagatggagggcggcat

SEQ ID NO: 479 - DNA, 21 bp; single-stranded, linear
aagctgagatggagggcggca

SEQ ID NO: 480 - DNA, 20 bp; single-stranded, linear
aagctgagatggagggcggc

SEQ ID NO: 481 - DNA, 19 bp; single-stranded, linear
aagctgagatggagggcgg

SEQ ID NO: 482 - DNA, 18 bp; single-stranded, linear
aagctgagatggagggcg

SEQ ID NO: 483 - DNA, 17 bp; single-stranded, linear
aagctgagatggagggc

SEQ ID NO: 484 - DNA, 16 bp; single-stranded, linear
aagctgagatggaggg

SEQ ID NO: 485 - DNA, 15 bp; single-stranded, linear
aagctgagatggagg

SEQ ID NO: 486 - DNA, 14 bp; single-stranded, linear
aagctgagatggag

SEQ ID NO: 487 - DNA, 13 bp; single-stranded, linear
aagctgagatgga

SEQ ID NO: 488 - DNA, 12 bp; single-stranded, linear
aagctgagatgg

SEQ ID NO: 489 - DNA, 11 bp; single-stranded, linear
aagctgagatg

SEQ ID NO: 490 - DNA, 10 bp; single-stranded, linear
aagctgagat

SEQ ID NO: 491 - DNA, 39 bp; single-stranded, linear; identical to SEQ ID NO: 22

SEQ ID NO: 492 - DNA, 38 bp; single-stranded, linear
agctgagatggagggcggcatggcgggcacaggctggg

SEQ ID NO: 493 - DNA, 37 bp; single-stranded, linear
agctgagatggagggcggcatggcgggcacaggctgg

SEQ ID NO: 494 - DNA, 36 bp; single-stranded, linear
agctgagatggagggcggcatggcgggcacaggctg

SEQ ID NO: 495 - DNA, 35 bp; single-stranded, linear
agctgagatggagggcggcatggcgggcacaggct

SEQ ID NO: 496 - DNA, 34 bp; single-stranded, linear
agctgagatggagggcggcatggcgggcacaggc

SEQ ID NO: 497 - DNA, 33 bp; single-stranded, linear
agctgagatggagggcggcatggcgggcacagg

SEQ ID NO: 498 - DNA, 32 bp; single-stranded, linear
agctgagatggagggcggcatggcgggcacag

SEQ ID NO: 499 - DNA, 31 bp; single-stranded, linear
agctgagatggagggcggcatggcgggcaca

SEQ ID NO: 500 - DNA, 30 bp; single-stranded, linear
agctgagatggagggcggcatggcgggcac

SEQ ID NO: 501 - DNA, 29 bp; single-stranded, linear
agctgagatggagggcggcatggcgggca

SEQ ID NO: 502 - DNA, 28 bp; single-stranded, linear
agctgagatggagggcggcatggcgggc

SEQ ID NO: 503 - DNA, 27 bp; single-stranded, linear
agctgagatggagggcggcatggcggg

SEQ ID NO: 504 - DNA, 26 bp; single-stranded, linear
agctgagatggagggcggcatggcgg

SEQ ID NO: 505 - DNA, 25 bp; single-stranded, linear
agctgagatggagggcggcatggcg

SEQ ID NO: 506 - DNA, 24 bp; single-stranded, linear
agctgagatggagggcggcatggc

SEQ ID NO: 507 - DNA, 23 bp; single-stranded, linear
agctgagatggagggcggcatgg

SEQ ID NO: 508 - DNA, 22 bp; single-stranded, linear
agctgagatggagggcggcatg

SEQ ID NO: 509 - DNA, 21 bp; single-stranded, linear
agctgagatggagggcggcat

SEQ ID NO: 510 - DNA, 20 bp; single-stranded, linear
agctgagatggagggcggca

SEQ ID NO: 511 - DNA, 19 bp; single-stranded, linear
agctgagatggagggcggc

SEQ ID NO: 512 - DNA, 18 bp; single-stranded, linear
agctgagatggagggcgg

SEQ ID NO: 513 - DNA, 17 bp; single-stranded, linear
agctgagatggagggcg

SEQ ID NO: 514 - DNA, 16 bp; single-stranded, linear
agctgagatggagggc

SEQ ID NO: 515 - DNA, 15 bp; single-stranded, linear
agctgagatggaggg

SEQ ID NO: 516 - DNA, 14 bp; single-stranded, linear
agctgagatggagg

SEQ ID NO: 517 - DNA, 13 bp; single-stranded, linear
agctgagatggag

SEQ ID NO: 518 - DNA, 12 bp; single-stranded, linear
agctgagatgga

SEQ ID NO: 519 - DNA, 11 bp; single-stranded, linear
agctgagatgg

SEQ ID NO: 520 - DNA, 10 bp; single-stranded, linear
agctgagatg

SEQ ID NO: 521 - DNA, 38 bp; single-stranded, linear; identical to SEQ ID NO: 23

SEQ ID NO: 522 - DNA, 37 bp; single-stranded, linear
gctgagatggagggcggcatggcgggcacaggctggg

SEQ ID NO: 523 - DNA, 36 bp; single-stranded, linear
gctgagatggagggcggcatggcgggcacaggctgg

SEQ ID NO: 524 - DNA, 35 bp; single-stranded, linear
gctgagatggagggcggcatggcgggcacaggctg

SEQ ID NO: 525 - DNA, 34 bp; single-stranded, linear
gctgagatggagggcggcatggcgggcacaggct

SEQ ID NO: 526 - DNA, 33 bp; single-stranded, linear
gctgagatggagggcggcatggcgggcacaggc

SEQ ID NO: 527 - DNA, 32 bp; single-stranded, linear
gctgagatggagggcggcatggcgggcacagg

SEQ ID NO: 528 - DNA, 31 bp; single-stranded, linear
gctgagatggagggcggcatggcgggcacag

SEQ ID NO: 529 - DNA, 30 bp; single-stranded, linear
gctgagatggagggcggcatggcgggcaca

SEQ ID NO: 530 - DNA, 29 bp; single-stranded, linear
gctgagatggagggcggcatggcgggcac

SEQ ID NO: 531 - DNA, 28 bp; single-stranded, linear
gctgagatggagggcggcatggcgggca

SEQ ID NO: 532 - DNA, 27 bp; single-stranded, linear
gctgagatggagggcggcatggcgggc

SEQ ID NO: 533 - DNA, 26 bp; single-stranded, linear
gctgagatggagggcggcatggcggg

SEQ ID NO: 534 - DNA, 25 bp; single-stranded, linear
gctgagatggagggcggcatggcgg

SEQ ID NO: 535 - DNA, 24 bp; single-stranded, linear
gctgagatggagggcggcatggcg

SEQ ID NO: 536 - DNA, 23 bp; single-stranded, linear
gctgagatggagggcggcatggc

SEQ ID NO: 537 - DNA, 22 bp; single-stranded, linear
gctgagatggagggcggcatgg

SEQ ID NO: 538 - DNA, 21 bp; single-stranded, linear
gctgagatggagggcggcatg

SEQ ID NO: 539 - DNA, 20 bp; single-stranded, linear
gctgagatggagggcggcat

SEQ ID NO: 540 - DNA, 19 bp; single-stranded, linear
gctgagatggagggcggca

SEQ ID NO: 541 - DNA, 18 bp; single-stranded, linear
gctgagatggagggcggc

SEQ ID NO: 542 - DNA, 17 bp; single-stranded, linear
gctgagatggagggcgg

SEQ ID NO: 543 - DNA, 16 bp; single-stranded, linear
gctgagatggagggcg

SEQ ID NO: 544 - DNA, 15 bp; single-stranded, linear
gctgagatggagggc

SEQ ID NO: 545 - DNA, 14 bp; single-stranded, linear
gctgagatggaggg

SEQ ID NO: 546 - DNA, 13 bp; single-stranded, linear
gctgagatggagg

SEQ ID NO: 547 - DNA, 12 bp; single-stranded, linear
gctgagatggag

SEQ ID NO: 548 - DNA, 11 bp; single-stranded, linear
gctgagatgga

SEQ ID NO: 549 - DNA, 10 bp; single-stranded, linear
gctgagatgg

SEQ ID NO: 550 - DNA, 37 bp; single-stranded, linear; identical to SEQ ID NO: 24

SEQ ID NO: 551 - DNA, 36 bp; single-stranded, linear
ctgagatggagggcggcatggcgggcacaggctggg

SEQ ID NO: 552 - DNA, 35 bp; single-stranded, linear
ctgagatggagggcggcatggcgggcacaggctgg

SEQ ID NO: 553 - DNA, 34 bp; single-stranded, linear
ctgagatggagggcggcatggcgggcacaggctg

SEQ ID NO: 554 - DNA, 33 bp; single-stranded, linear
ctgagatggagggcggcatggcgggcacaggct

SEQ ID NO: 555 - DNA, 32 bp; single-stranded, linear
ctgagatggagggcggcatggcgggcacaggc

SEQ ID NO: 556 - DNA, 31 bp; single-stranded, linear
ctgagatggagggcggcatggcgggcacagg

SEQ ID NO: 557 - DNA, 30 bp; single-stranded, linear
ctgagatggagggcggcatggcgggcacag

SEQ ID NO: 558 - DNA, 29 bp; single-stranded, linear
ctgagatggagggcggcatggcgggcaca

SEQ ID NO: 559 - DNA, 28 bp; single-stranded, linear
ctgagatggagggcggcatggcgggcac

SEQ ID NO: 560 - DNA, 27 bp; single-stranded, linear
ctgagatggagggcggcatggcgggca

SEQ ID NO: 561 - DNA, 26 bp; single-stranded, linear
ctgagatggagggcggcatggcgggc

SEQ ID NO: 562 - DNA, 25 bp; single-stranded, linear
ctgagatggagggcggcatggcggg

SEQ ID NO: 563 - DNA, 24 bp; single-stranded, linear
ctgagatggagggcggcatggcgg

SEQ ID NO: 564 - DNA, 23 bp; single-stranded, linear
ctgagatggagggcggcatggcg

SEQ ID NO: 565 - DNA, 22 bp; single-stranded, linear
ctgagatggagggcggcatggc

SEQ ID NO: 566 - DNA, 21 bp; single-stranded, linear
ctgagatggagggcggcatgg

SEQ ID NO: 567 - DNA, 20 bp; single-stranded, linear
ctgagatggagggcggcatg

SEQ ID NO: 568 - DNA, 19 bp; single-stranded, linear
ctgagatggagggcggcat

SEQ ID NO: 569 - DNA, 18 bp; single-stranded, linear
ctgagatggagggcggca

SEQ ID NO: 570 - DNA, 17 bp; single-stranded, linear
ctgagatggagggcggc

SEQ ID NO: 571 - DNA, 16 bp; single-stranded, linear
ctgagatggagggcgg

SEQ ID NO: 572 - DNA, 15 bp; single-stranded, linear
ctgagatggagggcg

SEQ ID NO: 573 - DNA, 14 bp; single-stranded, linear
ctgagatggagggc

SEQ ID NO: 574 - DNA, 13 bp; single-stranded, linear
ctgagatggaggg

SEQ ID NO: 575 - DNA, 12 bp; single-stranded, linear
ctgagatggagg

SEQ ID NO: 576 - DNA, 11 bp; single-stranded, linear
ctgagatggag

SEQ ID NO: 577 - DNA, 10 bp; single-stranded, linear
ctgagatgga

SEQ ID NO: 578 - DNA, 36 bp; single-stranded, linear; identical to SEQ ID NO: 25

SEQ ID NO: 579 - DNA, 35 bp; single-stranded, linear
tgagatggagggcggcatggcgggcacaggctggg

SEQ ID NO: 580 - DNA, 34 bp; single-stranded, linear
tgagatggagggcggcatggcgggcacaggctgg

SEQ ID NO: 581 - DNA, 33 bp; single-stranded, linear
tgagatggagggcggcatggcgggcacaggctg

SEQ ID NO: 582 - DNA, 32 bp; single-stranded, linear
tgagatggagggcggcatggcgggcacaggct

SEQ ID NO: 583 - DNA, 31 bp; single-stranded, linear
tgagatggagggcggcatggcgggcacaggc

SEQ ID NO: 584 - DNA, 30 bp; single-stranded, linear
tgagatggagggcggcatggcgggcacagg

SEQ ID NO: 585 - DNA, 29 bp; single-stranded, linear
tgagatggagggcggcatggcgggcacag

SEQ ID NO: 586 - DNA, 28 bp; single-stranded, linear
tgagatggagggcggcatggcgggcaca

SEQ ID NO: 587 - DNA, 27 bp; single-stranded, linear
tgagatggagggcggcatggcgggcac

SEQ ID NO: 588 - DNA, 26 bp; single-stranded, linear
tgagatggagggcggcatggcgggca

SEQ ID NO: 589 - DNA, 25 bp; single-stranded, linear
tgagatggagggcggcatggcgggc

SEQ ID NO: 590 - DNA, 24 bp; single-stranded, linear
tgagatggagggcggcatggcggg

SEQ ID NO: 591 - DNA, 23 bp; single-stranded, linear
tgagatggagggcggcatggcgg

SEQ ID NO: 592 - DNA, 22 bp; single-stranded, linear
tgagatggagggcggcatggcg

SEQ ID NO: 593 - DNA, 21 bp; single-stranded, linear
tgagatggagggcggcatggc

SEQ ID NO: 594 - DNA, 20 bp; single-stranded, linear
tgagatggagggcggcatgg

SEQ ID NO: 595 - DNA, 19 bp; single-stranded, linear
tgagatggagggcggcatg

SEQ ID NO: 596 - DNA, 18 bp; single-stranded, linear
tgagatggagggcggcat

SEQ ID NO: 597 - DNA, 17 bp; single-stranded, linear
tgagatggagggcggca

SEQ ID NO: 598 - DNA, 16 bp; single-stranded, linear
tgagatggagggcggc

SEQ ID NO: 599 - DNA, 15 bp; single-stranded, linear
tgagatggagggcgg

SEQ ID NO: 600 - DNA, 14 bp; single-stranded, linear
tgagatggagggcg

SEQ ID NO: 601 - DNA, 13 bp; single-stranded, linear
tgagatggagggc

SEQ ID NO: 602 - DNA, 12 bp; single-stranded, linear
tgagatggaggg

SEQ ID NO: 603 - DNA, 11 bp; single-stranded, linear
tgagatggagg

SEQ ID NO: 604 - DNA, 10 bp; single-stranded, linear
tgagatggag

SEQ ID NO: 605 - DNA, 35 bp; single-stranded, linear; identical to SEQ ID NO: 26

SEQ ID NO: 606 - DNA, 34 bp; single-stranded, linear
gagatggagggcggcatggcgggcacaggctggg

SEQ ID NO: 607 - DNA, 33 bp; single-stranded, linear
gagatggagggcggcatggcgggcacaggctgg

SEQ ID NO: 608 - DNA, 32 bp; single-stranded, linear
gagatggagggcggcatggcgggcacaggctg

SEQ ID NO: 609 - DNA, 31 bp; single-stranded, linear
gagatggagggcggcatggcgggcacaggct

SEQ ID NO: 610 - DNA, 30 bp; single-stranded, linear
gagatggagggcggcatggcgggcacaggc

SEQ ID NO: 611 - DNA, 29 bp; single-stranded, linear
gagatggagggcggcatggcgggcacagg

SEQ ID NO: 612 - DNA, 28 bp; single-stranded, linear
gagatggagggcggcatggcgggcacag

SEQ ID NO: 613 - DNA, 27 bp; single-stranded, linear
gagatggagggcggcatggcgggcaca

SEQ ID NO: 614 - DNA, 26 bp; single-stranded, linear
gagatggagggcggcatggcgggcac

SEQ ID NO: 615 - DNA, 25 bp; single-stranded, linear
gagatggagggcggcatggcgggca

SEQ ID NO: 616 - DNA, 24 bp; single-stranded, linear
gagatggagggcggcatggcgggc

SEQ ID NO: 617 - DNA, 23 bp; single-stranded, linear
gagatggagggcggcatggcggg

SEQ ID NO: 618 - DNA, 22 bp; single-stranded, linear
gagatggagggcggcatggcgg

SEQ ID NO: 619 - DNA, 21 bp; single-stranded, linear
gagatggagggcggcatggcg

SEQ ID NO: 620 - DNA, 20 bp; single-stranded, linear
gagatggagggcggcatggc

SEQ ID NO: 621 - DNA, 19 bp; single-stranded, linear
gagatggagggcggcatgg

SEQ ID NO: 622 - DNA, 18 bp; single-stranded, linear
gagatggagggcggcatg

SEQ ID NO: 623 - DNA, 17 bp; single-stranded, linear
gagatggagggcggcat

SEQ ID NO: 624 - DNA, 16 bp; single-stranded, linear
gagatggagggcggca

SEQ ID NO: 625 - DNA, 15 bp; single-stranded, linear
gagatggagggcggc

SEQ ID NO: 626 - DNA, 14 bp; single-stranded, linear
gagatggagggcgg

SEQ ID NO: 627 - DNA, 13 bp; single-stranded, linear
gagatggagggcg

SEQ ID NO: 628 - DNA, 12 bp; single-stranded, linear
gagatggagggc

SEQ ID NO: 629 - DNA, 11 bp; single-stranded, linear
gagatggaggg

SEQ ID NO: 630 - DNA, 10 bp; single-stranded, linear
gagatggagg

SEQ ID NO: 631 - DNA, 34 bp; single-stranded, linear; identical to SEQ ID NO: 27

SEQ ID NO: 632 - DNA, 33 bp; single-stranded, linear
agatggagggcggcatggcgggcacaggctggg

SEQ ID NO: 633 - DNA, 32 bp; single-stranded, linear
agatggagggcggcatggcgggcacaggctgg

SEQ ID NO: 634 - DNA, 31 bp; single-stranded, linear
agatggagggcggcatggcgggcacaggctg

SEQ ID NO: 635 - DNA, 30 bp; single-stranded, linear
agatggagggcggcatggcgggcacaggct

SEQ ID NO: 636 - DNA, 29 bp; single-stranded, linear
agatggagggcggcatggcgggcacaggc

SEQ ID NO: 637 - DNA, 28 bp; single-stranded, linear
agatggagggcggcatggcgggcacagg

SEQ ID NO: 638 - DNA, 27 bp; single-stranded, linear
agatggagggcggcatggcgggcacag

SEQ ID NO: 639 - DNA, 26 bp; single-stranded, linear
agatggagggcggcatggcgggcaca

SEQ ID NO: 640 - DNA, 25 bp; single-stranded, linear
agatggagggcggcatggcgggcac

SEQ ID NO: 641 - DNA, 24 bp; single-stranded, linear
agatggagggcggcatggcgggca

SEQ ID NO: 642 - DNA, 23 bp; single-stranded, linear
agatggagggcggcatggcgggc

SEQ ID NO: 643 - DNA, 22 bp; single-stranded, linear
agatggagggcggcatggcggg

SEQ ID NO: 644 - DNA, 21 bp; single-stranded, linear
agatggagggcggcatggcgg

SEQ ID NO: 645 - DNA, 20 bp; single-stranded, linear
agatggagggcggcatggcg

SEQ ID NO: 646 - DNA, 19 bp; single-stranded, linear
agatggagggcggcatggc

SEQ ID NO: 647 - DNA, 18 bp; single-stranded, linear
agatggagggcggcatgg

SEQ ID NO: 648 - DNA, 17 bp; single-stranded, linear
agatggagggcggcatg

SEQ ID NO: 649 - DNA, 16 bp; single-stranded, linear
agatggagggcggcat

SEQ ID NO: 650 - DNA, 15 bp; single-stranded, linear
agatggagggcggca

SEQ ID NO: 651 - DNA, 14 bp; single-stranded, linear
agatggagggcggc

SEQ ID NO: 652 - DNA, 13 bp; single-stranded, linear
agatggagggcgg

SEQ ID NO: 653 - DNA, 12 bp; single-stranded, linear
agatggagggcg

SEQ ID NO: 654 - DNA, 11 bp; single-stranded, linear
agatggagggc

SEQ ID NO: 655 - DNA, 10 bp; single-stranded, linear
agatggaggg

SEQ ID NO: 656 - DNA, 33 bp; single-stranded, linear; identical to SEQ ID NO: 28

SEQ ID NO: 657 - DNA, 32 bp; single-stranded, linear
gatggagggcggcatggcgggcacaggctggg

SEQ ID NO: 658 - DNA, 31 bp; single-stranded, linear
gatggagggcggcatggcgggcacaggctgg

SEQ ID NO: 659 - DNA, 30 bp; single-stranded, linear
gatggagggcggcatggcgggcacaggctg

SEQ ID NO: 660 - DNA, 29 bp; single-stranded, linear
gatggagggcggcatggcgggcacaggct

SEQ ID NO: 661 - DNA, 28 bp; single-stranded, linear
gatggagggcggcatggcgggcacaggc

SEQ ID NO: 662 - DNA, 27 bp; single-stranded, linear
gatggagggcggcatggcgggcacagg

SEQ ID NO: 663 - DNA, 26 bp; single-stranded, linear
gatggagggcggcatggcgggcacag

SEQ ID NO: 664 - DNA, 25 bp; single-stranded, linear
gatggagggcggcatggcgggcaca

SEQ ID NO: 665 - DNA, 24 bp; single-stranded, linear
gatggagggcggcatggcgggcac

SEQ ID NO: 666 - DNA, 23 bp; single-stranded, linear
gatggagggcggcatggcgggca

SEQ ID NO: 667 - DNA, 22 bp; single-stranded, linear
gatggagggcggcatggcgggc

SEQ ID NO: 668 - DNA, 21 bp; single-stranded, linear
gatggagggcggcatggcggg

SEQ ID NO: 669 - DNA, 20 bp; single-stranded, linear
gatggagggcggcatggcgg

SEQ ID NO: 670 - DNA, 19 bp; single-stranded, linear
gatggagggcggcatggcg

SEQ ID NO: 671 - DNA, 18 bp; single-stranded, linear
gatggagggcggcatggc

SEQ ID NO: 672 - DNA, 17 bp; single-stranded, linear
gatggagggcggcatgg

SEQ ID NO: 673 - DNA, 16 bp; single-stranded, linear
gatggagggcggcatg

SEQ ID NO: 674 - DNA, 15 bp; single-stranded, linear
gatggagggcggcat

SEQ ID NO: 675 - DNA, 14 bp; single-stranded, linear
gatggagggcggca

SEQ ID NO: 676 - DNA, 13 bp; single-stranded, linear
gatggagggcggc

SEQ ID NO: 677 - DNA, 12 bp; single-stranded, linear
gatggagggcgg

SEQ ID NO: 678 - DNA, 11 bp; single-stranded, linear
gatggagggcg

SEQ ID NO: 679 - DNA, 10 bp; single-stranded, linear
gatggagggc

SEQ ID NO: 680 - DNA, 32 bp; single-stranded, linear; identical to SEQ ID NO: 29

SEQ ID NO: 681 - DNA, 31 bp; single-stranded, linear
atggagggcggcatggcgggcacaggctggg

SEQ ID NO: 682 - DNA, 30 bp; single-stranded, linear
atggagggcggcatggcgggcacaggctgg

SEQ ID NO: 683 - DNA, 29 bp; single-stranded, linear
atggagggcggcatggcgggcacaggctg

SEQ ID NO: 684 - DNA, 28 bp; single-stranded, linear
atggagggcggcatggcgggcacaggct

SEQ ID NO: 685 - DNA, 27 bp; single-stranded, linear
atggagggcggcatggcgggcacaggc

SEQ ID NO: 686 - DNA, 26 bp; single-stranded, linear
atggagggcggcatggcgggcacagg

SEQ ID NO: 687 - DNA, 25 bp; single-stranded, linear
atggagggcggcatggcgggcacag

SEQ ID NO: 688 - DNA, 24 bp; single-stranded, linear
atggagggcggcatggcgggcaca

SEQ ID NO: 689 - DNA, 23 bp; single-stranded, linear
atggagggcggcatggcgggcac

SEQ ID NO: 690 - DNA, 22 bp; single-stranded, linear
atggagggcggcatggcgggca

SEQ ID NO: 691 - DNA, 21 bp; single-stranded, linear
atggagggcggcatggcgggc

SEQ ID NO: 692 - DNA, 20 bp; single-stranded, linear
atggagggcggcatggcggg

SEQ ID NO: 693 - DNA, 19 bp; single-stranded, linear
atggagggcggcatggcgg

SEQ ID NO: 694 - DNA, 18 bp; single-stranded, linear
atggagggcggcatggcg

SEQ ID NO: 695 - DNA, 17 bp; single-stranded, linear
atggagggcggcatggc

SEQ ID NO: 696 - DNA, 16 bp; single-stranded, linear
atggagggcggcatgg

SEQ ID NO: 697 - DNA, 15 bp; single-stranded, linear
atggagggcggcatg

SEQ ID NO: 698 - DNA, 14 bp; single-stranded, linear
atggagggcggcat

SEQ ID NO: 699 - DNA, 13 bp; single-stranded, linear
atggagggcggca

SEQ ID NO: 700 - DNA, 12 bp; single-stranded, linear
atggagggcggc

SEQ ID NO: 701 - DNA, 11 bp; single-stranded, linear
atggagggcgg

SEQ ID NO: 702 - DNA, 10 bp; single-stranded, linear
atggagggcg

SEQ ID NO: 703 - DNA, 31 bp; single-stranded, linear; identical to SEQ ID NO: 30

SEQ ID NO: 704 - DNA, 30 bp; single-stranded, linear
tggagggcggcatggcgggcacaggctggg

SEQ ID NO: 705 - DNA, 29 bp; single-stranded, linear
tggagggcggcatggcgggcacaggctgg

SEQ ID NO: 706 - DNA, 28 bp; single-stranded, linear
tggagggcggcatggcgggcacaggctg

SEQ ID NO: 707 - DNA, 27 bp; single-stranded, linear
tggagggcggcatggcgggcacaggct

SEQ ID NO: 708 - DNA, 26 bp; single-stranded, linear
tggagggcggcatggcgggcacaggc

SEQ ID NO: 709 - DNA, 25 bp; single-stranded, linear
tggagggcggcatggcgggcacagg

SEQ ID NO: 710 - DNA, 24 bp; single-stranded, linear
tggagggcggcatggcgggcacag

SEQ ID NO: 711 - DNA, 23 bp; single-stranded, linear
tggagggcggcatggcgggcaca

SEQ ID NO: 712 - DNA, 22 bp; single-stranded, linear
tggagggcggcatggcgggcac

SEQ ID NO: 713 - DNA, 21 bp; single-stranded, linear
tggagggcggcatggcgggca

SEQ ID NO: 714 - DNA, 20 bp; single-stranded, linear
tggagggcggcatggcgggc

SEQ ID NO: 715 - DNA, 19 bp; single-stranded, linear
tggagggcggcatggcggg

SEQ ID NO: 716 - DNA, 18 bp; single-stranded, linear
tggagggcggcatggcgg

SEQ ID NO: 717 - DNA, 17 bp; single-stranded, linear
tggagggcggcatggcg

SEQ ID NO: 718 - DNA, 16 bp; single-stranded, linear
tggagggcggcatggc

SEQ ID NO: 719 - DNA, 15 bp; single-stranded, linear
tggagggcggcatgg

SEQ ID NO: 720 - DNA, 14 bp; single-stranded, linear
tggagggcggcatg

SEQ ID NO: 721 - DNA, 13 bp; single-stranded, linear
tggagggcggcat

SEQ ID NO: 722 - DNA, 12 bp; single-stranded, linear
tggagggcggca

SEQ ID NO: 723 - DNA, 11 bp; single-stranded, linear
tggagggcggc

SEQ ID NO: 724 - DNA, 10 bp; single-stranded, linear
tggagggcgg

SEQ ID NO: 725 - DNA, 30 bp; single-stranded, linear; identical to SEQ ID NO: 31

SEQ ID NO: 726 - DNA, 29 bp; single-stranded, linear
ggagggcggcatggcgggcacaggctggg

SEQ ID NO: 727 - DNA, 28 bp; single-stranded, linear
ggagggcggcatggcgggcacaggctgg

SEQ ID NO: 728 - DNA, 27 bp; single-stranded, linear
ggagggcggcatggcgggcacaggctg

SEQ ID NO: 729 - DNA, 26 bp; single-stranded, linear
ggagggcggcatggcgggcacaggct

SEQ ID NO: 730 - DNA, 25 bp; single-stranded, linear
ggagggcggcatggcgggcacaggc

SEQ ID NO: 731 - DNA, 24 bp; single-stranded, linear
ggagggcggcatggcgggcacagg

SEQ ID NO: 732 - DNA, 23 bp; single-stranded, linear
ggagggcggcatggcgggcacag

SEQ ID NO: 733 - DNA, 22 bp; single-stranded, linear
ggagggcggcatggcgggcaca

SEQ ID NO: 734 - DNA, 21 bp; single-stranded, linear
ggagggcggcatggcgggcac

SEQ ID NO: 735 - DNA, 20 bp; single-stranded, linear
ggagggcggcatggcgggca

SEQ ID NO: 736 - DNA, 19 bp; single-stranded, linear
ggagggcggcatggcgggc

SEQ ID NO: 737 - DNA, 18 bp; single-stranded, linear
ggagggcggcatggcggg

SEQ ID NO: 738 - DNA, 17 bp; single-stranded, linear
ggagggcggcatggcgg

SEQ ID NO: 739 - DNA, 16 bp; single-stranded, linear
ggagggcggcatggcg

SEQ ID NO: 740 - DNA, 15 bp; single-stranded, linear
ggagggcggcatggc

SEQ ID NO: 741 - DNA, 14 bp; single-stranded, linear
ggagggcggcatgg

SEQ ID NO: 742 - DNA, 13 bp; single-stranded, linear
ggagggcggcatg

SEQ ID NO: 743 - DNA, 12 bp; single-stranded, linear
ggagggcggcat

SEQ ID NO: 744 - DNA, 11 bp; single-stranded, linear
ggagggcggca

SEQ ID NO: 745 - DNA, 10 bp; single-stranded, linear
ggagggcggc

SEQ ID NO: 746 - DNA, 29 bp; single-stranded, linear
gagggcggcatggcgggcacaggctgggc

SEQ ID NO: 747 - DNA, 28 bp; single-stranded, linear
gagggcggcatggcgggcacaggctggg

SEQ ID NO: 748 - DNA, 27 bp; single-stranded, linear
gagggcggcatggcgggcacaggctgg

SEQ ID NO: 749 - DNA, 26 bp; single-stranded, linear
gagggcggcatggcgggcacaggctg

SEQ ID NO: 750 - DNA, 25 bp; single-stranded, linear
gagggcggcatggcgggcacaggct

SEQ ID NO: 751 - DNA, 24 bp; single-stranded, linear
gagggcggcatggcgggcacaggc

SEQ ID NO: 752 - DNA, 23 bp; single-stranded, linear
gagggcggcatggcgggcacagg

SEQ ID NO: 753 - DNA, 22 bp; single-stranded, linear
gagggcggcatggcgggcacag

SEQ ID NO: 754 - DNA, 21 bp; single-stranded, linear
gagggcggcatggcgggcaca

SEQ ID NO: 755 - DNA, 20 bp; single-stranded, linear
gagggcggcatggcgggcac

SEQ ID NO: 756 - DNA, 19 bp; single-stranded, linear
gagggcggcatggcgggca

SEQ ID NO: 757 - DNA, 18 bp; single-stranded, linear
gagggcggcatggcgggc

SEQ ID NO: 758 - DNA, 17 bp; single-stranded, linear
gagggcggcatggcggg

SEQ ID NO: 759 - DNA, 16 bp; single-stranded, linear
gagggcggcatggcgg

SEQ ID NO: 760 - DNA, 15 bp; single-stranded, linear
gagggcggcatggcg

SEQ ID NO: 761 - DNA, 14 bp; single-stranded, linear
gagggcggcatggc

SEQ ID NO: 762 - DNA, 13 bp; single-stranded, linear
gagggcggcatgg

SEQ ID NO: 763 - DNA, 12 bp; single-stranded, linear
gagggcggcatg

SEQ ID NO: 764 - DNA, 11 bp; single-stranded, linear
gagggcggcat

SEQ ID NO: 765 - DNA, 10 bp; single-stranded, linear
gagggcggca

SEQ ID NO: 766 - DNA, 28 bp; single-stranded, linear
agggcggcatggcgggcacaggctgggc

SEQ ID NO: 767 - DNA, 27 bp; single-stranded, linear
agggcggcatggcgggcacaggctggg

SEQ ID NO: 768 - DNA, 26 bp; single-stranded, linear
agggcggcatggcgggcacaggctgg

SEQ ID NO: 769 - DNA, 25 bp; single-stranded, linear
agggcggcatggcgggcacaggctg

SEQ ID NO: 770 - DNA, 24 bp; single-stranded, linear
agggcggcatggcgggcacaggct

SEQ ID NO: 771 - DNA, 23 bp; single-stranded, linear
agggcggcatggcgggcacaggc

SEQ ID NO: 772 - DNA, 22 bp; single-stranded, linear
agggcggcatggcgggcacagg

SEQ ID NO: 773 - DNA, 21 bp; single-stranded, linear
agggcggcatggcgggcacag

SEQ ID NO: 774 - DNA, 20 bp; single-stranded, linear
agggcggcatggcgggcaca

SEQ ID NO: 775 - DNA, 19 bp; single-stranded, linear
agggcggcatggcgggcac

SEQ ID NO: 776 - DNA, 18 bp; single-stranded, linear
agggcggcatggcgggca

SEQ ID NO: 777 - DNA, 17 bp; single-stranded, linear
agggcggcatggcgggc

SEQ ID NO: 778 - DNA, 16 bp; single-stranded, linear
agggcggcatggcggg

SEQ ID NO: 779 - DNA, 15 bp; single-stranded, linear
agggcggcatggcgg

SEQ ID NO: 780 - DNA, 14 bp; single-stranded, linear
agggcggcatggcg

SEQ ID NO: 781 - DNA, 13 bp; single-stranded, linear
agggcggcatggc

SEQ ID NO: 782 - DNA, 12 bp; single-stranded, linear
agggcggcatgg

SEQ ID NO: 783 - DNA, 11 bp; single-stranded, linear
agggcggcatg

SEQ ID NO: 784 - DNA, 10 bp; single-stranded, linear
agggcggcat

SEQ ID NO: 785 - DNA, 27 bp; single-stranded, linear
gggcggcatggcgggcacaggctgggc

SEQ ID NO: 786 - DNA, 26 bp; single-stranded, linear
gggcggcatggcgggcacaggctggg

SEQ ID NO: 787 - DNA, 25 bp; single-stranded, linear
gggcggcatggcgggcacaggctgg

SEQ ID NO: 788 - DNA, 24 bp; single-stranded, linear
gggcggcatggcgggcacaggctg

SEQ ID NO: 789 - DNA, 23 bp; single-stranded, linear
gggcggcatggcgggcacaggct

SEQ ID NO: 790 - DNA, 22 bp; single-stranded, linear
gggcggcatggcgggcacaggc

SEQ ID NO: 791 - DNA, 21 bp; single-stranded, linear
gggcggcatggcgggcacagg

SEQ ID NO: 792 - DNA, 20 bp; single-stranded, linear
gggcggcatggcgggcacag

SEQ ID NO: 793 - DNA, 19 bp; single-stranded, linear
gggcggcatggcgggcaca

SEQ ID NO: 794 - DNA, 18 bp; single-stranded, linear
gggcggcatggcgggcac

SEQ ID NO: 795 - DNA, 17 bp; single-stranded, linear
gggcggcatggcgggca

SEQ ID NO: 796 - DNA, 16 bp; single-stranded, linear
gggcggcatggcgggc

SEQ ID NO: 797 - DNA, 15 bp; single-stranded, linear
gggcggcatggcggg

SEQ ID NO: 798 - DNA, 14 bp; single-stranded, linear
gggcggcatggcgg

SEQ ID NO: 799 - DNA, 13 bp; single-stranded, linear
gggcggcatggcg

SEQ ID NO: 800 - DNA, 12 bp; single-stranded, linear
gggcggcatggc

SEQ ID NO: 801 - DNA, 11 bp; single-stranded, linear
gggcggcatgg

SEQ ID NO: 802 - DNA, 10 bp; single-stranded, linear
gggcggcatg

SEQ ID NO: 803 - DNA, 26 bp; single-stranded, linear
ggcggcatggcgggcacaggctgggc

SEQ ID NO: 804 - DNA, 25 bp; single-stranded, linear
ggcggcatggcgggcacaggctggg

SEQ ID NO: 805 - DNA, 24 bp; single-stranded, linear
ggcggcatggcgggcacaggctgg

SEQ ID NO: 806 - DNA, 23 bp; single-stranded, linear
ggcggcatggcgggcacaggctg

SEQ ID NO: 807 - DNA, 22 bp; single-stranded, linear
ggcggcatggcgggcacaggct

SEQ ID NO: 808 - DNA, 21 bp; single-stranded, linear
ggcggcatggcgggcacaggc

SEQ ID NO: 809 - DNA, 20 bp; single-stranded, linear
ggcggcatggcgggcacagg

SEQ ID NO: 810 - DNA, 19 bp; single-stranded, linear
ggcggcatggcgggcacag

SEQ ID NO: 811 - DNA, 18 bp; single-stranded, linear
ggcggcatggcgggcaca

SEQ ID NO: 812 - DNA, 17 bp; single-stranded, linear
ggcggcatggcgggcac

SEQ ID NO: 813 - DNA, 16 bp; single-stranded, linear
ggcggcatggcgggca

SEQ ID NO: 814 - DNA, 15 bp; single-stranded, linear
ggcggcatggcgggc

SEQ ID NO: 815 - DNA, 14 bp; single-stranded, linear
ggcggcatggcggg

SEQ ID NO: 816 - DNA, 13 bp; single-stranded, linear
ggcggcatggcgg

SEQ ID NO: 817 - DNA, 12 bp; single-stranded, linear
ggcggcatggcg

SEQ ID NO: 818 - DNA, 11 bp; single-stranded, linear
ggcggcatggc

SEQ ID NO: 819 - DNA, 10 bp; single-stranded, linear
ggcggcatgg

SEQ ID NO: 820 - DNA, 25 bp; single-stranded, linear
gcggcatggcgggcacaggctgggc

SEQ ID NO: 821 - DNA, 24 bp; single-stranded, linear
gcggcatggcgggcacaggctggg

SEQ ID NO: 822 - DNA, 23 bp; single-stranded, linear
gcggcatggcgggcacaggctgg

SEQ ID NO: 823 - DNA, 22 bp; single-stranded, linear
gcggcatggcgggcacaggctg

SEQ ID NO: 824 - DNA, 21 bp; single-stranded, linear
gcggcatggcgggcacaggct

SEQ ID NO: 825 - DNA, 20 bp; single-stranded, linear
gcggcatggcgggcacaggc

SEQ ID NO: 826 - DNA, 19 bp; single-stranded, linear
gcggcatggcgggcacagg

SEQ ID NO: 827 - DNA, 18 bp; single-stranded, linear
gcggcatggcgggcacag

SEQ ID NO: 828 - DNA, 17 bp; single-stranded, linear
gcggcatggcgggcaca

SEQ ID NO: 829 - DNA, 16 bp; single-stranded, linear
gcggcatggcgggcac

SEQ ID NO: 830 - DNA, 15 bp; single-stranded, linear
gcggcatggcgggca

SEQ ID NO: 831 - DNA, 14 bp; single-stranded, linear
gcggcatggcgggc

SEQ ID NO: 832 - DNA, 13 bp; single-stranded, linear
gcggcatggcggg

SEQ ID NO: 833 - DNA, 12 bp; single-stranded, linear
gcggcatggcgg

SEQ ID NO: 834 - DNA, 11 bp; single-stranded, linear
gcggcatggcg

SEQ ID NO: 835 - DNA, 10 bp; single-stranded, linear
gcggcatggc

SEQ ID NO: 836 - DNA, 24 bp; single-stranded, linear
cggcatggcgggcacaggctgggc

SEQ ID NO: 837 - DNA, 23 bp; single-stranded, linear
cggcatggcgggcacaggctggg

SEQ ID NO: 838 - DNA, 22 bp; single-stranded, linear
cggcatggcgggcacaggctgg

SEQ ID NO: 839 - DNA, 21 bp; single-stranded, linear
cggcatggcgggcacaggctg

SEQ ID NO: 840 - DNA, 20 bp; single-stranded, linear
cggcatggcgggcacaggct

SEQ ID NO: 841 - DNA, 19 bp; single-stranded, linear
cggcatggcgggcacaggc

SEQ ID NO: 842 - DNA, 18 bp; single-stranded, linear
cggcatggcgggcacagg

SEQ ID NO: 843 - DNA, 17 bp; single-stranded, linear
cggcatggcgggcacag

SEQ ID NO: 844 - DNA, 16 bp; single-stranded, linear
cggcatggcgggcaca

SEQ ID NO: 845 - DNA, 15 bp; single-stranded, linear
cggcatggcgggcac

SEQ ID NO: 846 - DNA, 14 bp; single-stranded, linear
cggcatggcgggca

SEQ ID NO: 847 - DNA, 13 bp; single-stranded, linear
cggcatggcgggc

SEQ ID NO: 848 - DNA, 12 bp; single-stranded, linear
cggcatggcggg

SEQ ID NO: 849 - DNA, 11 bp; single-stranded, linear
cggcatggcgg

SEQ ID NO: 850 - DNA, 10 bp; single-stranded, linear
cggcatggcg

SEQ ID NO: 851 - DNA, 23 bp; single-stranded, linear
ggcatggcgggcacaggctgggc

SEQ ID NO: 852 - DNA, 22 bp; single-stranded, linear
ggcatggcgggcacaggctggg

SEQ ID NO: 853 - DNA, 21 bp; single-stranded, linear
ggcatggcgggcacaggctgg

SEQ ID NO: 854 - DNA, 20 bp; single-stranded, linear
ggcatggcgggcacaggctg

SEQ ID NO: 855 - DNA, 19 bp; single-stranded, linear
ggcatggcgggcacaggct

SEQ ID NO: 856 - DNA, 18 bp; single-stranded, linear
ggcatggcgggcacaggc

SEQ ID NO: 857 - DNA, 17 bp; single-stranded, linear
ggcatggcgggcacagg

SEQ ID NO: 858 - DNA, 16 bp; single-stranded, linear
ggcatggcgggcacag

SEQ ID NO: 859 - DNA, 15 bp; single-stranded, linear
ggcatggcgggcaca

SEQ ID NO: 860 - DNA, 14 bp; single-stranded, linear
ggcatggcgggcac

SEQ ID NO: 861 - DNA, 13 bp; single-stranded, linear
ggcatggcgggca

SEQ ID NO: 862 - DNA, 12 bp; single-stranded, linear
ggcatggcgggc

SEQ ID NO: 863 - DNA, 11 bp; single-stranded, linear
ggcatggcggg

SEQ ID NO: 864 - DNA, 10 bp; single-stranded, linear
ggcatggcgg

SEQ ID NO: 865 - DNA, 22 bp; single-stranded, linear
gcatggcgggcacaggctgggc

SEQ ID NO: 866 - DNA, 21 bp; single-stranded, linear
gcatggcgggcacaggctggg

SEQ ID NO: 867 - DNA, 20 bp; single-stranded, linear
gcatggcgggcacaggctgg

SEQ ID NO: 868 - DNA, 19 bp; single-stranded, linear
gcatggcgggcacaggctg

SEQ ID NO: 869 - DNA, 18 bp; single-stranded, linear
gcatggcgggcacaggct

SEQ ID NO: 870 - DNA, 17 bp; single-stranded, linear
gcatggcgggcacaggc

SEQ ID NO: 871 - DNA, 16 bp; single-stranded, linear
gcatggcgggcacagg

SEQ ID NO: 872 - DNA, 15 bp; single-stranded, linear
gcatggcgggcacag

SEQ ID NO: 873 - DNA, 14 bp; single-stranded, linear
gcatggcgggcaca

SEQ ID NO: 874 - DNA, 13 bp; single-stranded, linear
gcatggcgggcac

SEQ ID NO: 875 - DNA, 12 bp; single-stranded, linear
gcatggcgggca

SEQ ID NO: 876 - DNA, 11 bp; single-stranded, linear
gcatggcgggc

SEQ ID NO: 877 - DNA, 10 bp; single-stranded, linear
gcatggcggg

SEQ ID NO: 878 - DNA, 21 bp; single-stranded, linear
catggcgggcacaggctgggc

SEQ ID NO: 879 - DNA, 20 bp; single-stranded, linear
catggcgggcacaggctggg

SEQ ID NO: 880 - DNA, 19 bp; single-stranded, linear
catggcgggcacaggctgg

SEQ ID NO: 881 - DNA, 18 bp; single-stranded, linear
catggcgggcacaggctg

SEQ ID NO: 882 - DNA, 17 bp; single-stranded, linear
catggcgggcacaggct

SEQ ID NO: 883 - DNA, 16 bp; single-stranded, linear
catggcgggcacaggc

SEQ ID NO: 884 - DNA, 15 bp; single-stranded, linear
catggcgggcacagg

SEQ ID NO: 885 - DNA, 14 bp; single-stranded, linear
catggcgggcacag

SEQ ID NO: 886 - DNA, 13 bp; single-stranded, linear
catggcgggcaca

SEQ ID NO: 887 - DNA, 12 bp; single-stranded, linear
catggcgggcac

SEQ ID NO: 888 - DNA, 11 bp; single-stranded, linear
catggcgggca

SEQ ID NO: 889 - DNA, 10 bp; single-stranded, linear
catggcgggc

SEQ ID NO: 890 - DNA, 20 bp; single-stranded, linear
atggcgggcacaggctgggc

SEQ ID NO: 891 - DNA, 19 bp; single-stranded, linear
atggcgggcacaggctggg

SEQ ID NO: 892 - DNA, 18 bp; single-stranded, linear
atggcgggcacaggctgg

SEQ ID NO: 893 - DNA, 17 bp; single-stranded, linear
atggcgggcacaggctg

SEQ ID NO: 894 - DNA, 16 bp; single-stranded, linear
atggcgggcacaggct

SEQ ID NO: 895 - DNA, 15 bp; single-stranded, linear
atggcgggcacaggc

SEQ ID NO: 896 - DNA, 14 bp; single-stranded, linear
atggcgggcacagg

SEQ ID NO: 897 - DNA, 13 bp; single-stranded, linear
atggcgggcacag

SEQ ID NO: 898 - DNA, 12 bp; single-stranded, linear
atggcgggcaca

SEQ ID NO: 899 - DNA, 11 bp; single-stranded, linear
atggcgggcac

SEQ ID NO: 900 - DNA, 10 bp; single-stranded, linear
atggcgggca

SEQ ID NO: 901 - DNA, 19 bp; single-stranded, linear
tggcgggcacaggctgggc

SEQ ID NO: 902 - DNA, 18 bp; single-stranded, linear
tggcgggcacaggctggg

SEQ ID NO: 903 - DNA, 17 bp; single-stranded, linear
tggcgggcacaggctgg

SEQ ID NO: 904 - DNA, 16 bp; single-stranded, linear
tggcgggcacaggctg

SEQ ID NO: 905 - DNA, 15 bp; single-stranded, linear
tggcgggcacaggct

SEQ ID NO: 906 - DNA, 14 bp; single-stranded, linear
tggcgggcacaggc

SEQ ID NO: 907 - DNA, 13 bp; single-stranded, linear
tggcgggcacagg

SEQ ID NO: 908 - DNA, 12 bp; single-stranded, linear
tggcgggcacag

SEQ ID NO: 909 - DNA, 11 bp; single-stranded, linear
tggcgggcaca

SEQ ID NO: 910 - DNA, 10 bp; single-stranded, linear
tggcgggcac

SEQ ID NO: 911 - DNA, 18 bp; single-stranded, linear
ggcgggcacaggctgggc

SEQ ID NO: 912 - DNA, 17 bp; single-stranded, linear
ggcgggcacaggctggg

SEQ ID NO: 913 - DNA, 16 bp; single-stranded, linear
ggcgggcacaggctgg

SEQ ID NO: 914 - DNA, 15 bp; single-stranded, linear
ggcgggcacaggctg

SEQ ID NO: 915 - DNA, 14 bp; single-stranded, linear
ggcgggcacaggct

SEQ ID NO: 916 - DNA, 13 bp; single-stranded, linear
ggcgggcacaggc

SEQ ID NO: 917 - DNA, 12 bp; single-stranded, linear
ggcgggcacagg

SEQ ID NO: 918 - DNA, 11 bp; single-stranded, linear
ggcgggcacag

SEQ ID NO: 919 - DNA, 10 bp; single-stranded, linear
ggcgggcaca

SEQ ID NO: 920 - DNA, 17 bp; single-stranded, linear
gcgggcacaggctgggc

SEQ ID NO: 921 - DNA, 16 bp; single-stranded, linear
gcgggcacaggctggg

SEQ ID NO: 922 - DNA, 15 bp; single-stranded, linear
gcgggcacaggctgg

SEQ ID NO: 923 - DNA, 14 bp; single-stranded, linear
gcgggcacaggctg

SEQ ID NO: 924 - DNA, 13 bp; single-stranded, linear
gcgggcacaggct

SEQ ID NO: 925 - DNA, 12 bp; single-stranded, linear
gcgggcacaggc

SEQ ID NO: 926 - DNA, 11 bp; single-stranded, linear
gcgggcacagg

SEQ ID NO: 927 - DNA, 10 bp; single-stranded, linear
gcgggcacag

SEQ ID NO: 928 - DNA, 16 bp; single-stranded, linear
cgggcacaggctgggc

SEQ ID NO: 929 - DNA, 14 bp; single-stranded, linear
gggcacaggctggg

SEQ ID NO: 930 - DNA, 14 bp; single-stranded, linear
cgggcacaggctgg

SEQ ID NO: 931 - DNA, 13 bp; single-stranded, linear
cgggcacaggctg

SEQ ID NO: 932 - DNA, 12 bp; single-stranded, linear
cgggcacaggct

SEQ ID NO: 933 - DNA, 11 bp; single-stranded, linear
cgggcacaggc

SEQ ID NO: 934 - DNA, 10 bp; single-stranded, linear
cgggcacagg

SEQ ID NO: 935 - DNA, 15 bp; single-stranded, linear
gggcacaggctgggc

SEQ ID NO: 936 - DNA, 14 bp; single-stranded, linear
gggcacaggctggg

SEQ ID NO: 937 - DNA, 13 bp; single-stranded, linear
gggcacaggctgg

SEQ ID NO: 938 - DNA, 12 bp; single-stranded, linear
gggcacaggctg

SEQ ID NO: 939 - DNA, 11 bp; single-stranded, linear
gggcacaggct

SEQ ID NO: 940 - DNA, 10 bp; single-stranded, linear
gggcacaggc

SEQ ID NO: 941 - DNA, 14 bp; single-stranded, linear
ggcacaggctgggc

SEQ ID NO: 942 - DNA, 13 bp; single-stranded, linear
ggcacaggctggg

SEQ ID NO: 943 - DNA, 12 bp; single-stranded, linear
ggcacaggctgg

SEQ ID NO: 944 - DNA, 11 bp; single-stranded, linear
ggcacaggctg

SEQ ID NO: 945 - DNA, 10 bp; single-stranded, linear
ggcacaggct

SEQ ID NO: 946 - DNA, 13 bp; single-stranded, linear
gcacaggctgggc

SEQ ID NO: 947 - DNA, 12 bp; single-stranded, linear
gcacaggctggg

SEQ ID NO: 948 - DNA, 11 bp; single-stranded, linear
gcacaggctgg

SEQ ID NO: 949 - DNA, 10 bp; single-stranded, linear
gcacaggctg

SEQ ID NO: 950 - DNA, 12 bp; single-stranded, linear
cacaggctgggc

SEQ ID NO: 951 - DNA, 11 bp; single-stranded, linear
cacaggctggg

SEQ ID NO: 952 - DNA, 10 bp; single-stranded, linear
cacaggctgg

SEQ ID NO: 953 - DNA, 11 bp; single-stranded, linear
acaggctgggc

SEQ ID NO: 954 - DNA, 10 bp; single-stranded, linear
acaggctggg

SEQ ID NO: 955 - DNA, 10 bp; single-stranded, linear
caggctgggc

SEQ ID NO: 956 - DNA, 23 bp; single-stranded, linear
ttttccttcctttgtctctcttc

SEQ ID NO: 957 - DNA, 15 bp; single-stranded, linear
gctcccggctgcctg

SEQ ID NO: 958 - DNA, 29 bp; single-stranded, linear
ctcggccgtgcggctctgtcgctcccggt

SEQ ID NO: 959 - DNA, 20 bp; single-stranded, linear
ccgccgccctccggggggtc

SEQ ID NO: 960 - DNA, 18 bp; single-stranded, linear
tgctgccgttggctgccc

SEQ ID NO: 961 - DNA, 17 bp; single-stranded, linear
cttctgcgggtcgccgg

SEQ ID NO: 962 - DNA, 15 bp; single-stranded, linear
tgctgggcttgtggc

SEQ ID NO: 963 - DNA, 15 bp; single-stranded, linear
ggcctctcttctggg

SEQ ID NO: 964 - DNA, 14 bp; single-stranded, linear
cctggtccctccgt

SEQ ID NO: 965 - DNA, 14 bp; single-stranded, linear
ggtggctcctctgc

SEQ ID NO: 966 - DNA, 18 bp; single-stranded, linear
gcttggtcctggggctgc

SEQ ID NO: 967 - DNA, 15 bp; single-stranded, linear
tgctctcctctcctt

SEQ ID NO: 968 - DNA, 21 bp; single-stranded, linear
tgcttttcttttctgggcctc

SEQ ID NO: 969 - DNA, 19 bp; single-stranded, linear
tgtggtctgtttttttctg

SEQ ID NO: 970 - DNA, 20 bp; single-stranded, linear
gccctgctggggcgctctcc

SEQ ID NO: 971 - DNA, 18 bp; single-stranded, linear
gccgcccgcctggctccc

SEQ ID NO: 972 - DNA (Genomic DNA), 21 bp; single-stranded, linear
ggbgcccbtgbtgggcbtgcc

SEQ ID NO: 973 - DNA, 24 bp; single-stranded, linear
gtggttcttgccctcctttggctg

SEQ ID NO: 974 - DNA, 18 bp; single-stranded, linear
ccgtgcccgctccccggc

SEQ ID NO: 975 - DNA, 20 bp; single-stranded, linear
ctcctggcgggtggccgttg

SEQ ID NO: 976 - DNA, 18 bp; single-stranded, linear
ggcccgtgttcccctggg

SEQ ID NO: 977 - DNA, 20 bp; single-stranded, linear
gcctggggctcccttctctc

SEQ ID NO: 978 - DNA, 19 bp; single-stranded, linear
gcccttcttgctgggcctc

SEQ ID NO: 979 - DNA, 25 bp; single-stranded, linear
tgctgctgctggtgctgtggccccc

SEQ ID NO: 980 - DNA, 43 bp; single-stranded, linear
gtacaccgaggagcccatgatgggcatgccacagacgacaggc

SEQ ID NO: 981 - DNA (Genomic DNA), 43 bp; single-stranded, linear
gtbcbccgbggbgcccbtgbtgggcbtgccbcbgbcgbcbggc

SEQ ID NO: 982 - DNA, 29 bp; single-stranded, linear
ggcgccgtgccgcgtcttggtggcggcgg

SEQ ID NO: 983 - DNA, 30 bp; single-stranded, linear
gttcgcgcccgcgcggggcccctccggtcc

SEQ ID NO: 984 - DNA, 30 bp; single-stranded, linear; identical to SEQ ID NO: 983

SEQ ID NO: 985 - DNA, 22 bp; single-stranded, linear
cgggtcggggccccccgcggcc

SEQ ID NO: 986 - DNA, 29 bp; single-stranded, linear
gcctcggggctggggcgctggtggccggg

SEQ ID NO: 987 - DNA, 24 bp; single-stranded, linear
ccgcgcctccgcctgccgcttctg

SEQ ID NO: 988 - DNA, 21 bp; single-stranded, linear
gctgggccccgggcgccccct

SEQ ID NO: 989 - DNA, 23 bp; single-stranded, linear
cccctcttgctcgggtccccgtg

SEQ ID NO: 990 - DNA, 48 bp; single-stranded, linear
acagcgcgtcctgtgtctccagcagcatggccgggccagctgggcccc

SEQ ID NO: 991 - DNA (Genomic DNA), 48 bp; single-stranded, linear
bcbgcgcgtcctgtgtctccbgcbgcbtggccgggccbgctgggcccc

SEQ ID NO: 992 - DNA, 39 bp; single-stranded, linear
acagagcatgctgttgttgggcatcttgccttcccaggg

SEQ ID NO: 993 - DNA (Genomic DNA), 39 bp; single-stranded, linear
bcbgbgcbtgctgttgttgggcbtcttgccttcccbggg

SEQ ID NO: 994 - DNA, 18 bp; single-stranded, linear
cccttttctggtggggtg

SEQ ID NO: 995 - DNA, 15 bp; single-stranded, linear
gtgctgttgttgggc

SEQ ID NO: 996 - DNA, 14 bp; single-stranded, linear
tttcttctgttccc

SEQ ID NO: 997 - DNA, 18 bp; single-stranded, linear
cccttttctggtggggtg

SEQ ID NO: 998 - DNA, 15 bp; single-stranded, linear
gtgctgttgttgggc

SEQ ID NO: 999 - DNA, 14 bp; single-stranded, linear
tttcttctgttccc

SEQ ID NO: 1000 - DNA, 17 bp; single-stranded, linear
tttcccctgggtcttcc

SEQ ID NO: 1001 - DNA, 16 bp; single-stranded, linear
ctcctgctcttttttc

SEQ ID NO: 1002 - DNA, 50 bp; single-stranded, linear
atttgctctcctattactttctgtgtccattttttcattaaccgagctgt

SEQ ID NO: 1003 - DNA (Genomic DNA), 50 bp; single-stranded, linear
btttgctctcctbttbctttctgtgtccbttttttcbttbbccgbgctgt

SEQ ID NO: 1004 - DNA, 18 bp; single-stranded, linear
gcctgtgtctgtcctcct

SEQ ID NO: 1005 - DNA, 18 bp; single-stranded, linear
gcttcgttcctctcgttc

SEQ ID NO: 1006 - DNA, 19 bp; single-stranded, linear
ctgcttggtgcccttgccg

SEQ ID NO: 1007 - DNA, 22 bp; single-stranded, linear
gtcctgctcctccgggctgtgg

SEQ ID NO: 1008 - DNA, 36 bp; single-stranded, linear
gtcgtggccctggctccggctggtgggctcccctgg

SEQ ID NO: 1009 - DNA, 22 bp; single-stranded, linear
ccttcgctggctggcggcgtgc

SEQ ID NO: 1010 - DNA, 24 bp; single-stranded, linear
gggtcttgctctgggcctggctgt

SEQ ID NO: 1011 - DNA, 20 bp; single-stranded, linear
ggccgtggttgggggtcttc

SEQ ID NO: 1012 - DNA, 20 bp; single-stranded, linear
gctgcctccgtttgggtggc

SEQ ID NO: 1013 - DNA, 50 bp; single-stranded, linear
tctctgaatattgaccttcctccatggcggtcctgcttggattctcccga

SEQ ID NO: 1014 - DNA (Genomic DNA), 50 bp; single-stranded, linear
tctctgbbtbttgbccttcctccbtggcggtcctgcttggbttctcccgb

SEQ ID NO: 1015 - DNA, 39 bp; single-stranded, linear
gcctttcctggttctcttgttgtttttggggtttggctt

SEQ ID NO: 1016 - DNA, 50 bp; single-stranded, linear
acagtagagtaggggattccatggcaggagccatcttcttcatggactcc

SEQ ID NO: 1017 - DNA, 50 bp; single-stranded, linear
ttcaaggagaccttaggtttctgagggactgctaacacgccatctggagc

SEQ ID NO: 1018 - DNA (Genomic DNA), 77 bp; single-stranded, linear
bcbgtbgbgtbggggbttccbtggcbggbgccbtcttcttcbtggbctccttcbbggbgbccttbggtttctgbggg

SEQ ID NO: 1019 - DNA (Genomic DNA), 23 bp; single-stranded, linear
bctgctbbcbcgccbtctggbgc

SEQ ID NO: 1020 - DNA, 21 bp; single-stranded, linear
gttgtttttggggtttggctt

SEQ ID NO: 1021 - DNA, 18 bp; single-stranded, linear
gcctttcctggttctctt

SEQ ID NO: 1022 - DNA (Genomic DNA), 50 bp; single-stranded, linear
bcbgtbgbgtbggggbttccbtggcbggbgccbtcttcttcbtggbctcc

SEQ ID NO: 1023 - DNA (Genomic DNA), 50 bp; single-stranded, linear
ttcbbggbgbccttbggtttctgbgggbctgctbbcbcgccbtctggbgc

SEQ ID NO: 1024 - DNA, 18 bp; single-stranded, linear
gcctgtgtctgtcctcct

SEQ ID NO: 1025 - DNA, 18 bp; single-stranded, linear
gcttcgttcctctcgttc

SEQ ID NO: 1026 - DNA, 19 bp; single-stranded, linear
ctgcttggtgcccttgccg

SEQ ID NO: 1027 - DNA, 22 bp; single-stranded, linear
gtcctgctcctccgggctgtgg

SEQ ID NO: 1028 - DNA, 36 bp; single-stranded, linear
gtcctcgccctggctccggctggtgggctcccctgg

SEQ ID NO: 1029 - DNA, 22 bp; single-stranded, linear
ccttcgctggctggcggcgtgc

SEQ ID NO: 1030 - DNA (Genomic DNA), 24 bp; single-stranded, linear
cccbgbbcgbgbcccggbccgbcb

SEQ ID NO: 1031 - DNA, 20 bp; single-stranded, linear
ggccgtggttgggggtcttc

SEQ ID NO: 1032 - DNA, 20 bp; single-stranded, linear
gctgcctccgtttgggtggc

SEQ ID NO: 1033 - DNA (Genomic DNA), 40 bp; single-stranded, linear
gbtctctgbbtbttgbccttccbtggcggtcctgcttggb

SEQ ID NO: 1034 - DNA, 26 bp; single-stranded, linear
tctcccttgggctctggctccttctc

SEQ ID NO: 1035 - DNA, 21 bp; single-stranded, linear
tctctctccctctctctctgt

SEQ ID NO: 1036 - DNA, 32 bp; single-stranded, linear
cgcctccgccctggctgctggggtggtggtgc

SEQ ID NO: 1037 - DNA, 20 bp; single-stranded, linear
ttttgttcttccttgctgcc

SEQ ID NO: 1038 - DNA, 22 bp; single-stranded, linear
gccccgctgcttgtcttcctcg

SEQ ID NO: 1039 - DNA (Genomic DNA), 50 bp; single-stranded, linear
ctctgtccctctctctctgtbctcctcbggctccbtcbtctcccttgggc

SEQ ID NO: 1040 - DNA, 21 bp; single-stranded, linear
cttgctcctgggggcctcctg

SEQ ID NO: 1041 - DNA, 21 bp; single-stranded, linear
gtccctccgggtgttcccggc

SEQ ID NO: 1042 - DNA (Genomic DNA), 81 bp; single-stranded, linear
gggcctggcctggggcbggggccgcgtbggcgcggctcgccbggbcgggcbgcgccbgcbgcbgcbgbttcbgcbtcctgg

SEQ ID NO: 1043 - DNA, 21 bp; single-stranded, linear
cttgctcctgggggcctcctg

SEQ ID NO: 1044 - DNA, 21 bp; single-stranded, linear
gtccctctggctgttcccggc

SEQ ID NO: 1045 - DNA (Genomic DNA), 90 bp; single-stranded, linear
cctggbctggggcbggggccgcgtbggcgcggctcgccbggbcgggcbgcgccbgcbgcbgcbggctcbgcbtcctggccbcggbbttcc

SEQ ID NO: 1046 - DNA, 20 bp; single-stranded, linear
ggtgtgcggggcctggtgcc

SEQ ID NO: 1047 - DNA, 23 bp; single-stranded, linear
cctgggcctcgggtgctgcctgt

SEQ ID NO: 1048 - DNA, 20 bp; single-stranded, linear
gcgctgccttcttctcctgg

SEQ ID NO: 1049 - DNA, 32 bp; single-stranded, linear
gtcctcgccggggcccttgctgccctggctgt

SEQ ID NO: 1050 - DNA, 25 bp; single-stranded, linear
gccctgggggtctgggttcggctgt

SEQ ID NO: 1051 - DNA (Genomic DNA), 60 bp; single-stranded, linear
ccccbgcbggbccbgtcccbtccbcbgcgtgtgbtgbgtbgccbttctcctgcbgccgbg

SEQ ID NO: 1052 - DNA (Genomic DNA), 19 bp; single-stranded, linear
gggcgcgggcgbgcbtcgc

SEQ ID NO: 1053 - DNA, 22 bp; single-stranded, linear
tttgggcttttctcctttggtt

SEQ ID NO: 1054 - DNA (Genomic DNA), 60 bp; single-stranded, linear
tgbgcgccbggbccgcgcbcbgcbgcbgggcgcgggcgbgcbtcgcbgcggcgggcbggg

SEQ ID NO: 1055 - DNA, 20 bp; single-stranded, linear
gccctgctgctctttctgct

SEQ ID NO: 1056 - DNA, 19 bp; single-stranded, linear
tcccttggtgggttgggcc

SEQ ID NO: 1057 - DNA, 19 bp; single-stranded, linear
ttgctgccccttctgtccc

SEQ ID NO: 1058 - DNA, 19 bp; single-stranded, linear
gctggttgttctggggttc

SEQ ID NO: 1059 - DNA, 19 bp; single-stranded, linear
tgtttgctggtgtctgcgc

SEQ ID NO: 1060 - DNA (Genomic DNA), 60 bp; single-stranded, linear
ccccbbcbgbbgbbgcbgbcbbbtttgggbbgtgbbcbgttttggbbccbtgtttcctgt

SEQ ID NO: 1061 - DNA, 19 bp; single-stranded, linear
gcgctcggcctggtcccgg

SEQ ID NO: 1062 - DNA, 20 bp; single-stranded, linear
gggtctcctcttgttgttgc

SEQ ID NO: 1063 - DNA, 22 bp; single-stranded, linear
ttgcgcctcctgctgggggtcc

SEQ ID NO: 1064 - DNA, 21 bp; single-stranded, linear
ctctgttcttgttttgggggc

SEQ ID NO: 1065 - DNA, 19 bp; single-stranded, linear
gggcccggccgttgtcttg

SEQ ID NO: 1066 - DNA, 18 bp; single-stranded, linear
gtttgggggtttccgttg

SEQ ID NO: 1067 - DNA, 26 bp; single-stranded, linear
gggttctcctggcccgggccttgccc

SEQ ID NO: 1068 - DNA, 23 bp; single-stranded, linear
ggccgtggtcccggcttcgttgc

SEQ ID NO: 1069 - DNA, 24 bp; single-stranded, linear
cctgtctccgtctcggctcttctg

SEQ ID NO: 1070 - DNA, 22 bp; single-stranded, linear
gggccttgcgctgtctttggtg

SEQ ID NO: 1071 - DNA (Genomic DNA), 60 bp; single-stranded, linear
gcbccgtccbgtgbtggtgcggtbcttgtcgctgcbgcgctcggcctggtcccggbgbgc

SEQ ID NO: 1072 - DNA, 22 bp; single-stranded, linear
gcgcgggccgggggctgctggg

SEQ ID NO: 1073 - DNA, 19 bp; single-stranded, linear
ggttggcccggggtgcccc

SEQ ID NO: 1074 - DNA, 29 bp; single-stranded, linear
gccgctgggtgccctcgtcctctgcggtc

SEQ ID NO: 1075 - DNA, 23 bp; single-stranded, linear
gtgtctcctggctctggttcccc

SEQ ID NO: 1076 - DNA, 31 bp; single-stranded, linear
gctgcgcccgttgtcctctggggtggccttc

SEQ ID NO: 1077 - DNA, 23 bp; single-stranded, linear
gctcccgggtctggttcttgtgt

SEQ ID NO: 1078 - DNA, 26 bp; single-stranded, linear
tgggggtccctttttgggcctgttgt

SEQ ID NO: 1079 - DNA, 24 bp; single-stranded, linear
ggcgtggcttgtgtgttcggtttc

SEQ ID NO: 1080 - DNA, 21 bp; single-stranded, linear
tgccctgtcctccggcgtccc

SEQ ID NO: 1081 - DNA (Genomic DNA), 142 bp; single-stranded, linear
cggbgcctccccggggcbggbtgbcttttgbgggggbcbcbgbtgtctgggcbttgccbggtcctgggbbcbgbgccccgbgcbggbccbggbgtgcgggcbgcgcgggccgggggctgctgggbgccbtbgcgbggctgbg

SEQ ID NO: 1082 - DNA, 19 bp; single-stranded, linear
cctcttttctgtttttccc

SEQ ID NO: 1083 - DNA, 21 bp; single-stranded, linear
ctctgcctttgtttgggttcg

SEQ ID NO: 1084 - DNA, 19 bp; single-stranded, linear
cttcctttctgcttcttcc

SEQ ID NO: 1085 - DNA, 29 bp; single-stranded, linear
ctgtgtctcctgtctccgcttttttcttc

SEQ ID NO: 1086 - DNA, 24 bp; single-stranded, linear
gtctttgttgttttctcttccttg

SEQ ID NO: 1087 - DNA (Genomic DNA), 130 bp; single-stranded, linear
ctgbgcbbgbtbtctbgbttctggggtggtctcgbttttbbbbgcttgbgbbgctgcbbbcbttbtccbbbgtbtbtttgbggctccbbggbtcbcgbccbtcttcccbggcbttttbbgttgctgtcgt

SEQ ID NO: 1088 - DNA, 19 bp; single-stranded, linear
gttcttggcttcttctgtc

SEQ ID NO: 1089 - DNA, 20 bp; single-stranded, linear
cgttggcttctcgttgtccc

SEQ ID NO: 1090 - DNA, 20 bp; single-stranded, linear
tgtgggcttctcgttgtccc

SEQ ID NO: 1091 - DNA, 18 bp; single-stranded, linear
cccttcgggggctggtgg

SEQ ID NO: 1092 - DNA, 9 bp; single-stranded, linear
ggctggtgg

SEQ ID NO: 1093 - DNA, 19 bp; single-stranded, linear
ggccgtccttgcctgctgg

SEQ ID NO: 1094 - DNA, 41 bp; single-stranded, linear
ttttctctttcgctttcttttcgtctcctgttcctcctttt

SEQ ID NO: 1095 - DNA, 36 bp; single-stranded, linear
ttgctgttttttctccttcttctctcctttcttttc

SEQ ID NO: 1096 - DNA, 41 bp; single-stranded, linear; identical to SEQ ID NO: 1094

SEQ ID NO: 1097 - DNA, 36 bp; single-stranded, linear; identical to SEQ ID NO: 1095

SEQ ID NO: 1098 - DNA, 33 bp; single-stranded, linear
ctctgtcttgttctggtccttcgtggggctctg

SEQ ID NO: 1099 - DNA, 24 bp; single-stranded, linear
tgtcgcgtgggtgcggccgtggcc

SEQ ID NO: 1100 - DNA (Genomic DNA), 69 bp; single-stranded, linear
ggcggbccbggbgttggbgcbggbgcbggbcgggcbggcggctcbtgtttggbtcggcbggbggcbctc

SEQ ID NO: 1101 - DNA, 14 bp; single-stranded, linear
tctggggtgtcctg

SEQ ID NO: 1102 - DNA, 14 bp; single-stranded, linear
gccttcgtggttcc

SEQ ID NO: 1103 - DNA, 15 bp; single-stranded, linear
tcttccttcgtttgc

SEQ ID NO: 1104 - DNA, 19 bp; single-stranded, linear
ggctgcgctcctgccccgc

SEQ ID NO: 1105 - DNA, 23 bp; single-stranded, linear
cgtccgcgggggcccccgggcct

SEQ ID NO: 1106 - DNA, 17 bp; single-stranded, linear
ctctttcccgggctctt

SEQ ID NO: 1107 - DNA, 17 bp; single-stranded, linear
gcgctggggggtgctcc

SEQ ID NO: 1108 - DNA, 28 bp; single-stranded, linear
cgtgtgtttgcgccctcctcctggtcgc

SEQ ID NO: 1109 - DNA, 14 bp; single-stranded, linear
gcttgtcgttttgg

SEQ ID NO: 1110 - DNA, 21 bp; single-stranded, linear
ggccggctttgcccgcctccc

SEQ ID NO: 1111 - DNA, 16 bp; single-stranded, linear
ggcgcctggcccggcc

SEQ ID NO: 1112 - DNA, 18 bp; single-stranded, linear
ttcctgggctgcgtgcgc

SEQ ID NO: 1113 - DNA, 20 bp; single-stranded, linear
gttctgttcttcttcctggc

SEQ ID NO: 1114 - DNA (Genomic DNA), 78 bp; single-stranded, linear
gcbggbgbcbgggcbgggcgbtcbggbgcbgcgtgbgccbbbggbggbccbtcgggbbcgcbgctccggbbcgcbggb

SEQ ID NO: 1115 - DNA, 18 bp; single-stranded, linear
ctctggttggcttccttc

SEQ ID NO: 1116 - DNA (Genomic DNA), 70 bp; single-stranded, linear
gccggcbcbtgctbgcbggbbgbbcbgbgggggbbgcbgttgggbggtgbgbcccbttbbtbggtgtcgb

SEQ ID NO: 1117 - DNA, 18 bp; single-stranded, linear
tctgcgcgcccctgctcc

SEQ ID NO: 1118 - DNA, 14 bp; single-stranded, linear
cgcccggcttctct

SEQ ID NO: 1119 - DNA, 14 bp; single-stranded, linear
cgtgtgggcttcgg

SEQ ID NO: 1120 - DNA, 21 bp; single-stranded, linear
ccccgcgcctccgttgttctc

SEQ ID NO: 1121 - DNA, 15 bp; single-stranded, linear
tgctcgctgggcttg

SEQ ID NO: 1122 - DNA, 23 bp; single-stranded, linear
ggtttcctggggccctgggtttc

SEQ ID NO: 1123 - DNA, 17 bp; single-stranded, linear
tctgccgggtcgttttc

SEQ ID NO: 1124 - DNA, 14 bp; single-stranded, linear
gggtgctggctgcg

SEQ ID NO: 1125 - DNA, 17 bp; single-stranded, linear
cttggtgctggggctcc

SEQ ID NO: 1126 - DNA, 22 bp; single-stranded, linear
ggcggctgcgggctgggttggg

SEQ ID NO: 1127 - DNA, 23 bp; single-stranded, linear
cttggctggttcctggcctcggg

SEQ ID NO: 1128 - DNA, 35 bp; single-stranded, linear
cctcctcctcctcctcgctccctttttcttcctct

SEQ ID NO: 1129 - DNA, 14 bp; single-stranded, linear
tccctgctgctctc

SEQ ID NO: 1130 - DNA, 20 bp; single-stranded, linear
tgccctcccttccctcctgg

SEQ ID NO: 1131 - DNA, 20 bp; single-stranded, linear
ggtgcctccttgggccctgc

SEQ ID NO: 1132 - DNA, 16 bp; single-stranded, linear
ggctgctccttgcccc

SEQ ID NO: 1133 - DNA, 17 bp; single-stranded, linear
ctctgggtcgggctggc

SEQ ID NO: 1134 - DNA, 15 bp; single-stranded, linear
ggggcgtctctgtgc

SEQ ID NO: 1135 - DNA, 14 bp; single-stranded, linear
ctggcctgggtgcc

SEQ ID NO: 1136 - DNA, 29 bp; single-stranded, linear
gcctctcctgggggggtggctccctgtcc

SEQ ID NO: 1137 - DNA, 17 bp; single-stranded, linear
ccttttcccccggctcc

SEQ ID NO: 1138 - DNA, 14 bp; single-stranded, linear
gtgggggctttggc

SEQ ID NO: 1139 - DNA, 25 bp; single-stranded, linear
gggggtctgtggcctgctcctgggg

SEQ ID NO: 1140 - DNA, 17 bp; single-stranded, linear
aggggtctggggccctc

SEQ ID NO: 1141 - DNA, 18 bp; single-stranded, linear
ttttgggggtctggcttg

SEQ ID NO: 1142 - DNA, 15 bp; single-stranded, linear
gcctggctgccttcc

SEQ ID NO: 1143 - DNA, 17 bp; single-stranded, linear
ggggcctgccgtggggc

SEQ ID NO: 1144 - DNA, 20 bp; single-stranded, linear
tgtcctctgttgctcccctt

SEQ ID NO: 1145 - DNA, 14 bp; single-stranded, linear
tgcctgctgtctgg

SEQ ID NO: 1146 - DNA, 16 bp; single-stranded, linear
ggttcccgccttccct

SEQ ID NO: 1147 - DNA, 100 bp; single-stranded, linear
gttcccagagcttgccacctgcagcaggaccaggcagctcacagggaacaggagcccagagcaaagccaccccattgggagatgccaaggcaccaggctg

SEQ ID NO: 1148 - DNA (Genomic DNA), 100 bp; single-stranded, linear
gttcccbgbgcttgccbcctgcbgcbggbccbggcbgctcbcbgggbbcbggbgcccbgbgcbbbgccbccccbttgggbgbtgccbbggcbccbggctg

SEQ ID NO: 1149 - DNA, 18 bp; single-stranded, linear
tccctgtttccccccttt

SEQ ID NO: 1150 - DNA, 21 bp; single-stranded, linear
cgttctgcgtttgcctttggc

SEQ ID NO: 1151 - DNA, 18 bp; single-stranded, linear
gttttttgtttgttttct

SEQ ID NO: 1152 - DNA, 19 bp; single-stranded, linear
ctctccgtctttcttctcc

SEQ ID NO: 1153 - DNA, 25 bp; single-stranded, linear
cctcctgcctgtgtccctgctcccc

SEQ ID NO: 1154 - DNA, 22 bp; single-stranded, linear
gagggtttctggcttcctctct

SEQ ID NO: 1155 - DNA, 20 bp; single-stranded, linear
tgtctctctgtccttttgtt

SEQ ID NO: 1156 - DNA, 32 bp; single-stranded, linear
tgttgtgcggcctggtgctgccctgccccggg

SEQ ID NO: 1157 - DNA (Genomic DNA), 89 bp; single-stranded, linear
gtgggbbtttctgtggggbtggcbtbcbcgtbggcbgctccbbgbgctbgcbbbctcbbbtgcbgbbgcbtcctcbtggctctgbbbcg

SEQ ID NO: 1158 - DNA, 17 bp; single-stranded, linear
ccgtgtctgtcgtgtct

SEQ ID NO: 1159 - DNA, 14 bp; single-stranded, linear
ttcctttgctcttg

SEQ ID NO: 1160 - DNA, 15 bp; single-stranded, linear
gtgtgtctttgctgt

SEQ ID NO: 1161 - DNA, 15 bp; single-stranded, linear
gccctgcctctctgc

SEQ ID NO: 1162 - DNA, 17 bp; single-stranded, linear
gggggtggcttcctgcc

SEQ ID NO: 1163 - DNA, 18 bp; single-stranded, linear
gcgtctctgggccgtccc

SEQ ID NO: 1164 - DNA, 36 bp; single-stranded, linear
gtccctcggccccgcgccgcgctcggctcctctccc

SEQ ID NO: 1165 - DNA, 13 bp; single-stranded, linear
tctggcccggctc

SEQ ID NO: 1166 - DNA, 26 bp; single-stranded, linear
ggggcggggcggggcggtgggcgggc

SEQ ID NO: 1167 - DNA, 15 bp; single-stranded, linear
ggcgctgccctgcgc

SEQ ID NO: 1168 - DNA, 14 bp; single-stranded, linear
gcggcgctggcccc

SEQ ID NO: 1169 - DNA, 34 bp; single-stranded, linear
tgctggccgtcggctgcgcgctgctggctgccct

SEQ ID NO: 1170 - DNA, 15 bp; single-stranded, linear
gctggccgcgccggg

SEQ ID NO: 1171 - DNA, 19 bp; single-stranded, linear
gcctgtccgcctctgcggg

SEQ ID NO: 1172 - DNA, 14 bp; single-stranded, linear
cgctgtctcctggc

SEQ ID NO: 1173 - DNA, 15 bp; single-stranded, linear
ttgtcttccggctct

SEQ ID NO: 1174 - DNA, 14 bp; single-stranded, linear
tctgctggggtggg

SEQ ID NO: 1175 - DNA, 19 bp; single-stranded, linear
gctgggcggccggcccggt

SEQ ID NO: 1176 - DNA, 19 bp; single-stranded, linear
gctggggctcctcgggggg

SEQ ID NO: 1177 - DNA, 14 bp; single-stranded, linear
gggggctcttccgg

SEQ ID NO: 1178 - DNA, 16 bp; single-stranded, linear
gctgtctccctccggg

SEQ ID NO: 1179 - DNA, 16 bp; single-stranded, linear
gcgggggtttctggcc

SEQ ID NO: 1180 - DNA, 14 bp; single-stranded, linear
gtgggggtcttgcc

SEQ ID NO: 1181 - DNA, 15 bp; single-stranded, linear
tggcctccgggctcc

SEQ ID NO: 1182 - DNA, 20 bp; single-stranded, linear
tgcttgtcttgccttccttc

SEQ ID NO: 1183 - DNA, 19 bp; single-stranded, linear
tctggtcggttgtggctcg

SEQ ID NO: 1184 - DNA, 20 bp; single-stranded, linear
gggctccgtgggtccctggc

SEQ ID NO: 1185 - DNA, 18 bp; single-stranded, linear
gcccgtttgtgttttgtc

SEQ ID NO: 1186 - DNA, 14 bp; single-stranded, linear
ttttcccctggcgt

SEQ ID NO: 1187 - DNA, 35 bp; single-stranded, linear
ccctgtgcccctctcctctccttcctctgcttctc

SEQ ID NO: 1188 - DNA, 15 bp; single-stranded, linear
gctctcctttgtggg

SEQ ID NO: 1189 - DNA, 15 bp; single-stranded, linear
gccctccctgctgct

SEQ ID NO: 1190 - DNA, 14 bp; single-stranded, linear
cttggttttgggct

SEQ ID NO: 1191 - DNA, 22 bp; single-stranded, linear
ttttttctcttcctcctttttc

SEQ ID NO: 1192 - DNA, 14 bp; single-stranded, linear
gtgcgtgggcctcc

SEQ ID NO: 1193 - DNA, 8 bp; single-stranded, linear
cccggcgc

SEQ ID NO: 1194 - DNA, 150 bp; single-stranded, linear
gcacgcctcttgccacctcctgcgcagggcagcgccttggggccagcgccgctcccggcgcggccagcagggcagccagcagcgcgcagccgacggccagcatgcttcctcctcggctaccactccatggtcccgcagaggcggacaggc

SEQ ID NO: 1195 - DNA (Genomic DNA), 10 bp; single-stranded, linear
ggccbgcbgg

SEQ ID NO: 1196 - DNA (Genomic DNA), 150 bp; single-stranded, linear
gcbcgcctcttgccbcctcctgcgcbgggcbgcgccttggggccbgcgccgctcccggcgcggccbgcbgggcbgccbgcbgcgcgcbgccgbcggccbgcbtgcttcctcctcggctbccbctccbtggtcccgcbgbggcggbcbggc

SEQ ID NO: 1197 - DNA, 27 bp; single-stranded, linear
gcttctctttcgttcccggtgggctcg

SEQ ID NO: 1198 - DNA, 23 bp; single-stranded, linear
gtggctgtctgtgtggggcggct

SEQ ID NO: 1199 - DNA, 19 bp; single-stranded, linear
gtgcctctttgctgctttc

SEQ ID NO: 1200 - DNA, 20 bp; single-stranded, linear
gattctttgcctttttctgc

SEQ ID NO: 1201 - DNA, 22 bp; single-stranded, linear
gcttgtgtgctctgctgtctct

SEQ ID NO: 1202 - DNA, 37 bp; single-stranded, linear
tggttccttccggtggtttcttcctggctcttgtcct

SEQ ID NO: 1203 - DNA, 17 bp; single-stranded, linear
ttctcttggcccttggc

SEQ ID NO: 1204 - DNA, 39 bp; single-stranded, linear
tggtggggctggggctccggggtctctgcccctccgtgc

SEQ ID NO: 1205 - DNA, 28 bp; single-stranded, linear
cgcgtggggccgcgctcgccggcccccc

SEQ ID NO: 1206 - DNA, 24 bp; single-stranded, linear
cctgccgggtgggctcccgccgcg

SEQ ID NO: 1207 - DNA, 20 bp; single-stranded, linear
cgccggcctgccggcccctc

SEQ ID NO: 1208 - DNA, 39 bp; single-stranded, linear
gtgggtcctgctggccgggtccgggtcccgggggtgggg

SEQ ID NO: 1209 - DNA (Genomic DNA), 22 bp; single-stranded, linear
cgcgbgtcggcggccgbgggtc

SEQ ID NO: 1210 - DNA (Genomic DNA), 19 bp; single-stranded, linear
ggcctccbccbgggbcbtg

SEQ ID NO: 1211 - DNA, 19 bp; single-stranded, linear
gtccttcttgtccgctgcc

SEQ ID NO: 1212 - DNA, 25 bp; single-stranded, linear
tctctggggttttcggtctgggtgg

SEQ ID NO: 1213 - DNA, 24 bp; single-stranded, linear
gctttcctcctggggctgctgctg

SEQ ID NO: 1214 - DNA, 28 bp; single-stranded, linear
ggctcttctttttgtttctggcctggtg

SEQ ID NO: 1215 - DNA, 18 bp; single-stranded, linear
ctctctcgtgccctttcc

SEQ ID NO: 1216 - DNA, 20 bp; single-stranded, linear
cttgggtgtcttgtttttgt

SEQ ID NO: 1217 - DNA (Genomic DNA), 19 bp; single-stranded, linear
ggcctccbccbgggbcbtg

SEQ ID NO: 1218 - DNA, 25 bp; single-stranded, linear
gtggggcctgctctcccggcctccg

SEQ ID NO: 1219 - DNA, 29 bp; single-stranded, linear
tgtgttgctgggtgttttcccgtctctgg

SEQ ID NO: 1220 - DNA, 18 bp; single-stranded, linear
tctgccttcgggggtcgt

SEQ ID NO: 1221 - DNA (Genomic DNA), 18 bp; single-stranded, linear
gggtcctcbtggctgggg

SEQ ID NO: 1222 - DNA (Genomic DNA), 18 bp; single-stranded, linear
gcctgggcctgcbgggcc

SEQ ID NO: 1223 - DNA (Genomic DNA), 20 bp; single-stranded, linear
gctcttgcctggbgtggctc

SEQ ID NO: 1224 - DNA (Genomic DNA), 19 bp; single-stranded, linear
gcccbgbgtcttccctggt

SEQ ID NO: 1225 - DNA (Genomic DNA), 20 bp; single-stranded, linear
gggtcctcbtggctggggtc

SEQ ID NO: 1226 - DNA, 15 bp; single-stranded, linear
cctctctcccgtcct

SEQ ID NO: 1227 - DNA, 23 bp; single-stranded, linear
gtctttgtttctgggctcgtgcc

SEQ ID NO: 1228 - DNA, 24 bp; single-stranded, linear
ccbtcccggcttctctctggttcc

SEQ ID NO: 1229 - DNA, 18 bp; single-stranded, linear
gtcctctgtggtgtttgg

SEQ ID NO: 1230 - DNA, 21 bp; single-stranded, linear
ccctgcttccttttgcctgtt

SEQ ID NO: 1231 - DNA, 85 bp; single-stranded, linear
gagggggcagcagttgggccccaaaggccctctcgttcaccttctggcacggagttgcatccccatagtcaaactctgtggtcgt

SEQ ID NO: 1232 - DNA, 59 bp; single-stranded, linear
gtcatagtcctctgtggtgtttggagtttccatcccggcttctctctggttccaaggga

SEQ ID NO: 1233 - DNA (Genomic DNA), 86 bp; single-stranded, linear
gbgggggcbgcbgttgggccccbbbggccctctcgttcbccttctggcbcggbgttgcbtccccbtbgtcbbbctctgtggtcgtg

SEQ ID NO: 1234 - DNA (Genomic DNA), 58 bp; single-stranded, linear
tcbtbgtcctctgtggtgtttggbgtttccbtcccggcttctctctggttccbbgggb

SEQ ID NO: 1235 - DNA (Genomic DNA), 84 bp; single-stranded, linear
gggcbcggggcbgtgggcgggcbbtgtbggcbbbgcbgcbgggtgtggtgtccgbggbbtbtggggbggcbgbtgcbggbgcgc

SEQ ID NO: 1236 - DNA (Genomic DNA), 78 bp; single-stranded, linear
bgbgggcbgtbgcbbtgbggbtgbcbgcgbggcgtgccgcggbgbccttcbtggtbcctgtggbgbggctgtcggbgg

SEQ ID NO: 1237 - DNA, 70 bp; single-stranded, linear
gggtgtggtgtccgcttggcggttctttcgggtgtttcttctctgggttggcctgctgctcgtcgtggtc

SEQ ID NO: 1238 - DNA, 71 bp; single-stranded, linear
gctccgctcccgggttcgtctcgctctgtcgccccttccttccttgtcgtgttcctcccttccttgcctct

SEQ ID NO: 1239 - DNA, 14 bp; single-stranded, linear
gggtgtggtgtccg

SEQ ID NO: 1240 - DNA, 20 bp; single-stranded, linear
cttggcggttctttcgggtg

SEQ ID NO: 1241 - DNA, 18 bp; single-stranded, linear
tttcttctctgggttggc

SEQ ID NO: 1242 - DNA, 18 bp; single-stranded, linear
ctgctgctcgtcgtggtc

SEQ ID NO: 1243 - DNA, 17 bp; single-stranded, linear
gctccgctcccgggttc

SEQ ID NO: 1244 - DNA, 17 bp; single-stranded, linear
gtctcgctctgtcgccc

SEQ ID NO: 1245 - DNA, 14 bp; single-stranded, linear
cttccttccttgtc

SEQ ID NO: 1246 - DNA, 23 bp; single-stranded, linear
gtgttcctcccttccttgcctct

SEQ ID NO: 1247 - DNA (Genomic DNA), 22 bp; single-stranded, linear
gttcbtggtggctbggtggggc

SEQ ID NO: 1248 - DNA, 26 bp; single-stranded, linear
gctgcccggcggggtgtgcgcttggc

SEQ ID NO: 1249 - DNA, 30 bp; single-stranded, linear
gctcccgtgctcggttctctgtctcccggt

SEQ ID NO: 1250 - DNA, 22 bp; single-stranded, linear
ccccctttgcctggcgtctcgg

SEQ ID NO: 1251 - DNA, 29 bp; single-stranded, linear
gccttcgtcctcttcctcttcttccttcc

SEQ ID NO: 1252 - DNA, 43 bp; single-stranded, linear
gctccgtgggggctgcttggtgggggcctgtgcctcggggtcc

SEQ ID NO: 1253 - DNA, 20 bp; single-stranded, linear
cggggcttctggcccttgcc

SEQ ID NO: 1254 - DNA, 22 bp; single-stranded, linear
gttcatggtggctaggtggggc

SEQ ID NO: 1255 - DNA (Genomic DNA), 24 bp; single-stranded, linear
ggggtgggtbggccgtgtctgggg

SEQ ID NO: 1256 - DNA (Genomic DNA), 19 bp; single-stranded, linear
gttggccbtgttggttgcc

SEQ ID NO: 1257 - DNA, 19 bp; single-stranded, linear
tcttggtggtgcgccgggc

SEQ ID NO: 1258 - DNA, 47 bp; single-stranded, linear
gcgtcttggctttcttctccttcgggccctcgggccggtgcttgtgg

SEQ ID NO: 1259 - DNA, 38 bp; single-stranded, linear
gctcctcccgggcggcctccccgggcgggggcttcttg

SEQ ID NO: 1260 - DNA, 23 bp; single-stranded, linear
gcgctggcgggggggcctcctcc

SEQ ID NO: 1261 - DNA, 37 bp; single-stranded, linear
gctctgtggctgggcgttccttggtgttctgggtggc

SEQ ID NO: 1262 - DNA, 27 bp; single-stranded, linear
tggcgggcgtggtggcctctgtggtgg

SEQ ID NO: 1263 - DNA (Genomic DNA), 19 bp; single-stranded, linear
gggcccgcggctgcbgggg

SEQ ID NO: 1264 - DNA, 18 bp; single-stranded, linear
ttgcctgtctgcttcgtc

SEQ ID NO: 1265 - DNA, 20 bp; single-stranded, linear
ctttgcgctcccgggccgcc

SEQ ID NO: 1266 - DNA, 24 bp; single-stranded, linear
ggggtgggtaggccgtgtctgggg

SEQ ID NO: 1267 - DNA, 19 bp; single-stranded, linear
gttggccatgttggttgcc

SEQ ID NO: 1268 - DNA, 19 bp; single-stranded, linear
gggcccgcggctgcagggg

SEQ ID NO: 1269 - DNA, 17 bp; single-stranded, linear
cggtttcctttgcggtc

SEQ ID NO: 1270 - DNA, 19 bp; single-stranded, linear
ttggcccgggctccgggtg

SEQ ID NO: 1271 - DNA, 23 bp; single-stranded, linear
cccgcccgcccgccggccgccgc

SEQ ID NO: 1272 - DNA, 27 bp; single-stranded, linear
cccgccgggctgtccccgccccgcccc

SEQ ID NO: 1273 - DNA, 17 bp; single-stranded, linear
ggcccggggcgcggggg

SEQ ID NO: 1274 - DNA, 20 bp; single-stranded, linear
cggccctcccgcccctctgg

SEQ ID NO: 1275 - DNA, 17 bp; single-stranded, linear
gccggcgcgggcgtcgg

SEQ ID NO: 1276 - DNA, 37 bp; single-stranded, linear
ccgctcgcgcctggggttccctctcctccccctgtgc

SEQ ID NO: 1277 - DNA, 18 bp; single-stranded, linear
gcctgcctcttgctcttc

SEQ ID NO: 1278 - DNA, 20 bp; single-stranded, linear
tgcgtccgctgccttctccc

SEQ ID NO: 1279 - DNA, 23 bp; single-stranded, linear
ctctcctcggccgttgcctgtgc

SEQ ID NO: 1280 - DNA, 28 bp; single-stranded, linear
tgtccgtcctgtcgcccttccgtggtgc

SEQ ID NO: 1281 - DNA, 19 bp; single-stranded, linear
tgttgtctcttctgccctc

SEQ ID NO: 1282 - DNA, 24 bp; single-stranded, linear
ggtgtgctggtgctggtggtggtg

SEQ ID NO: 1283 - DNA, 18 bp; single-stranded, linear
cctctgcccgtgctcgcc

SEQ ID NO: 1284 - DNA, 24 bp; single-stranded, linear
ctgcctgggctggcctcttcgggt

SEQ ID NO: 1285 - DNA, 30 bp; single-stranded, linear
gtggctttggggctctcttggttgcccttt

SEQ ID NO: 1286 - DNA, 35 bp; single-stranded, linear
cttctcgtggtgcctctcctccctggcttggtcgt

SEQ ID NO: 1287 - DNA, 24 bp; single-stranded, linear
tgtctggggtggtgctcctctccc

SEQ ID NO: 1288 - DNA, 20 bp; single-stranded, linear
tttccctgctggccgtttgt

SEQ ID NO: 1289 - DNA, 20 bp; single-stranded, linear
cctgttttctgtcttcctct

SEQ ID NO: 1290 - DNA, 18 bp; single-stranded, linear
ttcctcctgtttctccgt

SEQ ID NO: 1291 - DNA, 28 bp; single-stranded, linear
ttggcttgctgcttgcggggctgtctcc

SEQ ID NO: 1292 - DNA, 21 bp; single-stranded, linear
cttgcccctgtgggctttccc

SEQ ID NO: 1293 - DNA, 25 bp; single-stranded, linear
tggtccggtcttctccttgggggtc

SEQ ID NO: 1294 - DNA, 18 bp; single-stranded, linear
gcccttcttggtgggctg

SEQ ID NO: 1295 - DNA, 22 bp; single-stranded, linear
gctcgtctgtctttttccttcc

SEQ ID NO: 1296 - DNA, 34 bp; single-stranded, linear
tgggggtggccgttgtgggcggtgtggtccgcct

SEQ ID NO: 1297 - DNA, 18 bp; single-stranded, linear
tgcctctgctggtctttc

SEQ ID NO: 1298 - DNA, 18 bp; single-stranded, linear
gtgctccggtggcttttt

SEQ ID NO: 1299 - DNA, 23 bp; single-stranded, linear
gcttgtgtgctctgctgtctctg

SEQ ID NO: 1300 - DNA, 34 bp; single-stranded, linear
ttccttccggtggtttcttcctggctcttgtcct

SEQ ID NO: 1301 - DNA, 19 bp; single-stranded, linear
ttctcttggcccttggccc

SEQ ID NO: 1302 - DNA, 20 bp; single-stranded, linear
tggctcggtgcttctgcccc

SEQ ID NO: 1303 - DNA, 16 bp; single-stranded, linear
tgttgttgcggcgctc

SEQ ID NO: 1304 - DNA, 17 bp; single-stranded, linear
ggttggtgtggcccctg

SEQ ID NO: 1305 - DNA, 15 bp; single-stranded, linear
tggtgcttcgtttcc

SEQ ID NO: 1306 - DNA, 18 bp; single-stranded, linear
ccctctttctctttgttc

SEQ ID NO: 1307 - DNA, 15 bp; single-stranded, linear
gggggttcttgtggc

SEQ ID NO: 1308 - DNA, 19 bp; single-stranded, linear
gggctgcttgtctcgttcc

SEQ ID NO: 1309 - DNA (Genomic DNA), 20 bp; single-stranded, linear
ggtccbgccbtgggtctggg

SEQ ID NO: 1310 - DNA (Genomic DNA), 20 bp; single-stranded, linear
ggctgggctgcbggctccgg

SEQ ID NO: 1311 - DNA, 27 bp; single-stranded, linear
gcgggcgggtgcgggctgcgtgctggg

SEQ ID NO: 1312 - DNA, 20 bp; single-stranded, linear
ggctgccccgcaggccctgc

SEQ ID NO: 1313 - DNA (Genomic DNA), 115 bp; single-stranded, linear
gcbccgcctggbgccctggggcccccctgtcttcttggggbgcgcctcctcggccbgctccbcgtcccggbtcbtgctttcbgtgctcbtggtgtcctttccbggggbgbgbggg

SEQ ID NO: 1314 - DNA (Genomic DNA), 331 bp; single-stranded, linear
gctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctggcgtggtggtcttgttgcttgggctgggctccgtgtctccbgtgctcbtggtgtcc

SEQ ID NO: 1315 - DNA (Genomic DNA), 373 bp; single-stranded, linear
gctgbgggbgcgtctgctggcgctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctggcgtggtggtcttgttgcttgggctgggctccgtgtctccbgtgctcbtggtgtccgctgbgggbgcgtctgctggc

SEQ ID NO: 1316 - DNA, 25 bp; single-stranded, linear
gccccgtctgctgctcctcgtgccg

SEQ ID NO: 1317 - DNA, 33 bp; single-stranded, linear
cctcgtccttcatggtaccgtcggtgtggtggc

SEQ ID NO: 1318 - DNA, 19 bp; single-stranded, linear
ctcgggtgggccggtggtg

SEQ ID NO: 1319 - DNA, 18 bp; single-stranded, linear
gggcgcgcgcgctcgcgt

SEQ ID NO: 1320 - DNA, 49 bp; single-stranded, linear
ggctccggctcttctttcccggctccgtcggcccgggggccttggtctc

SEQ ID NO: 1321 - DNA (Genomic DNA), 20 bp; single-stranded, linear
cctcgtccttcbtggtbccg

SEQ ID NO: 1322 - DNA, 16 bp; single-stranded, linear
cccgttcgcctggcgc

SEQ ID NO: 1323 - DNA, 16 bp; single-stranded, linear
gcgctgcgggttcctc

SEQ ID NO: 1324 - DNA, 23 bp; single-stranded, linear
gtgggtttctccccgccgttctc

SEQ ID NO: 1325 - DNA, 20 bp; single-stranded, linear
cggtctgttgcctttgtggg

SEQ ID NO: 1326 - DNA, 18 bp; single-stranded, linear
cttcttgtctttttggct

SEQ ID NO: 1327 - DNA, 18 bp; single-stranded, linear
gttcttttcctgcttggc

SEQ ID NO: 1328 - DNA, 15 bp; single-stranded, linear
gtcttttcctttctt

SEQ ID NO: 1329 - DNA, 18 bp; single-stranded, linear
tgtgctcggttgtgggtc

SEQ ID NO: 1330 - DNA, 15 bp; single-stranded, linear
cgctggtcctttgcc

SEQ ID NO: 1331 - DNA, 16 bp; single-stranded, linear
ctgtgtgtttctgctg

SEQ ID NO: 1332 - DNA, 16 bp; single-stranded, linear
cccgttcgcctggcgc

SEQ ID NO: 1333 - DNA, 16 bp; single-stranded, linear
gcgctgcgggttcctc

SEQ ID NO: 1334 - DNA, 23 bp; single-stranded, linear
gtgggtttctccccgccgttctc

SEQ ID NO: 1335 - DNA, 20 bp; single-stranded, linear
cggtctgttgcctttgtggg

SEQ ID NO: 1336 - DNA, 18 bp; single-stranded, linear
cttcttgtctttttggct

SEQ ID NO: 1337 - DNA, 18 bp; single-stranded, linear
gttcttttcctgcttggc

SEQ ID NO: 1338 - DNA, 15 bp; single-stranded, linear
gtcttttcctttctt

SEQ ID NO: 1339 - DNA, 18 bp; single-stranded, linear
tgtgctcggttgtgggtc

SEQ ID NO: 1340 - DNA, 15 bp; single-stranded, linear
cgctggtcctttgcc

SEQ ID NO: 1341 - DNA, 16 bp; single-stranded, linear
ctgtgtgtttctgctg

SEQ ID NO: 1342 - DNA, 18 bp; single-stranded, linear
gcgtccggtggccgccgc

SEQ ID NO: 1343 - DNA, 17 bp; single-stranded, linear
gcctctctcctctcccc

SEQ ID NO: 1344 - DNA, 18 bp; single-stranded, linear
gtggccctgtcgggcggg

SEQ ID NO: 1345 - DNA, 21 bp; single-stranded, linear
tcctgccgtcctgtctccttt

SEQ ID NO: 1346 - DNA, 16 bp; single-stranded, linear
tcttttgctgtcttgt

SEQ ID NO: 1347 - DNA, 17 bp; single-stranded, linear
cttcccgtctctgcttt

SEQ ID NO: 1348 - DNA, 23 bp; single-stranded, linear
gtctgtcctccccgtctcctccc

SEQ ID NO: 1349 - DNA, 16 bp; single-stranded, linear
actgcttctcccgggg

SEQ ID NO: 1350 - DNA, 14 bp; single-stranded, linear
gcttccccggcttc

SEQ ID NO: 1351 - DNA, 34 bp; single-stranded, linear
gggtggccggtgtcccgggctccggcgcggcggc

SEQ ID NO: 1352 - DNA, 12 bp; single-stranded, linear
ggcttcggctgc

SEQ ID NO: 1353 - DNA, 15 bp; single-stranded, linear
gggtgggtggcgcgg

SEQ ID NO: 1354 - DNA, 28 bp; single-stranded, linear
gctgccgggtccgcgcggcgcctgggcc

SEQ ID NO: 1355 - DNA, 14 bp; single-stranded, linear
cttgtgctgctttt

SEQ ID NO: 1356 - DNA, 14 bp; single-stranded, linear
tgcttgttccgttc

SEQ ID NO: 1357 - DNA, 32 bp; single-stranded, linear
tggctgctccggtctgtgttgtggttgttttg

SEQ ID NO: 1358 - DNA, 18 bp; single-stranded, linear
tttcttcttgggtgtggg

SEQ ID NO: 1359 - DNA, 14 bp; single-stranded, linear
ccttgcggttttgg

SEQ ID NO: 1360 - DNA, 14 bp; single-stranded, linear
ctgtgggccctttg

SEQ ID NO: 1361 - DNA, 19 bp; single-stranded, linear
gggccttggcttctggctc

SEQ ID NO: 1362 - DNA, 125 bp; single-stranded, linear
catccacatgattgcttagatttgtgctgtatctctcaggattatcactgattacacatccaaccagtgccagccaaaaggatgccctgaggcaaagggtttccatcttgaggcaaatttgagga

SEQ ID NO: 1363 - DNA (Genomic DNA), 125 bp; single-stranded, linear
cbtccbcbtgbttgcttbgbtttgtgctgtbtctctcbggbttbtcbctgbttbcbcbtccbbccbgtgccbgccbbbbggbtgccctgbggcbbbgggtttccbtcttgbggcbbbtttgbggb

SEQ ID NO: 1364 - DNA, 14 bp; single-stranded, linear
cgtggtcgctccgc

SEQ ID NO: 1365 - DNA, 18 bp; single-stranded, linear
gtttctctggttcctccg

SEQ ID NO: 1366 - DNA, 16 bp; single-stranded, linear
gtcccgcggggtgctg

SEQ ID NO: 1367 - DNA, 15 bp; single-stranded, linear
tctggtcgctgtcgt

SEQ ID NO: 1368 - DNA, 18 bp; single-stranded, linear
ggcttgggtctccgggcg

SEQ ID NO: 1369 - DNA, 18 bp; single-stranded, linear
gtttccttccttttccgc

SEQ ID NO: 1370 - DNA, 24 bp; single-stranded, linear
gtcctgtcgtggcgcctggggctc

SEQ ID NO: 1371 - DNA, 14 bp; single-stranded, linear
ttcttttgtgggct

SEQ ID NO: 1372 - DNA, 18 bp; single-stranded, linear
ctttggtggctgtggctg

SEQ ID NO: 1373 - DNA, 15 bp; single-stranded, linear
tggtctctgtggttg

SEQ ID NO: 1374 - DNA, 15 bp; single-stranded, linear
ctgccctgggtctgg

SEQ ID NO: 1375 - DNA, 46 bp; single-stranded, linear
gggtgtggccttggggccgtcctctggctcctcctcgtgggccccc

SEQ ID NO: 1376 - DNA, 265 bp; single-stranded, linear
gggctaagatgatccacatcactaccacgttgcccaccacagaggtcaccacaatgaccgtgtaggcagctgcccaaaggacaatttgccaggctggttgcacgaactgattgggttccgaggtgttagtggagatgtttggggagaggtctgagtccaccgggaggacgttatccatttcgaagctaggcggtaaagccctactatctgtacacaacccccctctgcagcagagtcctgtcgtggcgcctggggctcagggtcc

SEQ ID NO: 1377 - DNA (Genomic DNA), 265 bp; single-stranded, linear
gggctbbgbtgbtccbcbtcbctbccbcgttgcccbccbcbgbggtcbccbcbbtgbccgtgtbggcbgctgcccbbbggbcbbtttgccbggctggttgcbcgbbctgbttgggttccgbggtgttbgtggbgbtgtttggggbgbggtctgbgtccbccgggbggbcgttbtccbtttcgbbgctbggcggtbbbgccctbctbtctgtbcbcbbcccccctctgcbgcbgbgtcctgtcgtggcgcctggggctcbgggtcc

SEQ ID NO: 1378 - DNA, 14 bp; single-stranded, linear
cgttttcttctctc

SEQ ID NO: 1379 - DNA, 16 bp; single-stranded, linear
gctggttttcctttcc

SEQ ID NO: 1380 - DNA, 31 bp; single-stranded, linear
tggcagtgggtgggggtgggggtggggtggc

SEQ ID NO: 1381 - DNA, 23 bp; single-stranded, linear
ttccttgttcctgggggtgtcct

SEQ ID NO: 1382 - DNA, 18 bp; single-stranded, linear
cttgctctgggcttttct

SEQ ID NO: 1383 - DNA, 14 bp; single-stranded, linear
ccccttttccttcc

SEQ ID NO: 1384 - DNA, 17 bp; single-stranded, linear
tgtctgttttcctgggg

SEQ ID NO: 1385 - DNA, 19 bp; single-stranded, linear
ctctcctctgtctctgtgt

SEQ ID NO: 1386 - DNA, 14 bp; single-stranded, linear
ccttgccctggccc

SEQ ID NO: 1387 - DNA, 22 bp; single-stranded, linear
tcttccctctcctgtctcctgt

SEQ ID NO: 1388 - DNA, 15 bp; single-stranded, linear
ccctgtgttccgccc

SEQ ID NO: 1389 - DNA, 15 bp; single-stranded, linear
gtcttccctctcctg

SEQ ID NO: 1390 - DNA, 16 bp; single-stranded, linear
acctccttttcctccg

SEQ ID NO: 1391 - DNA, 15 bp; single-stranded, linear
ctgggtggggccctg

SEQ ID NO: 1392 - DNA, 16 bp; single-stranded, linear
cctgttctctgctccc

SEQ ID NO: 1393 - DNA, 19 bp; single-stranded, linear
tggcttggggtttcttctg

SEQ ID NO: 1394 - DNA, 19 bp; single-stranded, linear
tgtgtcttcttcctctgtt

SEQ ID NO: 1395 - DNA, 17 bp; single-stranded, linear
ggctggctttctccttc

SEQ ID NO: 1396 - DNA, 15 bp; single-stranded, linear
ttttgtcttcctggg

SEQ ID NO: 1397 - DNA, 22 bp; single-stranded, linear
tgccccttcttcctttcttggg

SEQ ID NO: 1398 - DNA, 20 bp; single-stranded, linear
tccttggtgcttgggctggg

SEQ ID NO: 1399 - DNA, 19 bp; single-stranded, linear
ctgtgcgtccgtctgctgg

SEQ ID NO: 1400 - DNA, 31 bp; single-stranded, linear
ggggccggggtggctgggccctgcttgccgc

SEQ ID NO: 1401 - DNA, 21 bp; single-stranded, linear
acgaccccgggccgacccgag

SEQ ID NO: 1402 - DNA, 31 bp; single-stranded, linear
gctcggggggctgtgttctggcgctggtggg

SEQ ID NO: 1403 - DNA, 25 bp; single-stranded, linear
cttgggcccctctgggggctgggtt

SEQ ID NO: 1404 - DNA, 21 bp; single-stranded, linear
tcctgctgcgcctgggcgctg

SEQ ID NO: 1405 - DNA, 14 bp; single-stranded, linear
gcgtcttggggtgc

SEQ ID NO: 1406 - DNA, 19 bp; single-stranded, linear
ggggccggggggccggggg

SEQ ID NO: 1407 - DNA, 21 bp; single-stranded, linear
gccgctgttcgtgggcctggg

SEQ ID NO: 1408 - DNA, 16 bp; single-stranded, linear
ggtgcctgtggctgcc

SEQ ID NO: 1409 - DNA, 19 bp; single-stranded, linear
ggttgccccggttggtggc

SEQ ID NO: 1410 - DNA, 17 bp; single-stranded, linear
gccgtcctgctgccggt

SEQ ID NO: 1411 - DNA, 20 bp; single-stranded, linear
cgttggctgggtccccccgc

SEQ ID NO: 1412 - DNA, 16 bp; single-stranded, linear
ccgtttcctggggtcc

SEQ ID NO: 1413 - DNA, 14 bp; single-stranded, linear
gcgtggggtgctcc

SEQ ID NO: 1414 - DNA, 14 bp; single-stranded, linear
ggttcctcgtgccg

SEQ ID NO: 1415 - DNA, 18 bp; single-stranded, linear
ctgctgccttgtctttcc

SEQ ID NO: 1416 - DNA, 22 bp; single-stranded, linear
ggccgtggcggcgtggtggtcc

SEQ ID NO: 1417 - DNA, 21 bp; single-stranded, linear
gccccccctggccttctgctc

SEQ ID NO: 1418 - DNA, 14 bp; single-stranded, linear
ggggtctggctggt

SEQ ID NO: 1419 - DNA, 19 bp; single-stranded, linear
tgccggtgcccttggcggc

SEQ ID NO: 1420 - DNA, 16 bp; single-stranded, linear
ggtcttcttcctggtg

SEQ ID NO: 1421 - DNA, 23 bp; single-stranded, linear
gctctgggcccggccggtctcgg

SEQ ID NO: 1422 - DNA, 14 bp; single-stranded, linear
gcgtctcgtgttcg

SEQ ID NO: 1423 - DNA, 20 bp; single-stranded, linear
ctcttgtgctgttccggccg

SEQ ID NO: 1424 - DNA, 20 bp; single-stranded, linear
ctccttcctcttccgccgcc

SEQ ID NO: 1425 - DNA, 14 bp; single-stranded, linear
gccgctccccgccc

SEQ ID NO: 1426 - DNA, 17 bp; single-stranded, linear
gctcgtcgccctggccc

SEQ ID NO: 1427 - DNA, 17 bp; single-stranded, linear
ggcctcctcctggccgc

SEQ ID NO: 1428 - DNA, 22 bp; single-stranded, linear
tgtctcgggcggcggccttggc

SEQ ID NO: 1429 - DNA, 16 bp; single-stranded, linear
gctccgtttggggctg

SEQ ID NO: 1430 - DNA, 14 bp; single-stranded, linear
cctctggcgcttcc

SEQ ID NO: 1431 - DNA, 20 bp; single-stranded, linear
ggccctcggcctgggcgctc

SEQ ID NO: 1432 - DNA, 14 bp; single-stranded, linear
tcttccgcctgtgc

SEQ ID NO: 1433 - DNA, 15 bp; single-stranded, linear
tggtggccctcgtgg

SEQ ID NO: 1434 - DNA, 23 bp; single-stranded, linear
gcccctcctggcctccggtgtcc

SEQ ID NO: 1435 - DNA, 18 bp; single-stranded, linear
tgtggtcccccggctggt

SEQ ID NO: 1436 - DNA, 21 bp; single-stranded, linear
ggccgggccggttgggcgggc

SEQ ID NO: 1437 - DNA, 21 bp; single-stranded, linear
gtgggcgccggcgggtcctcc

SEQ ID NO: 1438 - DNA, 15 bp; single-stranded, linear
gggctgcccttctcc

SEQ ID NO: 1439 - DNA, 14 bp; single-stranded, linear
gccgggggtcccgc

SEQ ID NO: 1440 - DNA, 29 bp; single-stranded, linear
gctcctgctgttccctgggctcttctgcc

SEQ ID NO: 1441 - DNA, 27 bp; single-stranded, linear
tctctcctgggtgggtgctgggtgccg

SEQ ID NO: 1442 - DNA, 15 bp; single-stranded, linear
gggtctccgggcttg

SEQ ID NO: 1443 - DNA, 23 bp; single-stranded, linear
ccccgcgctgctgggcgttctgc

SEQ ID NO: 1444 - DNA, 15 bp; single-stranded, linear
ggtcttggggttgtc

SEQ ID NO: 1445 - DNA, 14 bp; single-stranded, linear
tgtggccccgctcg

SEQ ID NO: 1446 - DNA, 17 bp; single-stranded, linear
tgtcgccctccgtcgcc

SEQ ID NO: 1447 - DNA, 17 bp; single-stranded, linear
cgtcgccggcctcgtcc

SEQ ID NO: 1448 - DNA, 14 bp; single-stranded, linear
cctcctgggtgcgc

SEQ ID NO: 1449 - DNA, 14 bp; single-stranded, linear
ggcgggctggtcct

SEQ ID NO: 1450 - DNA, 20 bp; single-stranded, linear
ggcgttttgctccttcctgg

SEQ ID NO: 1451 - DNA, 15 bp; single-stranded, linear
ctgcctccccggggt

SEQ ID NO: 1452 - DNA, 15 bp; single-stranded, linear
ttctgctgcttgctg

SEQ ID NO: 1453 - DNA, 16 bp; single-stranded, linear
cttctttcccgtctcc

SEQ ID NO: 1454 - DNA, 16 bp; single-stranded, linear
cttctttcccgtctcc

SEQ ID NO: 1455 - DNA, 14 bp; single-stranded, linear
tttttgcctctttg

SEQ ID NO: 1456 - DNA, 16 bp; single-stranded, linear
ggttcctgttgtttct

SEQ ID NO: 1457 - DNA, 16 bp; single-stranded, linear
ggcctgcttggtggcg

SEQ ID NO: 1458 - DNA, 14 bp; single-stranded, linear
gcttgtgcgtttcc

SEQ ID NO: 1459 - DNA, 36 bp; single-stranded, linear
tctctcttctcttgggtctccgcttctcgtcctgcc

SEQ ID NO: 1460 - DNA, 18 bp; single-stranded, linear
ttttcctgtctctgtcgc

SEQ ID NO: 1461 - DNA, 14 bp; single-stranded, linear
gccgttcctcctcc

SEQ ID NO: 1462 - DNA, 15 bp; single-stranded, linear
ggcgtcctcctgccc

SEQ ID NO: 1463 - DNA, 17 bp; single-stranded, linear
tgtgctgtttgcctcgg

SEQ ID NO: 1464 - DNA, 14 bp; single-stranded, linear
gtggtgcgggtccc

SEQ ID NO: 1465 - DNA, 14 bp; single-stranded, linear
ggtgctcccccggc

SEQ ID NO: 1466 - DNA, 21 bp; single-stranded, linear
gggccggctggttgcctgggc

SEQ ID NO: 1467 - DNA, 22 bp; single-stranded, linear
ctgtctggtggggtgtggggcc

SEQ ID NO: 1468 - DNA, 20 bp; single-stranded, linear
gctgggttgggggtgtggtg

SEQ ID NO: 1469 - DNA, 15 bp; single-stranded, linear
ggctcttctgtggcc

SEQ ID NO: 1470 - DNA, 16 bp; single-stranded, linear
tgtggggctgttggtg

SEQ ID NO: 1471 - DNA, 16 bp; single-stranded, linear
tctctgtgggcgtgtg

SEQ ID NO: 1472 - DNA, 17 bp; single-stranded, linear
ctgggtcttggggcttc

SEQ ID NO: 1473 - DNA, 15 bp; single-stranded, linear
ctcccttgtgctggg

SEQ ID NO: 1474 - DNA, 14 bp; single-stranded, linear
tgcggcctccccgc

SEQ ID NO: 1475 - DNA, 14 bp; single-stranded, linear
cccccttctgggcc

SEQ ID NO: 1476 - DNA, 20 bp; single-stranded, linear
ggtggcctggctccttgtgg

SEQ ID NO: 1477 - DNA, 16 bp; single-stranded, linear
gcgcttctggctcttg

SEQ ID NO: 1478 - DNA, 21 bp; single-stranded, linear
ccctgtccttcttcgcctcgt

SEQ ID NO: 1479 - DNA, 14 bp; single-stranded, linear
ggctgctgggctgc

SEQ ID NO: 1480 - DNA, 17 bp; single-stranded, linear
gttgggcttggccgggg

SEQ ID NO: 1481 - DNA, 15 bp; single-stranded, linear
ctgcccggtgcctcc

SEQ ID NO: 1482 - DNA, 18 bp; single-stranded, linear
tcttggctggtccctcgt

SEQ ID NO: 1483 - DNA, 14 bp; single-stranded, linear
tgtccttgggcccc

SEQ ID NO: 1484 - DNA, 22 bp; single-stranded, linear
gctcccgctgctcggcctccgt

SEQ ID NO: 1485 - DNA, 20 bp; single-stranded, linear
gttctttggcctcttgctcc

SEQ ID NO: 1486 - DNA, 16 bp; single-stranded, linear
gcctgctgtcttgtcc

SEQ ID NO: 1487 - DNA, 23 bp; single-stranded, linear
cgtcccctcctcgcttgcgtttc

SEQ ID NO: 1488 - DNA (cDNA), 18 bp; single-stranded, linear
cctcttccttgtcttcca

SEQ ID NO: 1489 - DNA (cDNA), 22 bp; single-stranded, linear
ggccttcctccgcttccgctgc

SEQ ID NO: 1490 - DNA (cDNA), 15 bp; single-stranded, linear
tggggcccgcgccgg

SEQ ID NO: 1491 - DNA (cDNA), 32 bp; single-stranded, linear
gggggcgctcggctccgcggcttcctccccgg

SEQ ID NO: 1492 - DNA (cDNA), 14 bp; single-stranded, linear
ctggggggtcctgg

SEQ ID NO: 1493 - DNA (cDNA), 21 bp; single-stranded, linear
tctccggggcctgcggctcgc

SEQ ID NO: 1494 - DNA (cDNA), 21 bp; single-stranded, linear
gggctcggggctgcgtgcgcc

SEQ ID NO: 1495 - DNA (cDNA), 19 bp; single-stranded, linear
gcgcgcggcgtccgcggtg

SEQ ID NO: 1496 - DNA (cDNA), 17 bp; single-stranded, linear
ggtggcgctgtcccgcc

SEQ ID NO: 1497 - DNA (cDNA), 32 bp; single-stranded, linear
gtggtgtgtctccgttctcgtcctgcgccgtc

SEQ ID NO: 1498 - DNA (cDNA), 15 bp; single-stranded, linear
ctggtctgcccgtgg

SEQ ID NO: 1499 - DNA (cDNA), 17 bp; single-stranded, linear
ggtcctgggcgtggtgg

SEQ ID NO: 1500 - DNA (cDNA), 14 bp; single-stranded, linear
ggggcgtctggtgc

SEQ ID NO: 1501 - DNA (cDNA), 15 bp; single-stranded, linear
ctcgtctgccccgtg

SEQ ID NO: 1502 - DNA (cDNA), 15 bp; single-stranded, linear
gggcttcgggctcgg

SEQ ID NO: 1503 - DNA, 34 bp; single-stranded, linear
ggctgttcgtcccccctgccgctctgtggcctcc

SEQ ID NO: 1504 - DNA, 16 bp; single-stranded, linear
ggggctcctcgttttc

SEQ ID NO: 1505 - DNA, 21 bp; single-stranded, linear
gctgcttcgggtgtccttctc

SEQ ID NO: 1506 - DNA, 15 bp; single-stranded, linear
ggcgtgtggccccgg

SEQ ID NO: 1507 - DNA, 29 bp; single-stranded, linear
gtcccggccctgctgggctgggcggggtc

SEQ ID NO: 1508 - DNA, 25 bp; single-stranded, linear
gctgccctgggcttctggcccgtct

SEQ ID NO: 1509 - DNA, 14 bp; single-stranded, linear
ggttgtctgtcggt

SEQ ID NO: 1510 - DNA, 19 bp; single-stranded, linear
gcttgtctcgggtttctgg

SEQ ID NO: 1511 - DNA, 14 bp; single-stranded, linear
cctctgtgctgggc

SEQ ID NO: 1512 - DNA, 20 bp; single-stranded, linear
gcttctctgcctcctgctcc

SEQ ID NO: 1513 - DNA, 16 bp; single-stranded, linear
gccctcctggtggctc

SEQ ID NO: 1514 - DNA, 19 bp; single-stranded, linear
ggctgggggtgcccgtgcg

SEQ ID NO: 1515 - DNA, 19 bp; single-stranded, linear
ggggtgggtgtggggtgtt

SEQ ID NO: 1516 - DNA, 20 bp; single-stranded, linear
ttcggggtcctccccttccc

SEQ ID NO: 1517 - DNA, 20 bp; single-stranded, linear
gtttcatcttggctttatcc

SEQ ID NO: 1518 - DNA, 19 bp; single-stranded, linear
tctccccttgttcctcccc

SEQ ID NO: 1519 - DNA, 22 bp; single-stranded, linear
tctcctgctctggrgtctcctc

SEQ ID NO: 1520 - DNA, 18 bp; single-stranded, linear
ttccctccctcccctgcc

SEQ ID NO: 1521 - DNA, 19 bp; single-stranded, linear
gtgttgtctgtgggtgtcc

SEQ ID NO: 1522 - DNA, 18 bp; single-stranded, linear
gtttcgctcttgttgccc

SEQ ID NO: 1523 - DNA, 18 bp; single-stranded, linear
tgggcccttccctgctgg

SEQ ID NO: 1524 - DNA, 18 bp; single-stranded, linear
gggggagtttcatcttgg

SEQ ID NO: 1525 - DNA, 22 bp; single-stranded, linear
gggggbgtttcbtcttggcttt

SEQ ID NO: 1526 - DNA, 21 bp; single-stranded, linear
gggggbgtttcbtcttggctt

SEQ ID NO: 1527 - DNA, 20 bp; single-stranded, linear
gggggbgtttcbtcttggct

SEQ ID NO: 1528 - DNA, 19 bp; single-stranded, linear
gggggbgtttcbtcttggc

SEQ ID NO: 1529 - DNA, 18 bp; single-stranded, linear
gggggbgtttcbtcttgg

SEQ ID NO: 1530 - DNA, 17 bp; single-stranded, linear
gggggbgtttcbtcttg

SEQ ID NO: 1531 - DNA, 16 bp; single-stranded, linear
gggggbgtttcbtctt

SEQ ID NO: 1532 - DNA, 15 bp; single-stranded, linear
gggggbgtttcbtct

SEQ ID NO: 1533 - DNA, 14 bp; single-stranded, linear
gggggbgtttcbtc

SEQ ID NO: 1534 - DNA, 13 bp; single-stranded, linear
gggggbgtttcbt

SEQ ID NO: 1535 - DNA, 12 bp; single-stranded, linear
gggggbgtttcb

SEQ ID NO: 1536 - DNA, 21 bp; single-stranded, linear
ggggbgtttcbtcttggcttt

SEQ ID NO: 1537 - DNA, 20 bp; single-stranded, linear
ggggbgtttcbtcttggctt

SEQ ID NO: 1538 - DNA, 19 bp; single-stranded, linear
ggggbgtttcbtcttggct

SEQ ID NO: 1539 - DNA, 18 bp; single-stranded, linear
ggggbgtttcbtcttggc

SEQ ID NO: 1540 - DNA, 17 bp; single-stranded, linear
ggggbgtttcbtcttgg

SEQ ID NO: 1541 - DNA, 16 bp; single-stranded, linear
ggggbgtttcbtcttg

SEQ ID NO: 1542 - DNA, 15 bp; single-stranded, linear
ggggbgtttcbtctt

SEQ ID NO: 1543 - DNA, 14 bp; single-stranded, linear
ggggbgtttcbtct

SEQ ID NO: 1544 - DNA, 13 bp; single-stranded, linear
ggggbgtttcbtc

SEQ ID NO: 1545 - DNA, 12 bp; single-stranded, linear
ggggbgtttcbt

SEQ ID NO: 1546 - DNA, 20 bp; single-stranded, linear
gggbgtttcbtcttggcttt

SEQ ID NO: 1547 - DNA, 19 bp; single-stranded, linear
gggbgtttcbtcttggctt

SEQ ID NO: 1548 - DNA, 18 bp; single-stranded, linear
gggbgtttcbtcttggct

SEQ ID NO: 1549 - DNA, 17 bp; single-stranded, linear
gggbgtttcbtcttggc

SEQ ID NO: 1550 - DNA, 16 bp; single-stranded, linear
gggbgtttcbtcttgg

SEQ ID NO: 1551 - DNA, 15 bp; single-stranded, linear
gggbgtttcbtcttg

SEQ ID NO: 1552 - DNA, 14 bp; single-stranded, linear
gggbgtttcbtctt

SEQ ID NO: 1553 - DNA, 13 bp; single-stranded, linear
gggbgtttcbtct

SEQ ID NO: 1554 - DNA, 12 bp; single-stranded, linear
gggbgtttcbtc

SEQ ID NO: 1555 - DNA, 19 bp; single-stranded, linear
ggbgtttcbtcttggcttt

SEQ ID NO: 1556 - DNA, 18 bp; single-stranded, linear
ggbgtttcbtcttggctt

SEQ ID NO: 1557 - DNA, 17 bp; single-stranded, linear
ggbgtttcbtcttggct

SEQ ID NO: 1558 - DNA, 16 bp; single-stranded, linear
ggbgtttcbtcttggc

SEQ ID NO: 1559 - DNA, 15 bp; single-stranded, linear
ggbgtttcbtcttgg

SEQ ID NO: 1560 - DNA, 14 bp; single-stranded, linear
ggbgtttcbtcttg

SEQ ID NO: 1561 - DNA, 13 bp; single-stranded, linear
ggbgtttcbtctt

SEQ ID NO: 1562 - DNA, 12 bp; single-stranded, linear
ggbgtttcbtct

SEQ ID NO: 1563 - DNA, 18 bp; single-stranded, linear
gbgtttcbtcttggcttt

SEQ ID NO: 1564 - DNA, 17 bp; single-stranded, linear
gbgtttcbtcttggctt

SEQ ID NO: 1565 - DNA, 16 bp; single-stranded, linear
gbgtttcbtcttggct

SEQ ID NO: 1566 - DNA, 15 bp; single-stranded, linear
gbgtttcbtcttggc

SEQ ID NO: 1567 - DNA, 14 bp; single-stranded, linear
gbgtttcbtcttgg

SEQ ID NO: 1568 - DNA, 13 bp; single-stranded, linear
gbgtttcbtcttg

SEQ ID NO: 1569 - DNA, 12 bp; single-stranded, linear
gbgtttcbtctt

SEQ ID NO: 1570 - DNA, 17 bp; single-stranded, linear
bgtttcbtcttggcttt

SEQ ID NO: 1571 - DNA, 16 bp; single-stranded, linear
bgtttcbtcttggctt

SEQ ID NO: 1572 - DNA, 16 bp; single-stranded, linear
bgtttcbtcttggctt

SEQ ID NO: 1573 - DNA, 15 bp; single-stranded, linear
bgtttcbtcttggct

SEQ ID NO: 1574 - DNA, 14 bp; single-stranded, linear
bgtttcbtcttggc

SEQ ID NO: 1575 - DNA, 13 bp; single-stranded, linear
bgtttcbtcttgg

SEQ ID NO: 1576 - DNA, 12 bp; single-stranded, linear
bgtttcbtcttg

SEQ ID NO: 1577 - DNA, 16 bp; single-stranded, linear
gtttcbtcttggcttt

SEQ ID NO: 1578 - DNA, 15 bp; single-stranded, linear
gtttcbtcttggctt

SEQ ID NO: 1579 - DNA, 14 bp; single-stranded, linear
gtttcbtcttggct

SEQ ID NO: 1580 - DNA, 13 bp; single-stranded, linear
gtttcbtcttggc

SEQ ID NO: 1581 - DNA, 12 bp; single-stranded, linear
gtttcbtcttgg

SEQ ID NO: 1582 - DNA, 15 bp; single-stranded, linear
tttcbtcttggcttt

SEQ ID NO: 1583 - DNA, 14 bp; single-stranded, linear
tttcbtcttggctt

SEQ ID NO: 1584 - DNA, 13 bp; single-stranded, linear
tttcbtcttggct

SEQ ID NO: 1585 - DNA, 12 bp; single-stranded, linear
tttcbtcttggc

SEQ ID NO: 1586 - DNA, 14 bp; single-stranded, linear
ttcbtcttggcttt

SEQ ID NO: 1587 - DNA, 13 bp; single-stranded, linear
ttcbtcttggctt

SEQ ID NO: 1588 - DNA, 12 bp; single-stranded, linear
ttcbtcttggct

SEQ ID NO: 1589 - DNA, 13 bp; single-stranded, linear
tcbtcttggcttt

SEQ ID NO: 1590 - DNA, 12 bp; single-stranded, linear
tcbtcttggctt

SEQ ID NO: 1591 - DNA, 22 bp; single-stranded, linear
gggggbgtttcbtcttggcttt

SEQ ID NO: 1592 - DNA, 21 bp; single-stranded, linear
ggggbgtttcbtcttggcttt

SEQ ID NO: 1593 - DNA, 20 bp; single-stranded, linear
gggbgtttcbtcttggcttt

SEQ ID NO: 1594 - DNA, 19 bp; single-stranded, linear
ggbgtttcbtcttggcttt

SEQ ID NO: 1595 - DNA, 18 bp; single-stranded, linear
gbgtttcbtcttggcttt

SEQ ID NO: 1596 - DNA, 17 bp; single-stranded, linear
bgtttcbtcttggcttt

SEQ ID NO: 1597 - DNA, 16 bp; single-stranded, linear
gtttcbtcttggcttt

SEQ ID NO: 1598 - DNA, 15 bp; single-stranded, linear
tttcbtcttggcttt

SEQ ID NO: 1599 - DNA, 14 bp; single-stranded, linear
ttcbtcttggcttt

SEQ ID NO: 1600 - DNA, 13 bp; single-stranded, linear
tcbtcttggcttt

SEQ ID NO: 1601 - DNA, 12 bp; single-stranded, linear
cbtcttggcttt

SEQ ID NO: 1602 - DNA, 21 bp; single-stranded, linear
gggggbgtttcbtcttggctt

SEQ ID NO: 1603 - DNA, 20 bp; single-stranded, linear
ggggbgtttcbtcttggctt

SEQ ID NO: 1604 - DNA, 19 bp; single-stranded, linear
gggbgtttcbtcttggctt

SEQ ID NO: 1605 - DNA, 18 bp; single-stranded, linear
ggbgtttcbtcttggctt

SEQ ID NO: 1606 - DNA, 17 bp; single-stranded, linear
gbgtttcbtcttggctt

SEQ ID NO: 1607 - DNA, 16 bp; single-stranded, linear
bgtttcbtcttggctt

SEQ ID NO: 1608 - DNA, 15 bp; single-stranded, linear
gtttcbtcttggctt

SEQ ID NO: 1609 - DNA, 14 bp; single-stranded, linear
tttcbtcttggctt

SEQ ID NO: 1610 - DNA, 13 bp; single-stranded, linear
ttcbtcttggctt

SEQ ID NO: 1611 - DNA, 12 bp; single-stranded, linear
tcbtcttggctt

SEQ ID NO: 1612 - DNA, 20 bp; single-stranded, linear
gggggbgtttcbtcttggct

SEQ ID NO: 1613 - DNA, 19 bp; single-stranded, linear
ggggbgtttcbtcttggct

SEQ ID NO: 1614 - DNA, 18 bp; single-stranded, linear
gggbgtttcbtcttggct

SEQ ID NO: 1615 - DNA, 17 bp; single-stranded, linear
ggbgtttcbtcttggct

SEQ ID NO: 1616 - DNA, 16 bp; single-stranded, linear
gbgtttcbtcttggct

SEQ ID NO: 1617 - DNA, 15 bp; single-stranded, linear
bgtttcbtcttggct

SEQ ID NO: 1618 - DNA, 14 bp; single-stranded, linear
gtttcbtcttggct

SEQ ID NO: 1619 - DNA, 13 bp; single-stranded, linear
tttcbtcttggct

SEQ ID NO: 1620 - DNA, 12 bp; single-stranded, linear
ttcbtcttggct

SEQ ID NO: 1621 - DNA, 19 bp; single-stranded, linear
gggggbgtttcbtcttggc

SEQ ID NO: 1622 - DNA, 18 bp; single-stranded, linear
ggggbgtttcbtcttggc

SEQ ID NO: 1623 - DNA, 17 bp; single-stranded, linear
gggbgtttcbtcttggc

SEQ ID NO: 1624 - DNA, 16 bp; single-stranded, linear
ggbgtttcbtcttggc

SEQ ID NO: 1625 - DNA, 15 bp; single-stranded, linear
gbgtttcbtcttggc

SEQ ID NO: 1626 - DNA, 14 bp; single-stranded, linear
bgtttcbtcttggc

SEQ ID NO: 1627 - DNA, 13 bp; single-stranded, linear
gtttcbtcttggc

SEQ ID NO: 1628 - DNA, 12 bp; single-stranded, linear
tttcbtcttggc

SEQ ID NO: 1629 - DNA, 18 bp; single-stranded, linear
gggggbgtttcbtcttgg

SEQ ID NO: 1630 - DNA, 17 bp; single-stranded, linear
ggggbgtttcbtcttgg

SEQ ID NO: 1631 - DNA, 16 bp; single-stranded, linear
gggbgtttcbtcttgg

SEQ ID NO: 1632 - DNA, 15 bp; single-stranded, linear
ggbgtttcbtcttgg

SEQ ID NO: 1633 - DNA, 14 bp; single-stranded, linear
gbgtttcbtcttgg

SEQ ID NO: 1634 - DNA, 13 bp; single-stranded, linear
bgtttcbtcttgg

SEQ ID NO: 1635 - DNA, 12 bp; single-stranded, linear
gtttcbtcttgg

SEQ ID NO: 1636 - DNA, 17 bp; single-stranded, linear
gggggbgtttcbtcttg

SEQ ID NO: 1637 - DNA, 16 bp; single-stranded, linear
ggggbgtttcbtcttg

SEQ ID NO: 1638 - DNA, 15 bp; single-stranded, linear
gggbgtttcbtcttg

SEQ ID NO: 1639 - DNA, 14 bp; single-stranded, linear
ggbgtttcbtcttg

SEQ ID NO: 1640 - DNA, 13 bp; single-stranded, linear
gbgtttcbtcttg

SEQ ID NO: 1641 - DNA, 12 bp; single-stranded, linear
bgtttcbtcttg

SEQ ID NO: 1642 - DNA, 16 bp; single-stranded, linear
gggggbgtttcbtctt

SEQ ID NO: 1643 - DNA, 15 bp; single-stranded, linear
ggggbgtttcbtctt

SEQ ID NO: 1644 - DNA, 14 bp; single-stranded, linear
gggbgtttcbtctt

SEQ ID NO: 1645 - DNA, 14 bp; single-stranded, linear
gggbgtttcbtctt

SEQ ID NO: 1646 - DNA, 13 bp; single-stranded, linear
ggbgtttcbtctt

SEQ ID NO: 1647 - DNA, 12 bp; single-stranded, linear
gbgtttcbtctt

SEQ ID NO: 1648 - DNA, 15 bp; single-stranded, linear
gggggbgtttcbtct

SEQ ID NO: 1649 - DNA, 14 bp; single-stranded, linear
ggggbgtttcbtct

SEQ ID NO: 1650 - DNA, 13 bp; single-stranded, linear
gggbgtttcbtct

SEQ ID NO: 1651 - DNA, 12 bp; single-stranded, linear
ggbgtttcbtct

SEQ ID NO: 1652 - DNA, 14 bp; single-stranded, linear
gggggbgtttcbtc

SEQ ID NO: 1653 - DNA, 13 bp; single-stranded, linear
ggggbgtttcbtc

SEQ ID NO: 1654 - DNA, 12 bp; single-stranded, linear
gggbgtttcbtc

SEQ ID NO: 1655 - DNA, 13 bp; single-stranded, linear
gggggbgtttcbt

SEQ ID NO: 1656 - DNA, 12 bp; single-stranded, linear
ggggbgtttcbt

SEQ ID NO: 1657 - DNA, 12 bp; single-stranded, linear
gggggbgtttcb

SEQ ID NO: 1658 - DNA, 19 bp; single-stranded, linear
tctccccttgttcctcccc

SEQ ID NO: 1659 - DNA, 22 bp; single-stranded, linear
tctcctgctctggtgtctcctc

SEQ ID NO: 1660 - DNA, 18 bp; single-stranded, linear
ttccctccctcccctgcc

SEQ ID NO: 1661 - DNA, 19 bp; single-stranded, linear
gtgttgtctgtgggtgtcc

SEQ ID NO: 1662 - DNA, 18 bp; single-stranded, linear
gtttcgctcttgttgccc

SEQ ID NO: 1663 - DNA, 18 bp; single-stranded, linear
tgggcccttccctgctgg

SEQ ID NO: 1664 - DNA, 24 bp; single-stranded, linear
gctggtcctctgctgtccttgctg

SEQ ID NO: 1665 - DNA, 20 bp; single-stranded, linear
gtgctcbtggtgtcctttcc

SEQ ID NO: 1666 - DNA, 28 bp; single-stranded, linear
gccctggggcccccctgtcttcttgggg

SEQ ID NO: 1667 - DNA, 20 bp; single-stranded, linear
cctcttccctctgggggccg

SEQ ID NO: 1668 - DNA, 25 bp; single-stranded, linear
tctctctccctctcttgcgtctctc

SEQ ID NO: 1669 - DNA, 22 bp; single-stranded, linear
tctttctctctctctcttcccc

SEQ ID NO: 1670 - DNA, 20 bp; single-stranded, linear
tttcccgctctttctgtctc

SEQ ID NO: 1671 - DNA, 21 bp; single-stranded, linear
ggtgtctggttttctctctcc

SEQ ID NO: 1672 - DNA, 28 bp; single-stranded, linear
gctggctgcctgtctggcctgcgctctt

SEQ ID NO: 1673 - DNA, 18 bp; single-stranded, linear
ggcctgtgctgttcctcc

SEQ ID NO: 1674 - DNA, 26 bp; single-stranded, linear
tccggttcctgtcctctctgtctgtc

SEQ ID NO: 1675 - DNA, 25 bp; single-stranded, linear
gccccctctggggtctccctctggc

SEQ ID NO: 1676 - DNA, 18 bp; single-stranded, linear
gtggtggtcttgttgctt

SEQ ID NO: 1677 - DNA, 19 bp; single-stranded, linear
gggctgggctccgtgtctc

SEQ ID NO: 1678 - DNA, 17 bp; single-stranded, linear
cbgtgctcbtggtgtcc

SEQ ID NO: 1679 - DNA, 21 bp; single-stranded, linear
gctgbgggbgcgtctgctggc

SEQ ID NO: 1680 - DNA, 329 bp; single-stranded, linear
tgcttttcttttctgggcctctgtggtctgtttttttctggccctgctggggcgctctccgccgcccgcctggctcccggbgcccbtgbtgggcbtgccgtggttcttgccctcctttggctgccgtgcccgctccccggcctcctggcgggtggccgttgggcccgtgttcccctggggcctggggctcccttctctcgcccttcttgctgggcctctgctgctgctggtgctgtggcccccgtacaccgaggagcccatgatgggcatgccacagacgacaggcgtbcbccgbggbgcccbtgbtgggcbtgccbcbgbcgbcbggc

SEQ ID NO: 1681 - DNA, 9 bp; single-stranded, linear
ctgggcctc

SEQ ID NO: 1682 - DNA, 12 bp; single-stranded, linear
gccgcccgcctg

SEQ ID NO: 1683 - DNA, 14 bp; single-stranded, linear
gcccgctccccggc

SEQ ID NO: 1684 - DNA, 13 bp; single-stranded, linear
cbccgbggbgccc

SEQ ID NO: 1685 - DNA, 304 bp; single-stranded, linear
ggcgccgtgccgcgtcttggtggcggcgggttcgcgcccgcgcggggcccctccggtccgttcgcgcccgcgcggggcccctccggtcccgggtcggggccccccgcggccgcctcggggctggggcgctggtggccgggccgcgcctccgcctgccgcttctggctgggccccgggcgccccctcccctcttgctcgggtccccgtgacagcgcgtcctgtgtctccagcagcatggccgggccagctgggccccbcbgcgcgtcctgtgtctccbgcbgcbtggccgggccbgctgggcccc

SEQ ID NO: 1686 - DNA, 10 bp; single-stranded, linear
gcgcgtcctg

SEQ ID NO: 1687 - DNA, 12 bp; single-stranded, linear
gctgggccccgg

SEQ ID NO: 1688 - DNA, 16 bp; single-stranded, linear
cgggtcggggcccccc

SEQ ID NO: 1689 - DNA, 10 bp; single-stranded, linear
cgcgcccgcg

SEQ ID NO: 1690 - DNA, 213 bp; single-stranded, linear
acagagcagtgctgttgttgggcatcttgccttcccagggbcbgbgcbtgctgttgttgggcbtcttgccttcccbgggcccttttctggtggggtggtgctgttgttgggctttcttctgttcccbcbgbgcbgtgctgttgttgggcbtcttgccttcccbgggcccttttctggtggggtggtgctgttgttgggctttcttctgttccc

SEQ ID NO: 1691 - DNA, 8 bp; single-stranded, linear
gbgcbtgc

SEQ ID NO: 1692 - DNA, 9 bp; single-stranded, linear
ttgttgggc

SEQ ID NO: 1693 - DNA, 13 bp; single-stranded, linear
tgccttcccbggg

SEQ ID NO: 1694 - DNA, 133 bp; single-stranded, linear
tttcccctgggtcttccctcctgctcttttttcatttgctctcctattactttctgtgtccattttttcattaaccgagctgtbtttgctctcctbttbctttctgtgtccbttttttcbttbbccgbgctgt

SEQ ID NO: 1695 - DNA, 8 bp; single-stranded, linear
cccctggg

SEQ ID NO: 1696 - DNA, 11 bp; single-stranded, linear
gctctcctbtt

SEQ ID NO: 1697 - DNA, 14 bp; single-stranded, linear
cbttbbccgbgctg

SEQ ID NO: 1698 - DNA, 299 bp; single-stranded, linear
gcctgtgtctgtcctcctgcttcgttcctctcgttcctgcttggtgcccttgccggtcctgctcctccgggctgtgggtcgtggccctggctccggctggtgggctcccctggccttcgctggctggcggcgtgcgggtcttgctctgggcctggctgtggccgtggttgggggtcttcgctgcctccgtttgggtggctctctgaatattgaccttcctccatggcggtcctgcttggattctcccgatctctgbbtbttgbccttcctccbtggcggtcctgcttggbttctcccgb

SEQ ID NO: 1699 - DNA, 8 bp; single-stranded, linear
gtcctcct

SEQ ID NO: 1700 - DNA, 14 bp; single-stranded, linear
tgtgtctgtcctcc

SEQ ID NO: 1701 - DNA, 11 bp; single-stranded, linear
gtggccctggc

SEQ ID NO: 1702 - DNA, 11 bp; single-stranded, linear
cgtggttgggg

SEQ ID NO: 1703 - DNA, 16 bp; single-stranded, linear
tctctgbbtbttgbcc

SEQ ID NO: 1704 - DNA, 378 bp; single-stranded, linear
gcctttcctggttctcttgttgtttttggggtttggcttacagtagagtaggggattccatggcaggagccatcttcttcatggactccttcaaggagaccttaggtttctgagggactgctaacacgccatctggagcbcbgtbgbgtbggggbttccbtggcbggbgccbtcttcttcbtggbctccttcbbggbgbccttbggtttctgbgggbctgctbbcbcgccbtctggbgcgttgtttttggggtttggcttgcctttcctggttctcttbcbgtbgbgtbggggbttccbtggcbggbgccbtcttcttcbtggbctccttcbbggbgbccttbggtttctgbgggbctgctbbcbcgccbtctggbgc

SEQ ID NO: 1705 - DNA, 8 bp; single-stranded, linear
tggbctcc

SEQ ID NO: 1706 - DNA, 9 bp; single-stranded, linear
ccbtctggb

SEQ ID NO: 1707 - DNA, 11 bp; single-stranded, linear
ctgctbbcbcg

SEQ ID NO: 1708 - DNA, 14 bp; single-stranded, linear
gtttttggggtttg

SEQ ID NO: 1709 - DNA (Genomic DNA), 279 bp; single-stranded, linear
gcctgtgtctgtcctcctgcttcgttcctctcgttcctgcttggtgcccttgccggtcctgctcctccgggctgtgggtcctcgccctggctccggctggtgggctcccctggccttcgctggctggcggcgtgccccbgbbcgbgbcccggbccgbcbggccgtggttgggggtcttcgctgcctccgtttgggtggcgatctctgaatattgaccttccatggcggtcctgcttggagbtctctgbbtbttgbccttccbtggcggtcctgcttggb

SEQ ID NO: 1710 - DNA, 291 bp; single-stranded, linear
gcctgtgtctgtcctcctgcttcgttcctctcgttcctgcttggtgcccttgccggtcctgctcctccgggctgtgggtcctcgccctggctccggctggtgggctcccctggccttcgctggctggcggcgtgccccbgbbcgbgbcccggbccgbcbggccgtggttgggggtcttcgctgcctccgtttgggtggcgatctctgaatattgaccttccatggcggtcctgcttggagbtctctgbbtbttgbccttccbtggcggtcctgcttggbtcgttcctctcg

SEQ ID NO: 1711 - DNA, 10 bp; single-stranded, linear
bgbbcgbgbc

SEQ ID NO: 1712 - DNA, 10 bp; single-stranded, linear
tgbbtbttgb

SEQ ID NO: 1713 - DNA, 171 bp; single-stranded, linear
tctcccttgggctctggctccttctctctctctccctctctctctgtcgcctccgccctggctgctggggtggtggtgcttttgttcttccttgctgccgccccgctgcttgtcttcctcgctctgtccctctctctctgtbctcctcbggctccbtcbtctcccttgggc

SEQ ID NO: 1714 - DNA, 9 bp; single-stranded, linear
ggctctggc

SEQ ID NO: 1715 - DNA, 7 bp; single-stranded, linear
cccttgg

SEQ ID NO: 1716 - DNA, 11 bp; single-stranded, linear
tttgttcttcc

SEQ ID NO: 1717 - DNA, 123 bp; single-stranded, linear
cttgctcctgggggcctcctggtccctccgggtgttcccggcgggcctggcctggggcbggggccgcgtbggcgcggctcgccbggbcgggcbgcgccbgcbgcbgcbgbttcbgcbtcctgg

SEQ ID NO: 1718 - DNA, 14 bp; single-stranded, linear
gctcctgggggcct

SEQ ID NO: 1719 - DNA, 9 bp; single-stranded, linear
cgtbggcgc

SEQ ID NO: 1720 - DNA, 10 bp; single-stranded, linear
tggcctgggg

SEQ ID NO: 1721 - DNA, 132 bp; single-stranded, linear
cttgctcctgggggcctcctggtccctctggctgttcccggccctggbctggggcbggggccgcgtbggcgcggctcgccbggbcgggcbgcgccbgcbgcbgcbggctcbgcbtcctggccbcggbbttcc

SEQ ID NO: 1722 - DNA, 17 bp; single-stranded, linear
ctcctgggggcctcctg

SEQ ID NO: 1723 - DNA, 19 bp; single-stranded, linear
btcctggccbcggbbttcc

SEQ ID NO: 1724 - DNA, 7 bp; single-stranded, linear
gtccctc

SEQ ID NO: 1725 - DNA, 180 bp; single-stranded, linear
ggtgtgcggggcctggtgcccctgggcctcgggtgctgcctgtgcgctgccttcttctcctgggtcctcgccggggcccttgctgccctggctgtgccctgggggtctgggttcggctgtccccbgcbggbccbgtcccbtccbcbgcgtgtgbtgbgtbgccbttctcctgcbgccgbg

SEQ ID NO: 1726 - DNA, 16 bp; single-stranded, linear
ttctcctgcbgccgbg

SEQ ID NO: 1727 - DNA, 17 bp; single-stranded, linear
cttgctgccctggctgt

SEQ ID NO: 1728 - DNA, 11 bp; single-stranded, linear
tcttctcctgg

SEQ ID NO: 1729 - DNA, 101 bp; single-stranded, linear
gggcgcgggcgbgcbtcgctttgggcttttctcctttggtttgbgcgccbggbccgcgcbcbgcbgcbgggcgcgggcgbgcbtcgcbgcggcgggcbggg

SEQ ID NO: 1730 - DNA, 7 bp; single-stranded, linear
ggcbggg

SEQ ID NO: 1731 - DNA, 10 bp; single-stranded, linear
tcctttggtt

SEQ ID NO: 1732 - DNA, 81 bp; single-stranded, linear
cctccttcctggtctgtctgccbgbcbbbtttgggbbgtgbbcbgttttggbbccbtgtttcccbgtctctgbgctgtggc

SEQ ID NO: 1733 - DNA, 13 bp; single-stranded, linear
ttctcctttggtt

SEQ ID NO: 1734 - DNA, 14 bp; single-stranded, linear
tttctcctttggtt

SEQ ID NO: 1735 - DNA, 156 bp; single-stranded, linear
gccctgctgctctttctgcttcccttggtgggttgggccgctggttgttctggggttcttgctgccccttctgtccctgtttgctggtgtctgcgcccccbbcbgbbgbbgcbgbcbbbtttgggbbgtgbbcbgttttggbbccbtgtttcctgt

SEQ ID NO: 1736 - DNA, 7 bp; single-stranded, linear
ttcctgt

SEQ ID NO: 1737 - DNA, 11 bp; single-stranded, linear
ctctttctgct

SEQ ID NO: 1738 - DNA, 13 bp; single-stranded, linear
ccccttctgtccc

SEQ ID NO: 1739 - DNA, 272 bp; single-stranded, linear
gcgctcggcctggtcccgggggtctcctcttgttgttgcttgcgcctcctgctgggggtccctctgttcttgttttgggggcgggcccggccgttgtcttggtttgggggtttccgttggggttctcctggcccgggccttgcccggccgtggtcccggcttcgttcctgtctccgtctcggctcttctggggccttgcgctgtctttggtggcbccgtccbgtgbtggtgcggtbcttgtcgctgcbgcgctcggcctggtcccggbgbgc

SEQ ID NO: 1740 - DNA, 15 bp; single-stranded, linear
tcggcctggtcccgg

SEQ ID NO: 1741 - DNA, 15 bp; single-stranded, linear
tgggggtttccgttg

SEQ ID NO: 1742 - DNA, 14 bp; single-stranded, linear
tggtcccggbgbgc

SEQ ID NO: 1743 - DNA, 360 bp; single-stranded, linear
gcgcgggccgggggctgctgggggttggcccggggtgccccgccgctgggtgccctcgtcctctgcggtcgtgtctcctggctctggttccccgctgcgcccgttgtcctctggggtggccttcgctcccgggtctggttcttgtgttgggggtccctttttgggcctgttgtggcgtggcttgtgtgttcggtttctgccctgtcctccggcgtccccggbgcctccccggggcbggbtgbcttttgbgggggbcbcbgbtgtctgggcbttgccbggtcctgggbbcbgbgccccgbgcbggbccbggbgtgcgggcbgcgcgggccgggggctgctgggbgccbtbgcgbggctgbg

SEQ ID NO: 1744 - DNA, 13 bp; single-stranded, linear
gggggctgctggg

SEQ ID NO: 1745 - DNA, 16 bp; single-stranded, linear
tgtcctccggcgtccc

SEQ ID NO: 1746 - DNA, 17 bp; single-stranded, linear
gccbtbgcgbggctgbg

SEQ ID NO: 1747 - DNA, 16 bp; single-stranded, linear
ctctggggtggccttc

SEQ ID NO: 1748 - DNA, 242 bp; single-stranded, linear
cctcttttctgtttttcccctctgcctttgtttgggttcgcttcctttctgcttcttccctgtgtctcctgtctccgcttttttcttcgtctttgttgttttctcttccttgctgbgcbbgbtbtctbgbttctggggtggtctcgbttttbbbbgcttgbgbbgctgcbbbcbttbtccbbbgtbtbtttgbggctccbbggbtcbcgbccbtcttcccbggcbttttbbgttgctgtcgt

SEQ ID NO: 1749 - DNA, 7 bp; single-stranded, linear
ctgtcgt

SEQ ID NO: 1750 - DNA, 10 bp; single-stranded, linear
tgcttcttcc

SEQ ID NO: 1751 - DNA, 249 bp; single-stranded, linear
bbgtgbgbgctgbgbgbbbctgtgbbgcbbtcbtgbcttcbbgbgttcttttcbcccgttcttggcttcttctgtccgttggcttctcgttgtccctgtgggcttctcgttgtccccccttcgggggctggtggggccgtccttgcctgctgggttcttggcttcttctgtccgttggcttctcgttgtccctgtgggcttctcgttgtccccccttcgggggctggtggggccgtccttgcctgctgg

SEQ ID NO: 1752 - DNA, 13 bp; single-stranded, linear
ccttgcctgctgg

SEQ ID NO: 1753 - DNA, 8 bp; single-stranded, linear
gttgtccc

SEQ ID NO: 1754 - DNA, 77 bp; single-stranded, linear
ttttctctttcgctttcttttcgtctcctgttcctccttttttgctgttttttctccttcttctctcctttcttttc

SEQ ID NO: 1755 - DNA, 12 bp; single-stranded, linear
tcctttcttttc

SEQ ID NO: 1756 - DNA, 8 bp; single-stranded, linear
ctcctttt

SEQ ID NO: 1757 - DNA, 77 bp; single-stranded, linear; identical to SEQ ID NO: 1754

SEQ ID NO: 1758 - DNA, 11 bp; single-stranded, linear
cctttcttttc

SEQ ID NO: 1759 - DNA, 14 bp; single-stranded, linear
ctgttcctcctttt

SEQ ID NO: 1760 - DNA, 126 bp; single-stranded, linear
ctctgtcttgttctggtccttcgtggggctctgtgtcgcgtgggtgcggccgtggccggcggbccbggbgttggbgcbggbgcbggbcgggcbggcggctcbtgtttggbtcggcbggbggcbctc

SEQ ID NO: 1761 - DNA, 10 bp; single-stranded, linear
ggbggcbctc

SEQ ID NO: 1762 - DNA, 11 bp; single-stranded, linear
gtggggctctg

SEQ ID NO: 1763 - DNA, 648 bp; single-stranded, linear
tctggggtgtcctggccttcgtggttcctcttccttcgtttgccgtccgcgggggcccccgggcctggctgcgctcctgccccgcctctttcccgggctcttgcgctggggggtgctcccgtgtgtttgcgccctcctcctggtcgcgcttgtcgttttggggccggctttgcccgcctcccggcgcctggcccggccttcctgggctgcgtgcgcgttctgttcttcttcctggctctggggtgtcctggccttcgtggttcctcttccttcgtttgccgtccgcgggggcccccgggcctggctgcgctcctgccccgcctctttcccgggctcttgcgctggggggtgctcccgtgtgtttgcgccctcctcctggtcgcgcttgtcgttttggggccggctttgcccgcctcccggcgcctggcccggccttcctgggctgcgtgcgcgttctgttcttcttcctggcgcaggagacagggcagggcgatcaggagcagcgtgagccaaaggaggaccatcgggaacgcagctccggaacgcaggacagaggtgccgcbggbgbcbgggcbgggcgbtcbggbgcbgcgtgbgccbbbggbggbccbtcgggbbcgcbgctccggbbcgcbggbcbgbggtgcc

SEQ ID NO: 1764 - DNA, 8 bp; single-stranded, linear
gbggtgcc

SEQ ID NO: 1765 - DNA, 7 bp; single-stranded, linear
gccccgc

SEQ ID NO: 1766 - DNA, 88 bp; single-stranded, linear
ctctggttggcttccttcgccggcbcbtgctbgcbggbbgbbcbgbgggggbbgcbgttgggbggtgbgbcccbttbbtbggtgtcgb

SEQ ID NO: 1767 - DNA, 9 bp; single-stranded, linear
gccggcbcb

SEQ ID NO: 1768 - DNA, 7 bp; single-stranded, linear
ttccttc

SEQ ID NO: 1769 - DNA, 562 bp; single-stranded, linear
tctgccctgtccgccggctcttcggtggctcggccccgctccttgtcttgccgcgggttggttcctgggcctggttcttgcgggcgtttcggtctgctggctggtctgggcccgcggtgcggcgggtggcttgctgttctgcctgggctctcccctctcctccttttctcccttcctctgtcttgcctccttcctctgggtcctcttggcctgggcgctcttcccctcgggcggctgcgggcgctcgtgctgcctggtccgctccctgggggtgctccttccctttccccgctcgtggggtttgcggggctgggctgccctggggggtctgggccttttggggtcggctggctgctgcttcgggccgcctgggcttccctgtgcccctttcctctgctgggtccccctcccgttccaagctgcaccgcacagaccggcgctacaggacagagccaggcaagcacccatggggatccaggcccagctgttccbbgctgcbccgcbcbgbccggcgctbcbggbcbgbgccbggcbbgcbcccbtggggbtccbggcccbgctg

SEQ ID NO: 1770 - DNA, 7 bp; single-stranded, linear
tctgcgc

SEQ ID NO: 1771 - DNA, 13 bp; single-stranded, linear
cctgctcctgggg

SEQ ID NO: 1772 - DNA, 257 bp; single-stranded, linear
tccctgtttcccccctttcgttctgcgtttgcctttggcgttttttgtttgttttctctctccgtctttcttctcccctgtgggbbtttctgtggggbtggcbtbcbcgtbggcbgctccbbgbgctbgcbbbctcbbbtgcbgbbgcbtcctcbtggctctgbbbcggtgggaatttctgtggggbtggcatacacgtaggcagctccaagagctagcaaactcaaatgcagaagcatcctcatggctctgaaacg

SEQ ID NO: 1773 - DNA, 8 bp; single-stranded, linear
gccccggg

SEQ ID NO: 1774 - DNA, 8 bp; single-stranded, linear
gggtttct

SEQ ID NO: 1775 - DNA, 11 bp; single-stranded, linear
gtggggbtggc

SEQ ID NO: 1776 - DNA, 12 bp; single-stranded, linear
ccbbgbgctbgc

SEQ ID NO: 1777 - DNA, 89 bp; single-stranded, linear
gtgggaatttctgtggggbtggcatacacgtaggcagctccaagagctagcaaactcaaatgcagaagcatcctcatggctctgaaacg

SEQ ID NO: 1778 - DNA, 249 bp; single-stranded, linear
ctcagtggcccccaaaaggatgagtaatacatgcgccacgatgatcatatcctttttactatgaggccgtgtctgtcgtgtctttcctttgctcttggtgtgtctttgctgtgccctgcctctctgcccgtgtctgtcgtgtctttcctttgctcttggtgtgtctttgctgtgccctgcctctctgcccgtgtctgtcgtgtctttcctttgctcttggtgtgtctttgctgtgccctgcctctctgc

SEQ ID NO: 1779 - DNA, 7 bp; single-stranded, linear
ccgtgtc

SEQ ID NO: 1780 - DNA, 8 bp; single-stranded, linear
gccctgcc

SEQ ID NO: 1781 - DNA, 66 bp; single-stranded, linear
ctcbgtggcccccbbbbggbtgbgtbbtbcbtgcgccbcgbtgbtcbtbtcctttttbctbtgbgg

SEQ ID NO: 1782 - DNA, 869 bp; single-stranded, linear
gggggtggcttcctgccgcgtctctgggccgtcccgtccctcggccccgcgccgcgctcggctcctctccctctggcccggctcggggcggggcggggcggtgggcgggcggcgctgccctgcgcgcggcgctggcccctgctggccgtcggctgcgcgctgctggctgccctgctggccgcgccggggcctgtccgcctctgcgggcgctgtctcctggcttgtcttccggctcttctgctggggtggggctgggcggccggcccggtgctggggctcctcgggggggggggctcttccgggctgtctccctccggggcgggggtttctggccgtgggggtcttgcctggcctccgggctcctgcttgtcttgccttccttctctggtcggttgtggctcggggctccgtgggtccctggcgcccgtttgtgttttgtcttttcccctggcgtccctgtgcccctctcctctccttcctctgcttctcgctctcctttgtggggccctccctgctgctcttggttttgggctttttttctcttcctcctttttcgtgcgtgggcctccgcacgcctcttgccacctcctgcgcagggcagcgccttggggccagcgccgctcccggcgcggccagcagggcagccagcagcgcgcagccgacggccagcatgcttcctcctcggctaccactccatggtcccgcagaggcggacaggcgcbcgcctcttgccbcctcctgcgcbgggcbgcgccttggggccbgcgccgctcccggcgcggccbgcbgggcbgccbgcbgcgcgcbgccgbcggccbgcbtgcttcctcctcggctbccbctccbtggtcccgcbgbggcggbcbggc

SEQ ID NO: 1783 - DNA, 13 bp; single-stranded, linear
gcbgccbgcbgcg

SEQ ID NO: 1784 - DNA, 14 bp; single-stranded, linear
cgcbgccgbcggcc

SEQ ID NO: 1785 - DNA, 869 bp; single-stranded, linear; identical to SEQ ID NO: 1782

SEQ ID NO: 1786 - DNA, 8 bp; single-stranded, linear
ggggcbgg

SEQ ID NO: 1787 - DNA, 13 bp; single-stranded, linear
gbbggcbgcbggc

SEQ ID NO: 1788 - DNA, 14 bp; single-stranded, linear
ccbggbgcbgcccc

SEQ ID NO: 1789 - DNA, 14 bp; single-stranded, linear
bgggbgbbggcbbc

SEQ ID NO: 1790 - DNA, 128 bp; single-stranded, linear
ctcctgggggtbctggggcbgggbbggcbgcbggcbbcbccbggbgcbgccccbgggbgbbggcbbctggbccgbbggcgcttgtggbgbbggbgttcbtbgctgggctcctggbggggbgbtbgbgc

SEQ ID NO: 1791 - DNA, 244 bp; single-stranded, linear
ggggtggbbbggtttggbgtbtgtctttbtgcbctgbcbtctbbgttctttbgcbctccttggcbbbbctgcbccttcbcbcbgbgctgcbgbbbtcbggbbggctgccbbgbgbgccbcggccbgcttggbbgtcbtgtttbcbcbcbgtgbgbtggttccttccgggcttgtgtgctctgctgtctcttggttccttccggtggtttcttcctggctcttgtcctttctcttggcccttggc

SEQ ID NO: 1792 - DNA, 8 bp; single-stranded, linear
ggbgtbtg

SEQ ID NO: 1793 - DNA, 12 bp; single-stranded, linear
gcbctgbcbtct

SEQ ID NO: 1794 - DNA, 7 bp; single-stranded, linear
ccggtgg

SEQ ID NO: 1795 - DNA, 10 bp; single-stranded, linear
ggcccttggc

SEQ ID NO: 1796 - DNA, 87 bp; single-stranded, linear
ggggtggbbbggtttggbgtbtgtctttbtgcbctgbcbtctbbgttctttbgcbctccttggcbbbbctgcbccttcbcbcbgbgc

SEQ ID NO: 1797 - DNA, 489 bp; single-stranded, linear
gggctcccgccgcgbgbggttbtgggctcccbggbccbcccgcbccgcgcggbcgtttbcbttcgccbcgcbgtgcgcggccgbcbtgbcgbbgttgggcgcbbtcbgggtggcgccgcbgbbgtggcctccgcgcbgctgcbgggbcbccbtgbbgggccbcgcgtggggccgcgctcgccggccccccbcbbtctccgbggccbgcgcggtgccccccbgcbgcbbggccggcbggbcbcbggcgbggbgbcbcgcgbgtcggcggccgbgggtcbtggtggggctggggctccggggtctctgcccctccgtgctggtggggctggggctccggggtctctgcccctccgtgccgcgtggggccgcgctcgccggcccccccctgccgggtgggctcccgccgcgcgccggcctgccggcccctcgtgggtcctgctggccgggtccgggtcccgggggtggggcgcgbgtcggcggccgbgggtc

SEQ ID NO: 1798 - DNA, 8 bp; single-stranded, linear
ggtggggc

SEQ ID NO: 1799 - DNA, 7 bp; single-stranded, linear
ggggccg

SEQ ID NO: 1800 - DNA, 13 bp; single-stranded, linear
ggccgggtccggg

SEQ ID NO: 1801 - DNA (Genomic DNA), 317 bp; single-stranded, linear
gggctcccgccgcgbgbggttbtgggctcccbggbccbcccgcbccgcgcggbcgtttbcbttcgccbcgcbgtgcgcggccgbcbtgbcgbbgttgggcgcbbtcbgggtggcgccgcbgbbgtggcctccgcgcbgctgcbgggbcbccbtgbbgggccbcgcgtggggccgcgctcgccggccccccbcbbtctccgbggccbgcgcggtgccccccbgcbgcbbggccggcbggbcbcbggcgbggbgbcbcgcgbgtcggcggccgbgggtcbtggtggggctggggctccggggtctctgcccctccgtgc

SEQ ID NO: 1802 - DNA (Genomic DNA), 308 bp; single-stranded, linear
cgggbgtgggggtcctggbcggcbctgbbggcbtccbgggctcccttccbgtccttcttgtccgctgccbgcbccccttcbttccbgbggctgbtggcctccbccbgggbcbtgbttbggtbgbbbctbggbggccggcctccbccbgggbcbtggtccttcttgtccgctgcctctctggggttttcggtctgggtgggctttcctcctggggctgctgctgggctcttctttttgtttctggcctggtgctctctcgtgccctttcccttgggtgtcttgtttttgtggcctccbccbgggbcbtg

SEQ ID NO: 1803 - DNA, 12 bp; single-stranded, linear
cgggbgtggggg

SEQ ID NO: 1804 - DNA, 11 bp; single-stranded, linear
gccbgcbcccc

SEQ ID NO: 1805 - DNA, 7 bp; single-stranded, linear
ccbccbg

SEQ ID NO: 1806 - DNA, 136 bp; single-stranded, linear
cgggbgtgggggtcctggbcggcbctgbbggcbtccbgggctcccttccbgtccttcttgtccgctgccbgcbccccttcbttccbgbggctgbtggcctccbccbgggbcbtgbttbggtbgbbbctbggbggcc

SEQ ID NO: 1807 - DNA, 233 bp; single-stranded, linear
ccctccbcbtctgctctgbcctgctggbctctggbtctgbbgbtbcgccbtgtbggggcgggbgtggggcctgctctcccggcctccgbtgbtctcccctgcctcbgccccbgtgggtbggbgbbbggccbgcbgbbgcbggbgtggctgcbtctttcctggtggggcctgctctcccggcctccgtgtgttgctgggtgttttcccgtctctggtctgccttcgggggtcgt

SEQ ID NO: 1808 - DNA, 11 bp; single-stranded, linear
gbbgbtbcgcc

SEQ ID NO: 1809 - DNA, 9 bp; single-stranded, linear
cbgccccbg

SEQ ID NO: 1810 - DNA, 12 bp; single-stranded, linear
tcccgtctctgg

SEQ ID NO: 1811 - DNA, 150 bp; single-stranded, linear
ccctccbcbtctgctctgbcctgctggbctctggbtctgbbgbtbcgccbtgtbggggcgggbgtggggcctgctctcccggcctccgbtgbtctcccctgcctcbgccccbgtgggtbggbgbbbggccbgcbgbbgcbggbgtggctg

SEQ ID NO: 1812 - DNA, 222 bp; single-stranded, linear
ccggggctgcbgcbbcctcbtcbgctcttgcctggbgtggctcbgcctgggcctgcbgggccbccbggbgbbtggcbgcbbggbtggcgbgggtcctcbtggctggggtcbcbgbtcctctbgctbggcbgggtgbccbgbgbgggcgggtcctcbtggctgggggcctgggcctgcbgggccgctcttgcctggbgtggctcgcccbgbgtcttccctggt

SEQ ID NO: 1813 - DNA, 7 bp; single-stranded, linear
ccggggc

SEQ ID NO: 1814 - DNA, 14 bp; single-stranded, linear
gggcctgcbgggcc

SEQ ID NO: 1815 - DNA, 10 bp; single-stranded, linear
ggcbgcbbgg

SEQ ID NO: 1816 - DNA, 147 bp; single-stranded, linear
ccggggctgcbgcbbcctcbtcbgctcttgcctggbgtggctcbgcctgggcctgcbgggccbccbggbgbbtggcbgcbbggbtggcgbgggtcctcbtggctggggtcbcbgbtcctctbgctbggcbgggtgbccbgbgbgggc

SEQ ID NO: 1817 - DNA, 180 bp; single-stranded, linear
cgctgcbbtctgctccggggctgcbgcbbcctcbtcbgctcttgcctggbgtggctcbgcctgggcctgcbgggccbccbggbgbbtggcbgcbbggbtggcgbgggtcctcbtggctggggtcbcctggbggbgggbgbgcbgggggtcctcbtggctggggtccctctctcccgtcct

SEQ ID NO: 1818 - DNA, 10 bp; single-stranded, linear
ggcbgcbbgg

SEQ ID NO: 1819 - DNA, 8 bp; single-stranded, linear
ggctgggg

SEQ ID NO: 1820 - DNA, 9 bp; single-stranded, linear
ggggtcbcc

SEQ ID NO: 1821 - DNA, 145 bp; single-stranded, linear
cgctgcbbtctgctccggggctgcbgcbbcctcbtcbgctcttgcctggbgtggctcbgcctgggcctgcbgggccbccbggbgbbtggcbgcbbggbtggcgbgggtcctcbtggctggggtcbcctggbggbgggbgbgcbgg

SEQ ID NO: 1822 - DNA, 374 bp; single-stranded, linear
gtctttgtttctgggctcgtgccccbtcccggcttctctctggttccgtcctctgtggtgtttggccctgcttccttttgcctgttgagggggcagcagttgggccccaaaggccctctcgttcaccttctggcacggagttgcatccccatagtcaaactctgtggtcgtgtcatagtcctctgtggtgtttggagtttccatcccggcttctctctggttccaagggagbgggggcbgcbgttgggccccbbbggccctctcgttcbccttctggcbcggbgttgcbtccccbtbgtcbbbctctgtggtcgtgtcbtbgtcctctgtggtgtttggbgtttccbtcccggcttctctctggttccbbgggb

SEQ ID NO: 1823 - DNA, 7 bp; single-stranded, linear
gggcccc

SEQ ID NO: 1824 - DNA, 9 bp; single-stranded, linear
gggggcbgc

SEQ ID NO: 1825 - DNA, 9 bp; single-stranded, linear
cccggcttc

SEQ ID NO: 1826 - DNA, 303 bp; single-stranded, linear
gggcbcggggcbgtgggcgggcbbtgtbggcbbbgcbgcbgggtgtggtgtccgbggbbtbtggggbggcbgbtgcbggbgcgcbgbgggcbgtbgcbbtgbggbtgbcbgcgbggcgtgccgcggbgbccttcbtggtbcctgtggbgbggctgtcggbgggggtgtggtgtccgcttggcggttctttcgggtgtttcttctctgggttggcctgctgctcgtcgtggtcgctccgctcccgggttcgtctcgctctgtcgccccttccttccttgtcgtgttcctcccttccttgcctct

SEQ ID NO: 1827 - DNA, 8 bp; single-stranded, linear
gggttggc

SEQ ID NO: 1828 - DNA, 8 bp; single-stranded, linear
cggggcbg

SEQ ID NO: 1829 - DNA, 10 bp; single-stranded, linear
cccgggttcg

SEQ ID NO: 1830 - DNA, 10 bp; single-stranded, linear
gggtgtggtg

SEQ ID NO: 1831 - DNA, 162 bp; single-stranded, linear
gggcbcggggcbgtgggcgggcbbtgtbggcbbbgcbgcbgggtgtggtgtccgbggbbtbtggggbggcbgbtgcbggbgcgcbgbgggcbgtbgcbbtgbggbtgbcbgcgbggcgtgccgcggbgbccttcbtggtbcctgtggbgbggctgtcggbgg

SEQ ID NO: 1832 - DNA, 213 bp; single-stranded, linear
gctgcccggcggggtgtgcgcttggcgctcccgtgctcggttctctgtctcccggtcccccttgcctggcgtctcgggccttcgtcctcttcctcttcttccttccgctccgtgggggctgcttggtgggggcctgtgcctcggggtcccggggcttctggcccttgccgttcatggtggctaggtggggcgttcbtggtggctbggtggggc

SEQ ID NO: 1833 - DNA, 8 bp; single-stranded, linear
ggtggggc

SEQ ID NO: 1834 - DNA, 11 bp; single-stranded, linear
gcccggcgggg

SEQ ID NO: 1835 - DNA, 15 bp; single-stranded, linear
cggggcttctggccc

SEQ ID NO: 1836 - DNA, 347 bp; single-stranded, linear
ggggtgggtbggccgtgtctgggggttggccbtgttggttgcctcttggtggtgcgccgggcgcgtcttggctttcttctccttcgggccctcgggccggtgcttgtgggctcctcccgggcggcctccccgggcgggggcttcttggcgctggcgggggggcctcctgctctgtggctgggcgttccttggtgttctgggtggtggcgggcgtggtggcctctgtgggggcccgcggctgcbggggttgcctgtctgcttcgtcctttgcgctcccgggccgccggggtgggtaggccgtgtctgggggttggccatgttggttgccgggcccgcggctgcagggg

SEQ ID NO: 1837 - DNA, 9 bp; single-stranded, linear
cccgggcgg

SEQ ID NO: 1838 - DNA, 12 bp; single-stranded, linear
ggcgggggggcc

SEQ ID NO: 1839 - DNA, 11 bp; single-stranded, linear
cccgggccgcc

SEQ ID NO: 1840 - DNA, 8 bp; single-stranded, linear
ggccgtgt

SEQ ID NO: 1841 - DNA, 664 bp; single-stranded, linear
cggtttcctttgcggtcttggcccgggctccgggtgcccgcccgcccgccggccgccgccccgccgggctgtccccgccccgccccggcccggggcgcgggggcggccctcccgcccctctgggccggcgcgggcgtcggccgctcgcgcctggggttccctctcctccccctgtgcgcctgcctcttgctcttctgcgtccgctgccttctcccctctcctcggccgttgcctgtgctgtccgtcctgtcgcccttccgtggtgctgttgtctcttctgccctcggtgtgctggtgctggtggtggtgcctctgcccgtgctcgccctgcctgggctggcctcttcgggtgtggctttggggctctcttggttgccctttcttctcgtggtgcctctcctccctggcttggtcgttgtctggggtggtgctcctctccctttccctgctggccgtttgtcctgttttctgtcttcctctttcctcctgtttctccgtttggcttgctgcttgcggggctgtctcccttgcccctgtgggctttccctggtccggtcttctccttgggggtcgcccttcttggtgggctggctcgtctgtctttttccttcctgggggtggccgttgtgggcggtgtggtccgccttgcctctgctggtctttc

SEQ ID NO: 1842 - DNA, 9 bp; single-stranded, linear
ggcccgggc

SEQ ID NO: 1843 - DNA, 13 bp; single-stranded, linear
gccggcgcgggcg

SEQ ID NO: 1844 - DNA, 13 bp; single-stranded, linear
gcctgggctggcc

SEQ ID NO: 1845 - DNA, 11 bp; single-stranded, linear
gggggtggccg

SEQ ID NO: 1846 - DNA, 21 bp; single-stranded, linear
gggggtggccgttgtgggcgg

SEQ ID NO: 1847 - DNA, 266 bp; single-stranded, linear
gbtgtttgttbccbbbgcbtcbbgbbtbgctttgctbtctbbggbtcbcbtttbgbcbtbggbbbbcgctgtbggtcbgbbbgbtgtgcttbccttcbcbcbgbgctgcbgbbbtcbggbbggctgccbbgbgbgccbcggccbgcttggbgtcbtgtttbcbcbcbgtgbggtgctccggtggctttttgcttgtgtgctctgctgtctctgttccttccggtggtttcttcctggctcttgtcctttctcttggcccttggccc

SEQ ID NO: 1848 - DNA, 7 bp; single-stranded, linear
gctccgg

SEQ ID NO: 1849 - DNA, 10 bp; single-stranded, linear
cbbgbbtbgc

SEQ ID NO: 1850 - DNA, 15 bp; single-stranded, linear
cbcbcbgtgbggtgc

SEQ ID NO: 1851 - DNA, 20 bp; single-stranded, linear
bccbbbgcbtcbbgbbtbgc

SEQ ID NO: 1852 - DNA, 21 bp; single-stranded, linear
gccbbgbgbgccbcggccbgc

SEQ ID NO: 1853 - DNA, 196 bp; single-stranded, linear
gbtgtttgttbccbbbgcbtcbbgbbtbgctttgctbtctbbggbtcbcbtttbgbcbtbggbbbbcgctgtbggtcbgbbbgbtgtgcttbccttcbcbcbgbgctgcbgbbbtcbggbbggctgccbbgbgbgccbcggccbgcttggbgtcbtgtttbcbcbcbgtgbggtgctccggtggctttttgcttgt

SEQ ID NO: 1854 - DNA, 400 bp; single-stranded, linear
acaggggctgtaatcttcatctgcaggtggcatgccagtgaaatttagatcatcaaaatcccacatctgtggatctgtaatatttgacatgtcctcttcagtttcagcaatggtttgatctaactgaagcaccggccaggbcbggggctgtbbtcttcbtctgcbggtggcbtgccbgtgbbbtttbgbtcbtcbbbbtcccbcbtctgtggbtctgtbbtbtttgbcbtgtcctcttcbgtttcbgcbbtggtttgbtctbbctgbbgcbccggccbggtggctcggtgcttctgcccctgttgttgcggcgctcggttggtgtggcccctgtggtgcttcgtttccccctctttctctttgttcgggggttcttgtggcgggctgcttgtctcgttcc

SEQ ID NO: 1855 - DNA, 7 bp; single-stranded, linear
cbggggc

SEQ ID NO: 1856 - DNA, 9 bp; single-stranded, linear
gcbggtggc

SEQ ID NO: 1857 - DNA, 9 bp; single-stranded, linear
gcggcgctc

SEQ ID NO: 1858 - DNA, 140 bp; single-stranded, linear
acaggggctgtaatcttcatctgcaggtggcatgccagtgaaatttagatcatcaaaatcccacatctgtggatctgtaatatttgacatgtcctcttcagtttcagcaatggtttgatctaactgaagcaccggccagg

SEQ ID NO: 1859 - DNA, 140 bp; single-stranded, linear
bcbggggctgtbbtcttcbtctgcbggtggcbtgccbgtgbbbtttbgbtcbtcbbbbtcccbcbtctgtggbtctgtbbtbtttgbcbtgtcctcttcbgtttcbgcbbtggtttgbtctbbctgbbgcbccggccbgg

SEQ ID NO: 1860 - DNA, 346 bp; single-stranded, linear
cttgbgcbggbbgctctggggcbgggbgctggcbgggcccbggggggtggcttcctgcbctgtccbgbgtgcbctgtgccbcbgcbgcbgctgcbgggccbtcbgcttcbtggggctctgggtggcbggtccbgccbtgggtctgggtggggctgggctgcbggctccgggcggtccbgccbtgggtctgggggctgggctgcbggctccgggcgggcgggtgcgggctgcgtgctgggggctgccccgcaggccctgcggtccbgccbtgggtctgggggctgggctgcbggctccgggcgggcgggtgcgggctgcgtgctgggggctgccccgcaggccctgc

SEQ ID NO: 1861 - DNA, 10 bp; single-stranded, linear
gbgcbggbbg

SEQ ID NO: 1862 - DNA, 14 bp; single-stranded, linear
gccbcbgcbgcbgc

SEQ ID NO: 1863 - DNA, 10 bp; single-stranded, linear
gggtgcgggc

SEQ ID NO: 1864 - DNA, 172 bp; single-stranded, linear
cttgbgcbggbbgctctggggcbgggbgctggcbgggcccbggggggtggcttcctgcbctgtccbgbgtgcbctgtgccbcbgcbgcbgctgcbgggccbtcbgcttcbtggggctctgggtggcbggtccbgccbtgggtctgggtggggctgggctgcbggctccgggc

SEQ ID NO: 1865 - DNA, 818 bp; single-stranded, linear
gcbccgcctggbgccctggggcccccctgtcttcttggggbgcgcctcctcggccbgctccbcgtcccggbtcbtgctttcbgtgctcbtggtgtcctttccbggggbgbgbggggctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctgggtggtggtcttgttgcttgggctgggctccgtgtctccbgtgctcbtggtgtccgctgbgggbgcgtctgctggcgctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctggcgtggtggtcttgttgcttgggctgggctccgtgtctccbgtgctcbtggtgtccgctgbgggbgcgtctgctggc

SEQ ID NO: 1866 - DNA, 10 bp; single-stranded, linear
ggggcccccc

SEQ ID NO: 1867 - DNA, 11 bp; single-stranded, linear
gggggccgtct

SEQ ID NO: 1868 - DNA, 20 bp; single-stranded, linear
ccbggggbgbgbggggctgg

SEQ ID NO: 1869 - DNA, 364 bp; single-stranded, linear
ctcggtbgbcgcgctcgbbctcgggtgggccggtggtgbgcggcggcgbcbcgcggbbggccctgcgcgccgbgbtcbcctgcbgggbgbbgtbggcttgcbgcbggbctcccbggbgggtgbcbgcbgccbgtbgbgctbcctcgtccttcbtggtbccgtcggtgtggtggcbcgggctgtgtgtgbbggcgbgctgggccccgtctgctgctcctcgtgccgcctcgtccttcatggtaccgtcggtgtggtggcctcgggtgggccggtggtggggcgcgcgcgctcgcgtggctccggctcttctttcccggctccgtcggcccgggggccttggtctccctcgtccttcbtggtbccg

SEQ ID NO: 1870 - DNA, 10 bp; single-stranded, linear
gcbgcbggbc

SEQ ID NO: 1871 - DNA, 10 bp; single-stranded, linear
cccggctccg

SEQ ID NO: 1872 - DNA, 13 bp; single-stranded, linear
cggcccgggggcc

SEQ ID NO: 1873 - DNA, 7 bp; single-stranded, linear
cbcgcgg

SEQ ID NO: 1874 - DNA, 200 bp; single-stranded, linear
ctcggtbgbcgcgctcgbbctcgggtgggccggtggtgbgcggcggcgbcbcgcggbbggccctgcgcgccgbgbtcbcctgcbgggbgbbgtbggcttgcbgcbggbctcccbggbgggtgbcbgcbgccbgtbgbgctbcctcgtccttcbtggtbccgtcggtgtggtggcbcgggctgtgtgtgbbggcgbgctgg

SEQ ID NO: 1875 - DNA, 530 bp; single-stranded, linear
bccggcggbgccgccbgggtggbctgggbgtgggtttctccccgccgttctcbcccbccgcgctgbgctcbgcgcctbbgbctgctgtttctggbgctccttggcbbgccbcbbbcbgcbgbgbgbbbbtcbtgbgcbbbtbbtccbttctgbbbbbbbgggbtcbbbbbcctcccgttccccgttcgcctggcgcgcgctgcgggttcctcgtgggtttctccccgccgttctccggtctgttgcctttgtgggcttcttgtctttttggctgttcttttcctgcttggcgtcttttcctttctttgtgctcggttgtgggtccgctggtcctttgccctgtgtgtttctgctgcccgttcgcctggcgcgcgctgcgggttcctcgtgggtttctccccgccgttctccggtctgttgcctttgtgggcttcttgtctttttggctgttcttttcctgcttggcgtcttttcctttctttgtgctcggttgtgggtccgctggtcctttgccctgtgtgtttctgctg

SEQ ID NO: 1876 - DNA, 23 bp; single-stranded, linear
ccggcggbgccgccbgggtggbc

SEQ ID NO: 1877 - DNA, 9 bp; single-stranded, linear
ccgccbggg

SEQ ID NO: 1878 - DNA, 9 bp; single-stranded, linear
ggcgcgcgc

SEQ ID NO: 1879 - DNA, 10 bp; single-stranded, linear
gtgggtccgc

SEQ ID NO: 1880 - DNA, 399 bp; single-stranded, linear
gccctgtcgggcgggaagcctctctcctctccccagatccgcgacaggccgcaggcaagaaccagcgcaaccagggcgcgtccgcacagacttggaggcggctgcatgctgctacctgctccagaagcgtccggtggccgccgcgccctgtcgggcgggbbgcctctctcctctccccbgbtccgcgbcbggccgcbggcbbgbbccbgcgcbbccbgggcgcgtccgcbcbgbcttggbggcggctgcbtgctgctbcctgctcgggcgggbbgcctccggtggccgccgcgcgtccggtggccgccgcgcctctctcctctccccgtggccctgtcgggcgggtcctgccgtcctgtctccttttcttttgctgtcttgtcttcccgtctctgcttt

SEQ ID NO: 1881 - DNA, 13 bp; single-stranded, linear
cgggcgggbbgcc

SEQ ID NO: 1882 - DNA, 8 bp; single-stranded, linear
cgggcggg

SEQ ID NO: 1883 - DNA, 10 bp; single-stranded, linear
ccgcbcbgbc

SEQ ID NO: 1884 - DNA, 144 bp; single-stranded, linear
gccctgtcgggcgggaagcctctctcctctccccagatccgcgacaggccgcaggcaagaaccagcgcaaccagggcgcgtccgcacagacttggaggcggctgcatgctgctacctgctccagaagcgtccggtggccgccgc

SEQ ID NO: 1885 - DNA, 144 bp; single-stranded, linear
gccctgtcgggcgggbbgcctctctcctctccccbgbtccgcgbcbggccgcbggcbbgbbccbgcgcbbccbgggcgcgtccgcbcbgbcttggbggcggctgcbtgctgctbcctgctccbgbbgcgtccggtggccgccgc

SEQ ID NO: 1886 - DNA, 784 bp; single-stranded, linear
gtctgtcctccccgtctcctcccactgcttctcccgggggcttccccggcttcgggtggccggtgtcccgggctccggcgcggcggcggcttcggctgcgggtgggtggcgcgggctgccgggtccgcgcggcgcctgggcccttgtgctgctttttgcttgttccgttctggctgctccggtctgtgttgtggttgttttgtttcttcttgggtgtgggccttgcggttttggctgtgggccctttggggccttggcttctggctcgtctgtcctccccgtctcctcccactgcttctcccgggggcttccccggcttcgggtggccggtgtcccgggctccggcgcggcggcggcttcggctgcgggtgggtggcgcgggctgccgggtccgcgcggcgcctgggcccttgtgctgctttttgcttgttccgttctggctgctccggtctgtgttgtggttgttttgtttcttcttgggtgtgggccttgcggttttggctgtgggccctttggggccttggcttctggctccatccacatgattgcttagatttgtgctgtatctctcaggattatcactgattacacatccaaccagtgccagccaaaaggatgccctgaggcaaagggtttccatcttgaggcaaatttgaggacbtccbcbtgbttgcttbgbtttgtgctgtbtctctcbggbttbtcbctgbttbcbcbtccbbccbgtgccbgccbbbbggbtgccctgbggcbbbgggtttccbtcttgbggcbbbtttgbggb

SEQ ID NO: 1887 - DNA, 11 bp; single-stranded, linear
gbggcbbbggg

SEQ ID NO: 1888 - DNA, 14 bp; single-stranded, linear
gccbgccbbbbggb

SEQ ID NO: 1889 - DNA, 11 bp; single-stranded, linear
cgcctgggccc

SEQ ID NO: 1890 - DNA, 349 bp; single-stranded, linear
ctgctgbggcttgggtctccgggcgbttctctgcbgbbgbtgctcbbbgggctccggcbgttcctccttgbtctggtcgctgtcgtbccbgtcggbccbgtbbttcbgbtcbtcbttggctcctbtttcttctgcbbbcbgctgbgtggbgbcbbgbbbbbbgbctgccbbggccbcgbggbttttcbtgttggbttttgcgbcggbcbgtcccgcggggtgctgagtttctctggttcctccgbgcgcbcgtggtcgctccgcgtttctctggttcctccggtcccgcggggtgctgtctggtcgctgtcgtggcttgggtctccgggcggtttccttccttttccgc

SEQ ID NO: 1891 - DNA, 10 bp; single-stranded, linear
ctccgggcgb

SEQ ID NO: 1892 - DNA, 10 bp; single-stranded, linear
ggccbcgbgg

SEQ ID NO: 1893 - DNA, 13 bp; single-stranded, linear
gggtctccgggcg

SEQ ID NO: 1894 - DNA, 14 bp; single-stranded, linear
gggtctccgggcgg

SEQ ID NO: 1895 - DNA, 250 bp; single-stranded, linear
ctgctgbggcttgggtctccgggcgbttctctgcbgbbgbtgctcbbbgggctccggcbgttcctccttgbtctggtcgctgtcgtbccbgtcggbccbgtbbttcbgbtcbtcbttggctcctbtttcttctgcbbbcbgctgbgtggbgbcbbgbbbbbbgbctgccbbggccbcgbggbttttcbtgttggbttttgcgbcggbcbgtcccgcggggtgctgagtttctctggttcctccgbgcgcb

SEQ ID NO: 1896 - DNA, 662 bp; single-stranded, linear
gggctbbgbtgbtccbcbtcbctbccbcgttgcccbccbcbgbggtcbccbcbbtgbccgtgtbggcbgctgcccbbbggbcbbtttgccbggctggttgcbcgbbctgbttgggttccgbggtgttbgtggbgbtgtttggggbgbggtctgbgtccbccgggbggbcgttbtccbtttcgbbgctbggcggtbbbgccctbctbtctgtbcbcbbcccccctctgcbgcbgbgtcctgtcgtggcgcctggggctcbgggtccgggctaagatgatccacatcactaccacgttgcccaccacagaggtcaccacaatgaccgtgtaggcagctgcccaaaggacaatttgccaggctggttgcacgaactgattgggttccgaggtgttagtggagatgtttggggagaggtctgagtccaccgggaggacgttatccatttcgaagctaggcggtaaagccctactatctgtacacaacccccctctgcagcagagtcctgtcgtggcgcctggggctcagggtccgtcctgtcgtggcgcctggggctcttcttttgtgggctctttggtggctgtggctgtggtctctgtggttgctgccctgggtctgggggtgtggccttggggccgtcctctggctcctcctcgtgggccccc

SEQ ID NO: 1897 - DNA, 9 bp; single-stranded, linear
gggbggbcg

SEQ ID NO: 1898 - DNA, 7 bp; single-stranded, linear
gggtccg

SEQ ID NO: 1899 - DNA, 8 bp; single-stranded, linear
gggccccc

SEQ ID NO: 1900 - DNA, 567 bp; single-stranded, linear
ggbgctgbtbctgcbgatttcbgbgggbbgbbccctgbtbctcbccbgcttcbgctctggbgcbcbbgbgbbbgbgcbgcbgggggbgbggbbgbbgcbgcbtcttcccbgbgbggctgcctgbgcbbbtgctggttttcctttccbgtcttgggttttbtbbctcccbgbbggcbbgbgbggggcbbggcgttttcttctctcgctggttttcctttcctggcagtgggtgggggtgggggtggggtggcttccttgttcctgggggtgtcctcttgctctgggcttttctccccttttccttcctgtctgttttcctggggctctcctctgtctctgtgtccttgccctggccctcttccctctcctgtctcctgtccctgtgttccgcccgtcttccctctcctgacctccttttcctccgctgggtggggccctgcctgttctctgctccctggcttggggtttcttctgtgtgtcttcttcctctgttggctggctttctccttcttttgtcttcctgggtgccccttcttcctttcttgggtccttggtgcttgggctggg

SEQ ID NO: 1901 - DNA, 10 bp; single-stranded, linear
ggbgcbcbbg

SEQ ID NO: 1902 - DNA, 8 bp; single-stranded, linear
gbbgcbgc

SEQ ID NO: 1903 - DNA, 11 bp; single-stranded, linear
ggggcbbggcg

SEQ ID NO: 1904 - DNA, 190 bp; single-stranded, linear
ggbgctgbtbctgcbgatttcbgbgggbbgbbccctgbtbctcbccbgcttcbgctctggbgcbcbbgbgbbbgbgcbgcbgggggbgbggbbgbbgcbgcbtcttcccbgbgbggctgcctgbgcbbbtgctggttttcctttccbgtcttgggttttbtbbctcccbgbbggcbbgbgbggggcbbgg

SEQ ID NO: 1905 - DNA, 2028 bp; single-stranded, linear
gcgtcttggggtgcbgggcccbtcctgctgcgcctgggcgctgctgtgcgtccgtctgctggggggccggggtggctgggccctgcttgccgcacgaccccgggccgacccgaggctcggggggctgtgttctggcgctggtgggcttgggcccctctgggggctgggtttcctgctgcgcctgggcgctggcgtcttggggtgcggggccggggggccggggggccgctgttcgtgggcctgggggtgcctgtggctgccggttgccccggttggtggcgccgtcctgctgccggtcgttggctgggtccccccgcccgtttcctggggtccgcgtggggtgctccggttcctcgtgccgctgctgccttgtctttccggccgtggcggcgtggtggtccgccccccctggccttctgctcggggtctggctggttgccggtgcccttggcggcggtcttcttcctggtggctctgggcccggccggtctcgggcgtctcgtgttcgctcttgtgctgttccggccgctccttcctcttccgccgccgccgctccccgcccgctcgtcgccctggcccggcctcctcctggccgctgtctcgggcggcggccttggcgctccgtttggggctgcctctggcgcttccggccctcggcctgggcgctctcttccgcctgtgctggtggccctcgtgggcccctcctggcctccggtgtcctgtggtcccccggctggtggccgggccggttgggcgggcgtgggcgccggcgggtcctccgggctgcccttctccgccgggggtcccgcgctcctgctgttccctgggctcttctgcctctctcctgggtgggtgctgggtgccggggtctccgggcttgccccgcgctgctgggcgttctgcggtcttggggttgtctgtggccccgctcgtgtcgccctccgtcgcccgtcgccggcctcgtcccctcctgggtgcgcggcgggctggtcctggcgttttgctccttcctgggcgtcttggggtgcbgggcccbtcctgctgcgcctgggcgctgctgtgcgtccgtctgctggggggccggggtggctgggccctgcttgccgcacgaccccgggccgacccgaggctcggggggctgtgttctggcgctggtgggcttgggcccctctgggggctgggtttcctgctgcgcctgggcgctggcgtcttggggtgcggggccggggggccggggggccgctgttcgtgggcctgggggtgcctgtggctgccggttgccccggttggtggcgccgtcctgctgccggtcgttggctgggtccccccgcccgtttcctggggtccgcgtggggtgctccggttcctcgtgccgctgctgccttgtctttccggccgtggcggcgtggtggtccgccccccctggccttctgctcggggtctggctggttgccggtgcccttggcggcggtcttcttcctggtggctctgggcccggccggtctcgggcgtctcgtgttcgctcttgtgctgttccggccgctccttcctcttccgccgccgccgctccccgcccgctcgtcgccctggcccggcctcctcctggccgctgtctcgggcggcggccttggcgctccgtttggggctgcctctggcgcttccggccctcggcctgggcgctctcttccgcctgtgctggtggccctcgtgggcccctcctggcctccggtgtcctgtggtcccccggctggtggccgggccggttgggcgggcgtgggcgccggcgggtcctccgggctgcccttctccgccgggggtcccgcgctcctgctgttccctgggctcttctgcctctctcctgggtgggtgctgggtgccggggtctccgggcttgccccgcgctgctgggcgttctgcggtcttggggttgtctgtggccccgctcgtgtcgccctccgtcgcccgtcgccggcctcgtcccctcctgggtgcgcggcgggctggtcctggcgttttgctccttcctgg

SEQ ID NO: 1906 - DNA, 9 bp; single-stranded, linear
gcggggccg

SEQ ID NO: 1907 - DNA, 8 bp; single-stranded, linear
cggggggc

SEQ ID NO: 1908 - DNA, 11 bp; single-stranded, linear
gcgcggcgggc

SEQ ID NO: 1909 - DNA, 43 bp; single-stranded, linear
gcgtcttggggtgcbgggcccbtcctgctgcgcctgggcgctg

SEQ ID NO: 1910 - DNA, 535 bp; single-stranded, linear
ctgccccbgtttttgbtcctcbcbtgccgtggggbggbcbbtggctgcctccccggggtttctgctgcttgctgcttctttcccgtctcccttctttcccgtctcctttttgcctctttgggttcctgttgtttctggcctgcttggtggcggcttgtgcgtttcctctctcttctcttgggtctccgcttctcgtcctgccttttcctgtctctgtcgcgccgttcctcctccggcgtcctcctgccctgtgctgtttgcctcgggtggtgcgggtcccggtgctcccccggcgggccggctggttgcctgggcctgtctggtggggtgtggggccgctgggttgggggtgtggtgggctcttctgtggcctgtggggctgttggtgtctctgtgggcgtgtgctgggtcttggggcttcctcccttgtgctgggtgcggcctccccgccccccttctgggccggtggcctggctccttgtgggcgcttctggctcttgccctgtccttcttcgcctcgtggctgctgggctgc

SEQ ID NO: 1911 - DNA, 8 bp; single-stranded, linear
ccccgggg

SEQ ID NO: 1912 - DNA, 12 bp; single-stranded, linear
ggggccgctggg

SEQ ID NO: 1913 - DNA, 10 bp; single-stranded, linear
gggggtgtgg

SEQ ID NO: 1914 - DNA, 44 bp; single-stranded, linear
ctgccccbgtttttgbtcctcbcbtgccgtggggbggbcbbtgg

SEQ ID NO: 1915 - DNA, 756 bp; single-stranded, linear
cggcccttctcactggaggcaccgggcagtcctccatgggagggttgggcttggccggggctgcccggtgcctcctcttggctggtccctcgttgtccttgggccccgctcccgctgctcggcctccgtgttctttggcctcttgctccgcctgctgtcttgtcccgtcccctcctcgcttgcgtttccctcttccttgtcttccaggccttcctccgcttccgctgctggggcccgcgccgggggggcgctcggctccgcggcttcctccccggctggggggtcctggtctccggggcctgcggctcgcgggctcggggctgcgtgcgccgcgcgcggcgtccgcggtgggtggcgctgtcccgccgtggtgtgtctccgttctcgtcctgcgccgtcctggtctgcccgtggggtcctgggcgtggtggggggcgtctggtgcctcgtctgccccgtggggcttcgggctcggggctgttcgtcccccctgccgctctgtggcctccggggctcctcgttttcgctgcttcgggtgtccttctcggcgtgtggccccgggtcccggccctgctgggctgggcggggtcgctgccctgggcttctggcccgtctggttgtctgtcggtgcttgtctcgggtttctggcctctgtgctgggcgcttctctgcctcctgctccgccctcctggtggctcggctgggggtgcccgtgcgggggtgggtgtggggtgttttcggggtcctccccttccc

SEQ ID NO: 1916 - DNA, 12 bp; single-stranded, linear
gggcggggtcgc

SEQ ID NO: 1917 - DNA, 9 bp; single-stranded, linear
gcgccgtcc

SEQ ID NO: 1918 - DNA, 11 bp; single-stranded, linear
gggcgtggtgg

SEQ ID NO: 1919 - DNA, 43 bp; single-stranded, linear
cggcccttctcactggaggcaccgggcagtcctccatgggagg

SEQ ID NO: 1920 - DNA, 302 bp; single-stranded, linear
gtttcatcttggctttatcctctccccttgttcctcccctctcctgctctggrgtctcctcttccctccctcccctgccgtgttgtctgtgggtgtcgtttcgctcttgttgccctgggcccttccctgctgggggggagtttcatcttgggtttcbtcttggctttbtcctctccccttgttcctcccctctcctgctctggrgtctcctcttccctccctcccctgccgtgttgtctgtgggtgtcgtttcgctcttgttgccctgggcccttccctgctgggggggbgtttcbtcttgg

SEQ ID NO: 1921 - DNA, 9 bp; single-stranded, linear
gggggagtt

SEQ ID NO: 1922 - DNA, 11 bp; single-stranded, linear
gccctgggccc

SEQ ID NO: 1923 - DNA, 151 bp; single-stranded, linear
gtttcatcttggctttatcctctccccttgttcctcccctctcctgctctggrgtctcctcttccctccctcccctgccgtgttgtctgtgggtgtcgtttcgctcttgttgccctgggcccttccctgctgggggggagtttcatcttgg

SEQ ID NO: 1924 - DNA, 151 bp; single-stranded, linear
gtttcbtcttggctttbtcctctccccttgttcctcccctctcctgctctggrgtctcctcttccctccctcccctgccgtgttgtctgtgggtgtcgtttcgctcttgttgccctgggcccttccctgctgggggggbgtttcbtcttgg

SEQ ID NO: 1925 - DNA, 7 bp; single-stranded, linear
gggggbg

SEQ ID NO: 1926 - DNA, 10 bp; single-stranded, linear
gtgggtgtcc

SEQ ID NO: 1927 - DNA, 91 bp; single-stranded, linear
ccgtgttgtcbgtggtgctgcccgtttgbggtbtggcgctccbccbbttcccttttctccttgttttccgtttctcttgccgtctgtggtt

SEQ ID NO: 1928 - DNA, 17 bp; single-stranded, linear
cccgtttgbggtbtggc

SEQ ID NO: 1929 - DNA, 23 bp; single-stranded, linear
gctccbccbbttcccttttctcc

SEQ ID NO: 1930 - DNA, 19 bp; single-stranded, linear
ttgttttccgtttctcttg

SEQ ID NO: 1931 - DNA, 12 bp; single-stranded, linear
ccgtctgtggtt

SEQ ID NO: 1932 - DNA, 17 bp; single-stranded, linear
cccgtttgaggtatggc

SEQ ID NO: 1933 - DNA, 23 bp; single-stranded, linear
gctccbccaattcccttttctcc

SEQ ID NO: 1934 - DNA, 34 bp; single-stranded, linear
gggcccbgccccgccgccttttctbgccccggcc

SEQ ID NO: 1935 - DNA, 33 bp; single-stranded, linear
gggcccbgccccgccgccttttctbgccccggc

SEQ ID NO: 1936 - DNA, 32 bp; single-stranded, linear
gggcccbgccccgccgccttttctbgccccgg

SEQ ID NO: 1937 - DNA, 31 bp; single-stranded, linear
gggcccbgccccgccgccttttctbgccccg

SEQ ID NO: 1938 - DNA, 30 bp; single-stranded, linear
gggcccbgccccgccgccttttctbgcccc

SEQ ID NO: 1939 - DNA, 29 bp; single-stranded, linear
gggcccbgccccgccgccttttctbgccc

SEQ ID NO: 1940 - DNA, 28 bp; single-stranded, linear
gggcccbgccccgccgccttttctbgcc

SEQ ID NO: 1941 - DNA, 27 bp; single-stranded, linear
gggcccbgccccgccgccttttctbgc

SEQ ID NO: 1942 - DNA, 26 bp; single-stranded, linear
gggcccbgccccgccgccttttctbg

SEQ ID NO: 1943 - DNA, 25 bp; single-stranded, linear
gggcccbgccccgccgccttttctb

SEQ ID NO: 1944 - DNA, 24 bp; single-stranded, linear
gggcccbgccccgccgccttttct

SEQ ID NO: 1945 - DNA, 23 bp; single-stranded, linear
gggcccbgccccgccgccttttc

SEQ ID NO: 1946 - DNA, 22 bp; single-stranded, linear
gggcccbgccccgccgcctttt

SEQ ID NO: 1947 - DNA, 21 bp; single-stranded, linear
gggcccbgccccgccgccttt

SEQ ID NO: 1948 - DNA, 20 bp; single-stranded, linear
gggcccbgccccgccgcctt

SEQ ID NO: 1949 - DNA, 19 bp; single-stranded, linear
gggcccbgccccgccgcct

SEQ ID NO: 1950 - DNA, 18 bp; single-stranded, linear
gggcccbgccccgccgcc

SEQ ID NO: 1951 - DNA, 17 bp; single-stranded, linear
gggcccbgccccgccgc

SEQ ID NO: 1952 - DNA, 16 bp; single-stranded, linear
gggcccbgccccgccg

SEQ ID NO: 1953 - DNA, 15 bp; single-stranded, linear
gggcccbgccccgcc

SEQ ID NO: 1954 - DNA, 14 bp; single-stranded, linear
gggcccbgccccgc

SEQ ID NO: 1955 - DNA, 13 bp; single-stranded, linear
gggcccbgccccg

SEQ ID NO: 1956 - DNA, 12 bp; single-stranded, linear
gggcccbgcccc

SEQ ID NO: 1957 - DNA, 11 bp; single-stranded, linear
gggcccbgccc

SEQ ID NO: 1958 - DNA, 32 bp; single-stranded, linear
ggcccbgccccgccgccttttctbgccccggc

SEQ ID NO: 1959 - DNA, 31 bp; single-stranded, linear
gcccbgccccgccgccttttctbgccccggc

SEQ ID NO: 1960 - DNA, 30 bp; single-stranded, linear
cccbgccccgccgccttttctbgccccggc

SEQ ID NO: 1961 - DNA, 29 bp; single-stranded, linear
ccbgccccgccgccttttctbgccccggc

SEQ ID NO: 1962 - DNA, 28 bp; single-stranded, linear
cbgccccgccgccttttctbgccccggc

SEQ ID NO: 1963 - DNA, 27 bp; single-stranded, linear
bgccccgccgccttttctbgccccggc

SEQ ID NO: 1964 - DNA, 26 bp; single-stranded, linear
gccccgccgccttttctbgccccggc

SEQ ID NO: 1965 - DNA, 25 bp; single-stranded, linear
ccccgccgccttttctbgccccggc

SEQ ID NO: 1966 - DNA, 24 bp; single-stranded, linear
cccgccgccttttctbgccccggc

SEQ ID NO: 1967 - DNA, 23 bp; single-stranded, linear
ccgccgccttttctbgccccggc

SEQ ID NO: 1968 - DNA, 22 bp; single-stranded, linear
cgccgccttttctbgccccggc

SEQ ID NO: 1969 - DNA, 21 bp; single-stranded, linear
gccgccttttctbgccccggc

SEQ ID NO: 1970 - DNA, 20 bp; single-stranded, linear
ccgccttttctbgccccggc

SEQ ID NO: 1971 - DNA, 19 bp; single-stranded, linear
cgccttttctbgccccggc

SEQ ID NO: 1972 - DNA, 18 bp; single-stranded, linear
gccttttctbgccccggc

SEQ ID NO: 1973 - DNA, 17 bp; single-stranded, linear
ccttttctbgccccggc

SEQ ID NO: 1974 - DNA, 16 bp; single-stranded, linear
cttttctbgccccggc

SEQ ID NO: 1975 - DNA, 15 bp; single-stranded, linear
ttttctbgccccggc

SEQ ID NO: 1976 - DNA, 14 bp; single-stranded, linear
tttctbgccccggc

SEQ ID NO: 1977 - DNA, 13 bp; single-stranded, linear
ttctbgccccggc

SEQ ID NO: 1978 - DNA, 12 bp; single-stranded, linear
tctbgccccggc

SEQ ID NO: 1979 - DNA, 11 bp; single-stranded, linear
ctbgccccggc

SEQ ID NO: 1980 - DNA, 25 bp; single-stranded, linear
gcgbggctgtcbcctcgctgggccc

SEQ ID NO: 1981 - DNA, 24 bp; single-stranded, linear
gcgbggctgtcbcctcgctgggcc

SEQ ID NO: 1982 - DNA, 23 bp; single-stranded, linear
gcgbggctgtcbcctcgctgggc

SEQ ID NO: 1983 - DNA, 22 bp; single-stranded, linear
gcgbggctgtcbcctcgctggg

SEQ ID NO: 1984 - DNA, 21 bp; single-stranded, linear
gcgbggctgtcbcctcgctgg

SEQ ID NO: 1985 - DNA, 20 bp; single-stranded, linear
gcgbggctgtcbcctcgctg

SEQ ID NO: 1986 - DNA, 19 bp; single-stranded, linear
gcgbggctgtcbcctcgct

SEQ ID NO: 1987 - DNA, 18 bp; single-stranded, linear
gcgbggctgtcbcctcgc

SEQ ID NO: 1988 - DNA, 17 bp; single-stranded, linear
gcgbggctgtcbcctcg

SEQ ID NO: 1989 - DNA, 16 bp; single-stranded, linear
gcgbggctgtcbcctc

SEQ ID NO: 1990 - DNA, 15 bp; single-stranded, linear
gcgbggctgtcbcct

SEQ ID NO: 1991 - DNA, 14 bp; single-stranded, linear
gcgbggctgtcbcc

SEQ ID NO: 1992 - DNA, 13 bp; single-stranded, linear
gcgbggctgtcbc

SEQ ID NO: 1993 - DNA, 12 bp; single-stranded, linear
gcgbggctgtcb

SEQ ID NO: 1994 - DNA, 11 bp; single-stranded, linear
gcgbggctgtc

SEQ ID NO: 1995 - DNA, 10 bp; single-stranded, linear
gcgbggctgt

SEQ ID NO: 1996 - DNA, 24 bp; single-stranded, linear
cgbggctgtcbcctcgctgggccc

SEQ ID NO: 1997 - DNA, 23 bp; single-stranded, linear
gbggctgtcbcctcgctgggccc

SEQ ID NO: 1998 - DNA, 22 bp; single-stranded, linear
bggctgtcbcctcgctgggccc

SEQ ID NO: 1999 - DNA, 21 bp; single-stranded, linear
ggctgtcbcctcgctgggccc

SEQ ID NO: 2000 - DNA, 20 bp; single-stranded, linear
gctgtcbcctcgctgggccc

SEQ ID NO: 2001 - DNA, 19 bp; single-stranded, linear
ctgtcbcctcgctgggccc

SEQ ID NO: 2002 - DNA, 18 bp; single-stranded, linear
tgtcbcctcgctgggccc

SEQ ID NO: 2003 - DNA, 17 bp; single-stranded, linear
gtcbcctcgctgggccc

SEQ ID NO: 2004 - DNA, 16 bp; single-stranded, linear
tcbcctcgctgggccc

SEQ ID NO: 2005 - DNA, 15 bp; single-stranded, linear
cbcctcgctgggccc

SEQ ID NO: 2006 - DNA, 14 bp; single-stranded, linear
bcctcgctgggccc

SEQ ID NO: 2007 - DNA, 13 bp; single-stranded, linear
cctcgctgggccc

SEQ ID NO: 2008 - DNA, 12 bp; single-stranded, linear
ctcgctgggccc

SEQ ID NO: 2009 - DNA, 11 bp; single-stranded, linear
tcgctgggccc

SEQ ID NO: 2010 - DNA, 10 bp; single-stranded, linear
cgctgggccc

SEQ ID NO: 2011 - DNA, 31 bp; single-stranded, linear
gcgcggccgtcbtggcggcgtcgggccgggc

SEQ ID NO: 2012 - DNA, 30 bp; single-stranded, linear
gcgcggccgtcbtggcggcgtcgggccggg

SEQ ID NO: 2013 - DNA, 29 bp; single-stranded, linear
gcgcggccgtcbtggcggcgtcgggccgg

SEQ ID NO: 2014 - DNA, 28 bp; single-stranded, linear
gcgcggccgtcbtggcggcgtcgggccg

SEQ ID NO: 2015 - DNA, 27 bp; single-stranded, linear
gcgcggccgtcbtggcggcgtcgggcc

SEQ ID NO: 2016 - DNA, 26 bp; single-stranded, linear
gcgcggccgtcbtggcggcgtcgggc

SEQ ID NO: 2017 - DNA, 25 bp; single-stranded, linear
gcgcggccgtcbtggcggcgtcggg

SEQ ID NO: 2018 - DNA, 24 bp; single-stranded, linear
gcgcggccgtcbtggcggcgtcgg

SEQ ID NO: 2019 - DNA, 23 bp; single-stranded, linear
gcgcggccgtcbtggcggcgtcg

SEQ ID NO: 2020 - DNA, 22 bp; single-stranded, linear
gcgcggccgtcbtggcggcgtc

SEQ ID NO: 2021 - DNA, 21 bp; single-stranded, linear
gcgcggccgtcbtggcggcgt

SEQ ID NO: 2022 - DNA, 20 bp; single-stranded, linear
gcgcggccgtcbtggcggcg

SEQ ID NO: 2023 - DNA, 19 bp; single-stranded, linear
gcgcggccgtcbtggcggc

SEQ ID NO: 2024 - DNA, 18 bp; single-stranded, linear
gcgcggccgtcbtggcgg

SEQ ID NO: 2025 - DNA, 17 bp; single-stranded, linear
gcgcggccgtcbtggcg

SEQ ID NO: 2026 - DNA, 16 bp; single-stranded, linear
gcgcggccgtcbtggc

SEQ ID NO: 2027 - DNA, 15 bp; single-stranded, linear
gcgcggccgtcbtgg

SEQ ID NO: 2028 - DNA, 14 bp; single-stranded, linear
gcgcggccgtcbtg

SEQ ID NO: 2029 - DNA, 13 bp; single-stranded, linear
gcgcggccgtcbt

SEQ ID NO: 2030 - DNA, 12 bp; single-stranded, linear
gcgcggccgtcb

SEQ ID NO: 2031 - DNA, 11 bp; single-stranded, linear
gcgcggccgtc

SEQ ID NO: 2032 - DNA, 10 bp; single-stranded, linear
gcgcggccgt

SEQ ID NO: 2033 - DNA, 30 bp; single-stranded, linear
cgcggccgtcbtggcggcgtcgggccgggc

SEQ ID NO: 2034 - DNA, 29 bp; single-stranded, linear
gcggccgtcbtggcggcgtcgggccgggc

SEQ ID NO: 2035 - DNA, 28 bp; single-stranded, linear
cggccgtcbtggcggcgtcgggccgggc

SEQ ID NO: 2036 - DNA, 27 bp; single-stranded, linear
ggccgtcbtggcggcgtcgggccgggc

SEQ ID NO: 2037 - DNA, 26 bp; single-stranded, linear
gccgtcbtggcggcgtcgggccgggc

SEQ ID NO: 2038 - DNA, 25 bp; single-stranded, linear
ccgtcbtggcggcgtcgggccgggc

SEQ ID NO: 2039 - DNA, 24 bp; single-stranded, linear
cgtcbtggcggcgtcgggccgggc

SEQ ID NO: 2040 - DNA, 23 bp; single-stranded, linear
gtcbtggcggcgtcgggccgggc

SEQ ID NO: 2041 - DNA, 22 bp; single-stranded, linear
tcbtggcggcgtcgggccgggc

SEQ ID NO: 2042 - DNA, 21 bp; single-stranded, linear
cbtggcggcgtcgggccgggc

SEQ ID NO: 2043 - DNA, 20 bp; single-stranded, linear
btggcggcgtcgggccgggc

SEQ ID NO: 2044 - DNA, 19 bp; single-stranded, linear
tggcggcgtcgggccgggc

SEQ ID NO: 2045 - DNA, 18 bp; single-stranded, linear
ggcggcgtcgggccgggc

SEQ ID NO: 2046 - DNA, 17 bp; single-stranded, linear
gcggcgtcgggccgggc

SEQ ID NO: 2047 - DNA, 16 bp; single-stranded, linear
cggcgtcgggccgggc

SEQ ID NO: 2048 - DNA, 15 bp; single-stranded, linear
ggcgtcgggccgggc

SEQ ID NO: 2049 - DNA, 14 bp; single-stranded, linear
gcgtcgggccgggc

SEQ ID NO: 2050 - DNA, 13 bp; single-stranded, linear
cgtcgggccgggc

SEQ ID NO: 2051 - DNA, 12 bp; single-stranded, linear
gtcgggccgggc

SEQ ID NO: 2052 - DNA, 11 bp; single-stranded, linear
tcgggccgggc

SEQ ID NO: 2053 - DNA, 10 bp; single-stranded, linear
cgggccgggc

SEQ ID NO: 2054 - DNA, 32 bp; single-stranded, linear
ccgcbggccbgggcgcgccgccggccgggccg

SEQ ID NO: 2055 - DNA, 31 bp; single-stranded, linear
ccgcbggccbgggcgcgccgccggccgggcc

SEQ ID NO: 2056 - DNA, 30 bp; single-stranded, linear
ccgcbggccbgggcgcgccgccggccgggc

SEQ ID NO: 2057 - DNA, 29 bp; single-stranded, linear
ccgcbggccbgggcgcgccgccggccggg

SEQ ID NO: 2058 - DNA, 28 bp; single-stranded, linear
ccgcbggccbgggcgcgccgccggccgg

SEQ ID NO: 2059 - DNA, 27 bp; single-stranded, linear
ccgcbggccbgggcgcgccgccggccg

SEQ ID NO: 2060 - DNA, 26 bp; single-stranded, linear
ccgcbggccbgggcgcgccgccggcc

SEQ ID NO: 2061 - DNA, 25 bp; single-stranded, linear
ccgcbggccbgggcgcgccgccggc

SEQ ID NO: 2062 - DNA, 24 bp; single-stranded, linear
ccgcbggccbgggcgcgccgccgg

SEQ ID NO: 2063 - DNA, 23 bp; single-stranded, linear
ccgcbggccbgggcgcgccgccg

SEQ ID NO: 2064 - DNA, 22 bp; single-stranded, linear
ccgcbggccbgggcgcgccgcc

SEQ ID NO: 2065 - DNA, 21 bp; single-stranded, linear
ccgcbggccbgggcgcgccgc

SEQ ID NO: 2066 - DNA, 20 bp; single-stranded, linear
ccgcbggccbgggcgcgccg

SEQ ID NO: 2067 - DNA, 19 bp; single-stranded, linear
ccgcbggccbgggcgcgcc

SEQ ID NO: 2068 - DNA, 18 bp; single-stranded, linear
ccgcbggccbgggcgcgc

SEQ ID NO: 2069 - DNA, 17 bp; single-stranded, linear
ccgcbggccbgggcgcg

SEQ ID NO: 2070 - DNA, 16 bp; single-stranded, linear
ccgcbggccbgggcgc

SEQ ID NO: 2071 - DNA, 15 bp; single-stranded, linear
ccgcbggccbgggcg

SEQ ID NO: 2072 - DNA, 14 bp; single-stranded, linear
ccgcbggccbgggc

SEQ ID NO: 2073 - DNA, 13 bp; single-stranded, linear
ccgcbggccbggg

SEQ ID NO: 2074 - DNA, 12 bp; single-stranded, linear
ccgcbggccbgg

SEQ ID NO: 2075 - DNA, 11 bp; single-stranded, linear
ccgcbggccbg

SEQ ID NO: 2076 - DNA, 10 bp; single-stranded, linear
ccgcbggccb

SEQ ID NO: 2077 - DNA, 9 bp; single-stranded, linear
ccgcbggcc

SEQ ID NO: 2078 - DNA, 31 bp; single-stranded, linear
cgcbggccbgggcgcgccgccggccgggccg

SEQ ID NO: 2079 - DNA, 30 bp; single-stranded, linear
gcbggccbgggcgcgccgccggccgggccg

SEQ ID NO: 2080 - DNA, 29 bp; single-stranded, linear
cbggccbgggcgcgccgccggccgggccg

SEQ ID NO: 2081 - DNA, 28 bp; single-stranded, linear
bggccbgggcgcgccgccggccgggccg

SEQ ID NO: 2082 - DNA, 27 bp; single-stranded, linear
ggccbgggcgcgccgccggccgggccg

SEQ ID NO: 2083 - DNA, 26 bp; single-stranded, linear
gccbgggcgcgccgccggccgggccg

SEQ ID NO: 2084 - DNA, 25 bp; single-stranded, linear
ccbgggcgcgccgccggccgggccg

SEQ ID NO: 2085 - DNA, 24 bp; single-stranded, linear
cbgggcgcgccgccggccgggccg

SEQ ID NO: 2086 - DNA, 23 bp; single-stranded, linear
bgggcgcgccgccggccgggccg

SEQ ID NO: 2087 - DNA, 22 bp; single-stranded, linear
gggcgcgccgccggccgggccg

SEQ ID NO: 2088 - DNA, 21 bp; single-stranded, linear
ggcgcgccgccggccgggccg

SEQ ID NO: 2089 - DNA, 20 bp; single-stranded, linear
gcgcgccgccggccgggccg

SEQ ID NO: 2090 - DNA, 19 bp; single-stranded, linear
cgcgccgccggccgggccg

SEQ ID NO: 2091 - DNA, 18 bp; single-stranded, linear
gcgccgccggccgggccg

SEQ ID NO: 2092 - DNA, 17 bp; single-stranded, linear
cgccgccggccgggccg

SEQ ID NO: 2093 - DNA, 16 bp; single-stranded, linear
gccgccggccgggccg

SEQ ID NO: 2094 - DNA, 15 bp; single-stranded, linear
ccgccggccgggccg

SEQ ID NO: 2095 - DNA, 14 bp; single-stranded, linear
cgccggccgggccg

SEQ ID NO: 2096 - DNA, 13 bp; single-stranded, linear
gccggccgggccg

SEQ ID NO: 2097 - DNA, 12 bp; single-stranded, linear
ccggccgggccg

SEQ ID NO: 2098 - DNA, 11 bp; single-stranded, linear
cggccgggccg

SEQ ID NO: 2099 - DNA, 10 bp; single-stranded, linear
ggccgggccg

SEQ ID NO: 2100 - DNA, 16 bp; single-stranded, linear
gggcgcbggctccgcb

SEQ ID NO: 2101 - DNA, 46 bp; single-stranded, linear
gggcccctggctcggccccgcggcccggcttgcccgcccggcccgg

SEQ ID NO: 2102 - DNA, 45 bp; single-stranded, linear
gggcccctggctcggccccgcggcccggcttgcccgcccggcccg

SEQ ID NO: 2103 - DNA, 44 bp; single-stranded, linear
gggcccctggctcggccccgcggcccggcttgcccgcccggccc

SEQ ID NO: 2104 - DNA, 43 bp; single-stranded, linear
gggcccctggctcggccccgcggcccggcttgcccgcccggcc

SEQ ID NO: 2105 - DNA, 42 bp; single-stranded, linear
gggcccctggctcggccccgcggcccggcttgcccgcccggc

SEQ ID NO: 2106 - DNA, 41 bp; single-stranded, linear
gggcccctggctcggccccgcggcccggcttgcccgcccgg

SEQ ID NO: 2107 - DNA, 40 bp; single-stranded, linear
gggcccctggctcggccccgcggcccggcttgcccgcccg

SEQ ID NO: 2108 - DNA, 39 bp; single-stranded, linear
gggcccctggctcggccccgcggcccggcttgcccgccc

SEQ ID NO: 2109 - DNA, 38 bp; single-stranded, linear
gggcccctggctcggccccgcggcccggcttgcccgcc

SEQ ID NO: 2110 - DNA, 37 bp; single-stranded, linear
gggcccctggctcggccccgcggcccggcttgcccgc

SEQ ID NO: 2111 - DNA, 36 bp; single-stranded, linear
gggcccctggctcggccccgcggcccggcttgcccg

SEQ ID NO: 2112 - DNA, 35 bp; single-stranded, linear
gggcccctggctcggccccgcggcccggcttgccc

SEQ ID NO: 2113 - DNA, 34 bp; single-stranded, linear
gggcccctggctcggccccgcggcccggcttgcc

SEQ ID NO: 2114 - DNA, 33 bp; single-stranded, linear
gggcccctggctcggccccgcggcccggcttgc

SEQ ID NO: 2115 - DNA, 32 bp; single-stranded, linear
gggcccctggctcggccccgcggcccggcttg

SEQ ID NO: 2116 - DNA, 31 bp; single-stranded, linear
gggcccctggctcggccccgcggcccggctt

SEQ ID NO: 2117 - DNA, 30 bp; single-stranded, linear
gggcccctggctcggccccgcggcccggct

SEQ ID NO: 2118 - DNA, 29 bp; single-stranded, linear
gggcccctggctcggccccgcggcccggc

SEQ ID NO: 2119 - DNA, 28 bp; single-stranded, linear
gggcccctggctcggccccgcggcccgg

SEQ ID NO: 2120 - DNA, 27 bp; single-stranded, linear
gggcccctggctcggccccgcggcccg

SEQ ID NO: 2121 - DNA, 26 bp; single-stranded, linear
gggcccctggctcggccccgcggccc

SEQ ID NO: 2122 - DNA, 25 bp; single-stranded, linear
gggcccctggctcggccccgcggcc

SEQ ID NO: 2123 - DNA, 24 bp; single-stranded, linear
gggcccctggctcggccccgcggc

SEQ ID NO: 2124 - DNA, 23 bp; single-stranded, linear
gggcccctggctcggccccgcgg

SEQ ID NO: 2125 - DNA, 22 bp; single-stranded, linear
gggcccctggctcggccccgcg

SEQ ID NO: 2126 - DNA, 21 bp; single-stranded, linear
gggcccctggctcggccccgc

SEQ ID NO: 2127 - DNA, 20 bp; single-stranded, linear
gggcccctggctcggccccg

SEQ ID NO: 2128 - DNA, 19 bp; single-stranded, linear
gggcccctggctcggcccc

SEQ ID NO: 2129 - DNA, 18 bp; single-stranded, linear
gggcccctggctcggccc

SEQ ID NO: 2130 - DNA, 17 bp; single-stranded, linear
gggcccctggctcggcc

SEQ ID NO: 2131 - DNA, 16 bp; single-stranded, linear
gggcccctggctcggc

SEQ ID NO: 2132 - DNA, 15 bp; single-stranded, linear
gggcccctggctcgg

SEQ ID NO: 2133 - DNA, 14 bp; single-stranded, linear
gggcccctggctcg

SEQ ID NO: 2134 - DNA, 13 bp; single-stranded, linear
gggcccctggctc

SEQ ID NO: 2135 - DNA, 12 bp; single-stranded, linear
gggcccctggct

SEQ ID NO: 2136 - DNA, 45 bp; single-stranded, linear
ggcccctggctcggccccgcggcccggcttgcccgcccggcccgg

SEQ ID NO: 2137 - DNA, 44 bp; single-stranded, linear
gcccctggctcggccccgcggcccggcttgcccgcccggcccgg

SEQ ID NO: 2138 - DNA, 43 bp; single-stranded, linear
cccctggctcggccccgcggcccggcttgcccgcccggcccgg

SEQ ID NO: 2139 - DNA, 42 bp; single-stranded, linear
ccctggctcggccccgcggcccggcttgcccgcccggcccgg

SEQ ID NO: 2140 - DNA, 41 bp; single-stranded, linear
cctggctcggccccgcggcccggcttgcccgcccggcccgg

SEQ ID NO: 2141 - DNA, 40 bp; single-stranded, linear
ctggctcggccccgcggcccggcttgcccgcccggcccgg

SEQ ID NO: 2142 - DNA, 39 bp; single-stranded, linear
tggctcggccccgcggcccggcttgcccgcccggcccgg

SEQ ID NO: 2143 - DNA, 38 bp; single-stranded, linear
ggctcggccccgcggcccggcttgcccgcccggcccgg

SEQ ID NO: 2144 - DNA, 37 bp; single-stranded, linear
gctcggccccgcggcccggcttgcccgcccggcccgg

SEQ ID NO: 2145 - DNA, 36 bp; single-stranded, linear
ctcggccccgcggcccggcttgcccgcccggcccgg

SEQ ID NO: 2146 - DNA, 35 bp; single-stranded, linear
tcggccccgcggcccggcttgcccgcccggcccgg

SEQ ID NO: 2147 - DNA, 34 bp; single-stranded, linear
cggccccgcggcccggcttgcccgcccggcccgg

SEQ ID NO: 2148 - DNA, 33 bp; single-stranded, linear
ggccccgcggcccggcttgcccgcccggcccgg

SEQ ID NO: 2149 - DNA, 32 bp; single-stranded, linear
gccccgcggcccggcttgcccgcccggcccgg

SEQ ID NO: 2150 - DNA, 31 bp; single-stranded, linear
ccccgcggcccggcttgcccgcccggcccgg

SEQ ID NO: 2151 - DNA, 30 bp; single-stranded, linear
cccgcggcccggcttgcccgcccggcccgg

SEQ ID NO: 2152 - DNA, 29 bp; single-stranded, linear
ccgcggcccggcttgcccgcccggcccgg

SEQ ID NO: 2153 - DNA, 28 bp; single-stranded, linear
cgcggcccggcttgcccgcccggcccgg

SEQ ID NO: 2154 - DNA, 27 bp; single-stranded, linear
gcggcccggcttgcccgcccggcccgg

SEQ ID NO: 2155 - DNA, 26 bp; single-stranded, linear
cggcccggcttgcccgcccggcccgg

SEQ ID NO: 2156 - DNA, 25 bp; single-stranded, linear
ggcccggcttgcccgcccggcccgg

SEQ ID NO: 2157 - DNA, 24 bp; single-stranded, linear
gcccggcttgcccgcccggcccgg

SEQ ID NO: 2158 - DNA, 23 bp; single-stranded, linear
cccggcttgcccgcccggcccgg

SEQ ID NO: 2159 - DNA, 22 bp; single-stranded, linear
ccggcttgcccgcccggcccgg

SEQ ID NO: 2160 - DNA, 21 bp; single-stranded, linear
cggcttgcccgcccggcccgg

SEQ ID NO: 2161 - DNA, 20 bp; single-stranded, linear
ggcttgcccgcccggcccgg

SEQ ID NO: 2162 - DNA, 19 bp; single-stranded, linear
gcttgcccgcccggcccgg

SEQ ID NO: 2163 - DNA, 18 bp; single-stranded, linear
cttgcccgcccggcccgg

SEQ ID NO: 2164 - DNA, 17 bp; single-stranded, linear
ttgcccgcccggcccgg

SEQ ID NO: 2165 - DNA, 16 bp; single-stranded, linear
tgcccgcccggcccgg

SEQ ID NO: 2166 - DNA, 15 bp; single-stranded, linear
gcccgcccggcccgg

SEQ ID NO: 2167 - DNA, 14 bp; single-stranded, linear
cccgcccggcccgg

SEQ ID NO: 2168 - DNA, 13 bp; single-stranded, linear
ccgcccggcccgg

SEQ ID NO: 2169 - DNA, 12 bp; single-stranded, linear
cgcccggcccgg

SEQ ID NO: 2170 - DNA, 11 bp; single-stranded, linear
gcccggcccgg

SEQ ID NO: 2171 - DNA, 36 bp; single-stranded, linear
ggcgggggcggcggcgcctggctcgcctbgggcccc

SEQ ID NO: 2172 - DNA, 35 bp; single-stranded, linear
ggcgggggcggcggcgcctggctcgcctbgggccc

SEQ ID NO: 2173 - DNA, 34 bp; single-stranded, linear
ggcgggggcggcggcgcctggctcgcctbgggcc

SEQ ID NO: 2174 - DNA, 33 bp; single-stranded, linear
ggcgggggcggcggcgcctggctcgcctbgggc

SEQ ID NO: 2175 - DNA, 32 bp; single-stranded, linear
ggcgggggcggcggcgcctggctcgcctbggg

SEQ ID NO: 2176 - DNA, 31 bp; single-stranded, linear
ggcgggggcggcggcgcctggctcgcctbgg

SEQ ID NO: 2177 - DNA, 30 bp; single-stranded, linear
ggcgggggcggcggcgcctggctcgcctbg

SEQ ID NO: 2178 - DNA, 29 bp; single-stranded, linear
ggcgggggcggcggcgcctggctcgcctb

SEQ ID NO: 2179 - DNA, 28 bp; single-stranded, linear
ggcgggggcggcggcgcctggctcgcct

SEQ ID NO: 2180 - DNA, 27 bp; single-stranded, linear
ggcgggggcggcggcgcctggctcgcc

SEQ ID NO: 2181 - DNA, 26 bp; single-stranded, linear
ggcgggggcggcggcgcctggctcgc

SEQ ID NO: 2182 - DNA, 25 bp; single-stranded, linear
ggcgggggcggcggcgcctggctcg

SEQ ID NO: 2183 - DNA, 24 bp; single-stranded, linear
ggcgggggcggcggcgcctggctc

SEQ ID NO: 2184 - DNA, 23 bp; single-stranded, linear
ggcgggggcggcggcgcctggct

SEQ ID NO: 2185 - DNA, 22 bp; single-stranded, linear
ggcgggggcggcggcgcctggc

SEQ ID NO: 2186 - DNA, 21 bp; single-stranded, linear
ggcgggggcggcggcgcctgg

SEQ ID NO: 2187 - DNA, 20 bp; single-stranded, linear
ggcgggggcggcggcgcctg

SEQ ID NO: 2188 - DNA, 19 bp; single-stranded, linear
ggcgggggcggcggcgcct

SEQ ID NO: 2189 - DNA, 18 bp; single-stranded, linear
ggcgggggcggcggcgcc

SEQ ID NO: 2190 - DNA, 17 bp; single-stranded, linear
ggcgggggcggcggcgc

SEQ ID NO: 2191 - DNA, 16 bp; single-stranded, linear
ggcgggggcggcggcg

SEQ ID NO: 2192 - DNA, 15 bp; single-stranded, linear
ggcgggggcggcggc

SEQ ID NO: 2193 - DNA, 14 bp; single-stranded, linear
ggcgggggcggcgg

SEQ ID NO: 2194 - DNA, 13 bp; single-stranded, linear
ggcgggggcggcg

SEQ ID NO: 2195 - DNA, 12 bp; single-stranded, linear
ggcgggggcggc

SEQ ID NO: 2196 - DNA, 11 bp; single-stranded, linear
ggcgggggcgg

SEQ ID NO: 2197 - DNA, 35 bp; single-stranded, linear
gcgggggcggcggcgcctggctcgcctbgggcccc

SEQ ID NO: 2198 - DNA, 34 bp; single-stranded, linear
cgggggcggcggcgcctggctcgcctbgggcccc

SEQ ID NO: 2199 - DNA, 33 bp; single-stranded, linear
gggggcggcggcgcctggctcgcctbgggcccc

SEQ ID NO: 2200 - DNA, 32 bp; single-stranded, linear
ggggcggcggcgcctggctcgcctbgggcccc

SEQ ID NO: 2201 - DNA, 31 bp; single-stranded, linear
gggcggcggcgcctggctcgcctbgggcccc

SEQ ID NO: 2202 - DNA, 30 bp; single-stranded, linear
ggcggcggcgcctggctcgcctbgggcccc

SEQ ID NO: 2203 - DNA, 29 bp; single-stranded, linear
gcggcggcgcctggctcgcctbgggcccc

SEQ ID NO: 2204 - DNA, 28 bp; single-stranded, linear
cggcggcgcctggctcgcctbgggcccc

SEQ ID NO: 2205 - DNA, 27 bp; single-stranded, linear
ggcggcgcctggctcgcctbgggcccc

SEQ ID NO: 2206 - DNA, 26 bp; single-stranded, linear
gcggcgcctggctcgcctbgggcccc

SEQ ID NO: 2207 - DNA, 25 bp; single-stranded, linear
cggcgcctggctcgcctbgggcccc

SEQ ID NO: 2208 - DNA, 24 bp; single-stranded, linear
ggcgcctggctcgcctbgggcccc

SEQ ID NO: 2209 - DNA, 23 bp; single-stranded, linear
gcgcctggctcgcctbgggcccc

SEQ ID NO: 2210 - DNA, 22 bp; single-stranded, linear
cgcctggctcgcctbgggcccc

SEQ ID NO: 2211 - DNA, 21 bp; single-stranded, linear
gcctggctcgcctbgggcccc

SEQ ID NO: 2212 - DNA, 20 bp; single-stranded, linear
cctggctcgcctbgggcccc

SEQ ID NO: 2213 - DNA, 19 bp; single-stranded, linear
ctggctcgcctbgggcccc

SEQ ID NO: 2214 - DNA, 18 bp; single-stranded, linear
tggctcgcctbgggcccc

SEQ ID NO: 2215 - DNA, 17 bp; single-stranded, linear
ggctcgcctbgggcccc

SEQ ID NO: 2216 - DNA, 16 bp; single-stranded, linear
gctcgcctbgggcccc

SEQ ID NO: 2217 - DNA, 15 bp; single-stranded, linear
ctcgcctbgggcccc

SEQ ID NO: 2218 - DNA, 14 bp; single-stranded, linear
tcgcctbgggcccc

SEQ ID NO: 2219 - DNA, 13 bp; single-stranded, linear
cgcctbgggcccc

SEQ ID NO: 2220 - DNA, 12 bp; single-stranded, linear
gcctbgggcccc

SEQ ID NO: 2221 - DNA, 11 bp; single-stranded, linear
cctbgggcccc

SEQ ID NO: 2222 - DNA, 10 bp; single-stranded, linear
ctbgggcccc

SEQ ID NO: 2223 - DNA, 17 bp; single-stranded, linear
gggtgggcbcggcggcc

SEQ ID NO: 2224 - DNA, 24 bp; single-stranded, linear
ggtcggcgbbgbgctcgtcgtggc

SEQ ID NO: 2225 - DNA, 23 bp; single-stranded, linear
ggtcggcgbbgbgctcgtcgtgg

SEQ ID NO: 2226 - DNA, 22 bp; single-stranded, linear
ggtcggcgbbgbgctcgtcgtg

SEQ ID NO: 2227 - DNA, 21 bp; single-stranded, linear
ggtcggcgbbgbgctcgtcgt

SEQ ID NO: 2228 - DNA, 20 bp; single-stranded, linear
ggtcggcgbbgbgctcgtcg

SEQ ID NO: 2229 - DNA, 19 bp; single-stranded, linear
ggtcggcgbbgbgctcgtc

SEQ ID NO: 2230 - DNA, 18 bp; single-stranded, linear
ggtcggcgbbgbgctcgt

SEQ ID NO: 2231 - DNA, 17 bp; single-stranded, linear
ggtcggcgbbgbgctcg

SEQ ID NO: 2232 - DNA, 16 bp; single-stranded, linear
ggtcggcgbbgbgctc

SEQ ID NO: 2233 - DNA, 15 bp; single-stranded, linear
ggtcggcgbbgbgct

SEQ ID NO: 2234 - DNA, 14 bp; single-stranded, linear
ggtcggcgbbgbgc

SEQ ID NO: 2235 - DNA, 13 bp; single-stranded, linear
ggtcggcgbbgbg

SEQ ID NO: 2236 - DNA, 12 bp; single-stranded, linear
ggtcggcgbbgb

SEQ ID NO: 2237 - DNA, 11 bp; single-stranded, linear
ggtcggcgbbg

SEQ ID NO: 2238 - DNA, 23 bp; single-stranded, linear
gtcggcgbbgbgctcgtcgtggc

SEQ ID NO: 2239 - DNA, 22 bp; single-stranded, linear
tcggcgbbgbgctcgtcgtggc

SEQ ID NO: 2240 - DNA, 21 bp; single-stranded, linear
cggcgbbgbgctcgtcgtggc

SEQ ID NO: 2241 - DNA, 20 bp; single-stranded, linear
ggcgbbgbgctcgtcgtggc

SEQ ID NO: 2242 - DNA, 19 bp; single-stranded, linear
gcgbbgbgctcgtcgtggc

SEQ ID NO: 2243 - DNA, 18 bp; single-stranded, linear
cgbbgbgctcgtcgtggc

SEQ ID NO: 2244 - DNA, 17 bp; single-stranded, linear
gbbgbgctcgtcgtggc

SEQ ID NO: 2245 - DNA, 16 bp; single-stranded, linear
bbgbgctcgtcgtggc

SEQ ID NO: 2246 - DNA, 15 bp; single-stranded, linear
bgbgctcgtcgtggc

SEQ ID NO: 2247 - DNA, 14 bp; single-stranded, linear
gbgctcgtcgtggc

SEQ ID NO: 2248 - DNA, 13 bp; single-stranded, linear
bgctcgtcgtggc

SEQ ID NO: 2249 - DNA, 12 bp; single-stranded, linear
gctcgtcgtggc

SEQ ID NO: 2250 - DNA, 11 bp; single-stranded, linear
ctcgtcgtggc

SEQ ID NO: 2251 - DNA, 10 bp; single-stranded, linear
tcgtcgtggc

SEQ ID NO: 2252 - DNA, 20 bp; single-stranded, linear
ggggccccgcgccgcccgcc

SEQ ID NO: 2253 - DNA, 19 bp; single-stranded, linear
ggggccccgcgccgcccgc

SEQ ID NO: 2254 - DNA, 18 bp; single-stranded, linear
ggggccccgcgccgcccg

SEQ ID NO: 2255 - DNA, 17 bp; single-stranded, linear
ggggccccgcgccgccc

SEQ ID NO: 2256 - DNA, 16 bp; single-stranded, linear
ggggccccgcgccgcc

SEQ ID NO: 2257 - DNA, 15 bp; single-stranded, linear
ggggccccgcgccgc

SEQ ID NO: 2258 - DNA, 14 bp; single-stranded, linear
ggggccccgcgccg

SEQ ID NO: 2259 - DNA, 13 bp; single-stranded, linear
ggggccccgcgcc

SEQ ID NO: 2260 - DNA, 12 bp; single-stranded, linear
ggggccccgcgc

SEQ ID NO: 2261 - DNA, 19 bp; single-stranded, linear
gggccccgcgccgcccgcc

SEQ ID NO: 2262 - DNA, 18 bp; single-stranded, linear
ggccccgcgccgcccgcc

SEQ ID NO: 2263 - DNA, 17 bp; single-stranded, linear
gccccgcgccgcccgcc

SEQ ID NO: 2264 - DNA, 16 bp; single-stranded, linear
ccccgcgccgcccgcc

SEQ ID NO: 2265 - DNA, 15 bp; single-stranded, linear
cccgcgccgcccgcc

SEQ ID NO: 2266 - DNA, 14 bp; single-stranded, linear
ccgcgccgcccgcc

SEQ ID NO: 2267 - DNA, 13 bp; single-stranded, linear
cgcgccgcccgcc

SEQ ID NO: 2268 - DNA, 12 bp; single-stranded, linear
gcgccgcccgcc

SEQ ID NO: 2269 - DNA, 11 bp; single-stranded, linear
cgccgcccgcc

SEQ ID NO: 2270 - DNA, 10 bp; single-stranded, linear
gccgcccgcc

SEQ ID NO: 2271 - DNA, 21 bp; single-stranded, linear
ggggcgcgcggggccgccggg

SEQ ID NO: 2272 - DNA, 26 bp; single-stranded, linear
ggcggggbgcggcbgggcccgggccc

SEQ ID NO: 2273 - DNA, 33 bp; single-stranded, linear
ggcgcgtcgccgtcgccccbgtcgggctcgcgc

SEQ ID NO: 2274 - DNA, 26 bp; single-stranded, linear
gcgcgggcbbcbgcgbgccgggcgcg

SEQ ID NO: 2275 - DNA, 24 bp; single-stranded, linear
gcgcbcgggcccbcctgcgcgggc

SEQ ID NO: 2276 - DNA, 28 bp; single-stranded, linear
gggcggggtgggctgccctgcggccgcc

SEQ ID NO: 2277 - DNA, 26 bp; single-stranded, linear
gggctgctgcgcggcggctccggcga

SEQ ID NO: 2278 - DNA, 25 bp; single-stranded, linear
ctcccgggcggggccgggcgcgggg

SEQ ID NO: 2279 - DNA, 33 bp; single-stranded, linear
gggctgccgcggtccgggcccctcttgccggcg

SEQ ID NO: 2280 - DNA, 19 bp; single-stranded, linear
gcgctcgcgccgctgccgg

SEQ ID NO: 2281 - DNA, 23 bp; single-stranded, linear
gcgccgcttggccttgtcgcggc

SEQ ID NO: 2282 - DNA, 17 bp; single-stranded, linear
gctgctccbcgcgctgg

SEQ ID NO: 2283 - DNA, 24 bp; single-stranded, linear
gccggbggccggccbggtcccgcg

SEQ ID NO: 2284 - DNA, 31 bp; single-stranded, linear
cccggcggccggcbggbbgggcgggctgggc

SEQ ID NO: 2285 - DNA, 23 bp; single-stranded, linear
gtctctcccgccccggccgcgcg

SEQ ID NO: 2286 - DNA, 24 bp; single-stranded, linear
gggcgtccgctccgggccgtcggg

SEQ ID NO: 2287 - DNA, 28 bp; single-stranded, linear
gcgggcacgcggcggctctggcgtcggc

SEQ ID NO: 2288 - DNA, 681 bp; single-stranded, linear
ggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggccgtgttgtcbgtggtgctgcccgtttgbggtbtggcgctccbccbbttcccttttctccttgttttccgtttctcttgccgtctgtggtt

SEQ ID NO: 2289 - DNA, 23 bp; single-stranded, linear
ggtgbcbttgbgcbtgtcggcgc

SEQ ID NO: 2290 - DNA, 21 bp; single-stranded, linear
ggtcccgttbbgbgtgggccc

SEQ ID NO: 2291 - DNA, 27 bp; single-stranded, linear
gccagcccagccactccacttgggggc

SEQ ID NO: 2292 - DNA, 38 bp; single-stranded, linear
gggtggccagcacgaacagcacccagaggaaggggggc

SEQ ID NO: 2293 - DNA, 46 bp; single-stranded, linear
ggcccagaagggcagcccgcaggccaggatcaggtctgctgcggcc

SEQ ID NO: 2294 - DNA, 26 bp; single-stranded, linear
ggagataatggcattcaccacgcggc

SEQ ID NO: 2295 - DNA, 28 bp; single-stranded, linear
ggcccagcgcacgccgcgcatccggccc

SEQ ID NO: 2296 - DNA, 21 bp; single-stranded, linear
gggttctgacctgcagccccc

SEQ ID NO: 2297 - DNA, 23 bp; single-stranded, linear
gtctccttggcattcctgggccc

SEQ ID NO: 2298 - DNA, 23 bp; single-stranded, linear
cagtcactcctctccctgccccc

SEQ ID NO: 2299 - DNA, 19 bp; single-stranded, linear
cttgctggggcagggacgg

SEQ ID NO: 2300 - DNA, 23 bp; single-stranded, linear
ggtgbcbttgbgcbtgtcggcgc

SEQ ID NO: 2301 - DNA, 21 bp; single-stranded, linear
ggtcccgttbbgbgtgggccc

SEQ ID NO: 2302 - DNA, 27 bp; single-stranded, linear
gccagcccagccactccacttgggggc

SEQ ID NO: 2303 - DNA, 38 bp; single-stranded, linear; identical to SEQ ID NO: 2292

SEQ ID NO: 2304 - DNA, 46 bp; single-stranded, linear; identical to SEQ ID NO: 2293

SEQ ID NO: 2305 - DNA, 26 bp; single-stranded, linear
ggagataatggcattcaccacgcggc

SEQ ID NO: 2306 - DNA, 28 bp; single-stranded, linear
ggcccagcgcacgccgcgcatccggccc

SEQ ID NO: 2307 - DNA, 21 bp; single-stranded, linear
gggttctgacctgcagccccc

SEQ ID NO: 2308 - DNA, 23 bp; single-stranded, linear
gtctccttggcattcctgggccc

SEQ ID NO: 2309 - DNA, 23 bp; single-stranded, linear
cagtcactcctctccctgccccc

SEQ ID NO: 2310 - DNA, 19 bp; single-stranded, linear
cttgctggggcagggacgg

SEQ ID NO: 2311 - DNA, 20 bp; single-stranded, linear
ccgtgttgtcbgtggtgctg

SEQ ID NO: 2312 - DNA, 17 bp; single-stranded, linear
cccgtttgbggtbtggc

SEQ ID NO: 2313 - DNA, 23 bp; single-stranded, linear
gctccbccbbttcccttttctcc

SEQ ID NO: 2314 - DNA, 19 bp; single-stranded, linear
ttgttttccgtttctcttg

SEQ ID NO: 2315 - DNA, 12 bp; single-stranded, linear
ccgtctgtggtt

SEQ ID NO: 2316 - DNA, 19 bp; single-stranded, linear
cccggccccgcctcgtgcc

SEQ ID NO: 2317 - DNA, 18 bp; single-stranded, linear
cgtccbtgccgcgggccc

SEQ ID NO: 2318 - DNA, 28 bp; single-stranded, linear
gccccgctgcttgggctgctctgccggg

SEQ ID NO: 2319 - DNA, 21 bp; single-stranded, linear
tctgtgctcctctcgcctggg

SEQ ID NO: 2320 - DNA, 21 bp; single-stranded, linear
tggtggggtgggtcttggtgg

SEQ ID NO: 2321 - DNA, 17 bp; single-stranded, linear
ctgtccctggtcctgtg

SEQ ID NO: 2322 - DNA, 14 bp; single-stranded, linear
ggtcccgcttcttc

SEQ ID NO: 2323 - DNA, 19 bp; single-stranded, linear
ggggttgttgttggtctgg

SEQ ID NO: 2324 - DNA, 14 bp; single-stranded, linear
tgtcctctttctgc

SEQ ID NO: 2325 - DNA, 14 bp; single-stranded, linear
gcctcgggcctccc

SEQ ID NO: 2326 - DNA, 15 bp; single-stranded, linear
ggctggggtctgcgt

SEQ ID NO: 2327 - DNA, 24 bp; single-stranded, linear
ggccgggggtcggtgggtccgctg

SEQ ID NO: 2328 - DNA, 22 bp; single-stranded, linear
gggctggggtgctggcttgggg

SEQ ID NO: 2329 - DNA, 18 bp; single-stranded, linear
ggggctggggcctgggcc

SEQ ID NO: 2330 - DNA, 20 bp; single-stranded, linear
gcctgggtgggcttgggggc

SEQ ID NO: 2331 - DNA, 20 bp; single-stranded, linear
gctgggtctgtgctgttgcc

SEQ ID NO: 2332 - DNA, 15 bp; single-stranded, linear
gttgtgtggggggcc

SEQ ID NO: 2333 - DNA, 27 bp; single-stranded, linear
gctgggtcggggggcctctgggctgtc

SEQ ID NO: 2334 - DNA, 14 bp; single-stranded, linear
gccccggggccccc

SEQ ID NO: 2335 - DNA, 14 bp; single-stranded, linear
tggctcccccctcc

SEQ ID NO: 2336 - DNA, 14 bp; single-stranded, linear
gctcccccctttcc

SEQ ID NO: 2337 - DNA, 16 bp; single-stranded, linear
cggacgaagacagaga

SEQ ID NO: 2338 - DNA, 14 bp; single-stranded, linear
ggctttgtgggctc

SEQ ID NO: 2339 - DNA, 14 bp; single-stranded, linear
gcctgctctccccc

SEQ ID NO: 2340 - DNA, 19 bp; single-stranded, linear
cccggccccgccbcgbbcc

SEQ ID NO: 2341 - DNA, 15 bp; single-stranded, linear
cccggccccgccbcg

SEQ ID NO: 2342 - DNA, 19 bp; single-stranded, linear
cccggccccgccbcgbbcc

SEQ ID NO: 2343 - DNA, 15 bp; single-stranded, linear
cccggccccgccbcg

SEQ ID NO: 2344 - DNA, 17 bp; single-stranded, linear
cccgbccccgcctcbbg

SEQ ID NO: 2345 - DNA, 14 bp; single-stranded, linear
cccgbccccgcctc

SEQ ID NO: 2346 - DNA, 13 bp; single-stranded, linear
ccggccccgcctc

SEQ ID NO: 2347 - DNA, 19 bp; single-stranded, linear
cccgbbcccgcbtbgtgcc

SEQ ID NO: 2348 - DNA, 13 bp; single-stranded, linear
cccgcbtbgtgcc

SEQ ID NO: 2349 - DNA, 19 bp; single-stranded, linear
cccggbcccbccbbgtgcc

SEQ ID NO: 2350 - DNA, 18 bp; single-stranded, linear
cbgbbcccgcctcgtgcc

SEQ ID NO: 2351 - DNA, 13 bp; single-stranded, linear
cccgcctcgtgcc

SEQ ID NO: 2352 - DNA, 18 bp; single-stranded, linear
ccggcbccgcctcbtgcc

SEQ ID NO: 2353 - DNA, 18 bp; single-stranded, linear
ccggccccgccbcbtgcc

SEQ ID NO: 2354 - DNA, 15 bp; single-stranded, linear
cccgbccccgbctcg

SEQ ID NO: 2355 - DNA, 15 bp; single-stranded, linear
cccggccbcgbctcg

SEQ ID NO: 2356 - DNA, 15 bp; single-stranded, linear
cccggcccbgcctbg

SEQ ID NO: 2357 - DNA, 19 bp; single-stranded, linear
cccggcbcbgbctcgtbcc

SEQ ID NO: 2358 - DNA, 15 bp; single-stranded, linear
cccggccccgccbcg

SEQ ID NO: 2359 - DNA, 15 bp; single-stranded, linear
cccggccccgccbcg

SEQ ID NO: 2360 - DNA, 14 bp; single-stranded, linear
tccbtgccgcgggc

SEQ ID NO: 2361 - DNA, 15 bp; single-stranded, linear
tccbtgccbcgggcc

SEQ ID NO: 2362 - DNA, 15 bp; single-stranded, linear
tccbtgccbcgggcc

SEQ ID NO: 2363 - DNA, 15 bp; single-stranded, linear
tccbtgccbcbggcc

SEQ ID NO: 2364 - DNA, 13 bp; single-stranded, linear
gtccbtgbcgcgg

SEQ ID NO: 2365 - DNA, 13 bp; single-stranded, linear
tccbtgbcgcggg

SEQ ID NO: 2366 - DNA, 21 bp; single-stranded, linear
tctgbgctcctctbbcctggg

SEQ ID NO: 2367 - DNA, 20 bp; single-stranded, linear
ctgtgcbcctbbcbcctggg

SEQ ID NO: 2368 - DNA, 19 bp; single-stranded, linear
tgtgbtccbctbgbctggg

SEQ ID NO: 2369 - DNA, 19 bp; single-stranded, linear
tctgtbctcbbctcbcctg

SEQ ID NO: 2370 - DNA, 17 bp; single-stranded, linear
tgctcctcbcbbctggg

SEQ ID NO: 2371 - DNA, 14 bp; single-stranded, linear
ctcctctbgcctgg

SEQ ID NO: 2372 - DNA, 18 bp; single-stranded, linear
gtgctccbbtcbbctggg

SEQ ID NO: 2373 - DNA, 18 bp; single-stranded, linear
gtgcbccbbtcbcctggg

SEQ ID NO: 2374 - DNA, 18 bp; single-stranded, linear
tctgtgcbcctctbgbct

SEQ ID NO: 2375 - DNA, 16 bp; single-stranded, linear
tbbtcctbbcbcctgg

SEQ ID NO: 2376 - DNA, 19 bp; single-stranded, linear
tgtgctbbtcbcbcbtggg

SEQ ID NO: 2377 - DNA, 16 bp; single-stranded, linear
gtgcbccbctcbcctg

SEQ ID NO: 2378 - DNA, 13 bp; single-stranded, linear
ctgtgcbcctctc

SEQ ID NO: 2379 - DNA, 18 bp; single-stranded, linear
cbgtgcbccbctcbcctg

SEQ ID NO: 2380 - DNA, 16 bp; single-stranded, linear
gtgcbccbctcbcctg

SEQ ID NO: 2381 - DNA, 15 bp; single-stranded, linear
cbcctctcbcctggg

SEQ ID NO: 2382 - DNA, 13 bp; single-stranded, linear
cctctcbcctggg

SEQ ID NO: 2383 - DNA, 13 bp; single-stranded, linear
gctccbctcgcct

SEQ ID NO: 2384 - DNA, 13 bp; single-stranded, linear
tgctcctcbcgcc

SEQ ID NO: 2385 - DNA, 13 bp; single-stranded, linear
gttgttgbtctgg

SEQ ID NO: 2386 - DNA, 18 bp; single-stranded, linear
ggttgbbbttggtcttgg

SEQ ID NO: 2387 - DNA, 16 bp; single-stranded, linear
ggttgttgbtgbtctg

SEQ ID NO: 2388 - DNA, 18 bp; single-stranded, linear
gggttbbbgttgbtctgg

SEQ ID NO: 2389 - DNA, 18 bp; single-stranded, linear
gggttbbbgttgbtctgg

SEQ ID NO: 2390 - DNA, 15 bp; single-stranded, linear
ttgttgtbgbtctgg

SEQ ID NO: 2391 - DNA, 18 bp; single-stranded, linear
gggtbgbbgbgtccgctg

SEQ ID NO: 2392 - DNA, 18 bp; single-stranded, linear
gggtcbgbggbtcbgctg

SEQ ID NO: 2393 - DNA, 13 bp; single-stranded, linear
gggtbggtgggtc

SEQ ID NO: 2394 - DNA, 16 bp; single-stranded, linear
gggtcggbgggtcbgc

SEQ ID NO: 2395 - DNA, 13 bp; single-stranded, linear
cctgggtgggctt

SEQ ID NO: 2396 - DNA, 13 bp; single-stranded, linear
gggtgggcttggg

SEQ ID NO: 2397 - DNA, 16 bp; single-stranded, linear
cctgggtgggbbtggg

SEQ ID NO: 2398 - DNA, 16 bp; single-stranded, linear
cctggbtgggcbtggg

SEQ ID NO: 2399 - DNA, 17 bp; single-stranded, linear
gcctgbgtgbbcttggg

SEQ ID NO: 2400 - DNA, 17 bp; single-stranded, linear
cccavgvccvcccaggc

SEQ ID NO: 2401 - DNA, 13 bp; single-stranded, linear
agcccacccaggc

SEQ ID NO: 2402 - DNA, 14 bp; single-stranded, linear
bcctgggtgggctb

SEQ ID NO: 2403 - DNA, 12 bp; single-stranded, linear
ggtgggcttggg

SEQ ID NO: 2404 - DNA, 16 bp; single-stranded, linear
ccbbggtgggcttggg

SEQ ID NO: 2405 - DNA, 15 bp; single-stranded, linear
ctgggtgggbbtggg

SEQ ID NO: 2406 - DNA, 15 bp; single-stranded, linear
ccbgggtgggcttgg

SEQ ID NO: 2407 - DNA, 12 bp; single-stranded, linear
gggtgggcttgg

SEQ ID NO: 2408 - DNA, 16 bp; single-stranded, linear
cctgbgtgbgcbtggg

SEQ ID NO: 2409 - DNA, 7800 bp; single-stranded, linear
ggcggcctggaaagctgagatggagggcggcatggcgggcacaggctgggctgcttttcttttctgggcctctgtggtctgtttttttctggccctgctggggcgctctccgccgcccgcctggctcccggbgcccbtgbtgggcbtgccgtggttcttgccctcctttggctgccgtgcccgctccccggcctcctggcgggtggccgttgggcccgtgttcccctggggcctggggctcccttctctcgcccttcttgctgggcctctgctgctgctggtgctgtggcccccgtacaccgaggagcccatgatgggcatgccacagacgacaggcgtbcbccgbggbgcccbtgbtgggcbtgccbcbgbcgbcbggcggcgccgtgccgcgtcttggtggcggcgggttcgcgcccgcgcggggcccctccggtccgttcgcgcccgcgcggggcccctccggtcccgggtcggggccccccgcggccgcctcggggctggggcgctggtggccgggccgcgcctccgcctgccgcttctggctgggccccgggcgccccctcccctcttgctcgggtccccgtgacagcgcgtcctgtgtctccagcagcatggccgggccagctgggccccbcbgcgcgtcctgtgtctccbgcbgcbtggccgggccbgctgggccccacagagcagtgctgttgttgggcatcttgccttcccagggbcbgbgcbtgctgttgttgggcbtcttgccttcccbgggcccttttctggtggggtggtgctgttgttgggctttcttctgttcccbcbgbgcbgtgctgttgttgggcbtcttgccttcccbgggcccttttctggtggggtggtgctgttgttgggctttcttctgttccctttcccctgggtcttccctcctgctcttttttcatttgctctcctattactttctgtgtccattttttcattaaccgagctgtbtttgctctcctbttbctttctgtgtccbttttttcbttbbccgbgctgtgcctgtgtctgtcctcctgcttcgttcctctcgttcctgcttggtgcccttgccggtcctgctcctccgggctgtgggtcgtggccctggctccggctggtgggctcccctggccttcgctggctggcggcgtgcgggtcttgctctgggcctggctgtggccgtggttgggggtcttcgctgcctccgtttgggtggctctctgaatattgaccttcctccatggcggtcctgcttggattctcccgatctctgbbtbttgbccttcctccbtggcggtcctgcttggbttctcccgbgcctttcctggttctcttgttgtttttggggtttggcttacagtagagtaggggattccatggcaggagccatcttcttcatggactccttcaaggagaccttaggtttctgagggactgctaacacgccatctggagcbcbgtbgbgtbggggbttccbtggcbggbgccbtcttcttcbtggbctccttcbbggbgbccttbggtttctgbgggbctgctbbcbcgccbtctggbgcgttgtttttggggtttggcttgcctttcctggttctcttbcbgtbgbgtbggggbttccbtggcbggbgccbtcttcttcbtggbctccttcbbggbgbccttbggtttctgbgggbctgctbbcbcgccbtctggbgcgcctgtgtctgtcctcctgcttcgttcctctcgttcctgcttggtgcccttgccggtcctgctcctccgggctgtgggtcctcgccctggctccggctggtgggctcccctggccttcgctggctggcggcgtgccccbgbbcgbgbcccggbccgbcbggccgtggttgggggtcttcgctgcctccgtttgggtggcgatctctgaatattgaccttccatggcggtcctgcttggagbtctctgbbtbttgbccttccbtggcggtcctgcttggbtctggggtgtcctggccttcgtggttcctcttccttcgtttgccgtccgcgggggcccccgggcctggctgcgctcctgccccgcctctttcccgggctcttgcgctggggggtgctcccgtgtgtttgcgccctcctcctggtcgcgcttgtcgttttggggccggctttgcccgcctcccggcgcctggcccggccttcctgggctgcgtgcgcgttctgttcttcttcctggctctggggtgtcctggccttcgtggttcctcttccttcgtttgccgtccgcgggggcccccgggcctggctgcgctcctgccccgcctctttcccgggctcttgcgctggggggtgctcccgtgtgtttgcgccctcctcctggtcgcgcttgtcgttttggggccggctttgcccgcctcccggcgcctggcccggccttcctgggctgcgtgcgcgttctgttcttcttcctggcgcaggagacagggcagggcgatcaggagcagcgtgagccaaaggaggaccatcgggaacgcagctccggaacgcaggacagaggtgccgcbggbgbcbgggcbgggcgbtcbggbgcbgcgtgbgccbbbggbggbccbtcgggbbcgcbgctccggbbcgcbggbcbgbggtgcctctgccctgtccgccggctcttcggtggctcggccccgctccttgtcttgccgcgggttggttcctgggcctggttcttgcgggcgtttcggtctgctggctggtctgggcccgcggtgcggcgggtggcttgctgttctgcctgggctctcccctctcctccttttctcccttcctctgtcttgcctccttcctctgggtcctcttggcctgggcgctcttcccctcgggcggctgcgggcgctcgtgctgcctggtccgctccctgggggtgctccttccctttccccgctcgtggggtttgcggggctgggctgccctggggggtctgggccttttggggtcggctggctgctgcttcgggccgcctgggcttccctgtgcccctttcctctgctgggtccccctcccgttccaagctgcaccgcacagaccggcgctacaggacagagccaggcaagcacccatggggatccaggcccagctgttccbbgctgcbccgcbcbgbccggcgctbcbggbcbgbgccbggcbbgcbcccbtggggbtccbggcccbgctgctcagtggcccccaaaaggatgagtaatacatgcgccacgatgatcatatcctttttactatgaggccgtgtctgtcgtgtctttcctttgctcttggtgtgtctttgctgtgccctgcctctctgcccgtgtctgtcgtgtctttcctttgctcttggtgtgtctttgctgtgccctgcctctctgcccgtgtctgtcgtgtctttcctttgctcttggtgtgtctttgctgtgccctgcctctctgcgggggtggcttcctgccgcgtctctgggccgtcccgtccctcggccccgcgccgcgctcggctcctctccctctggcccggctcggggcggggcggggcggtgggcgggcggcgctgccctgcgcgcggcgctggcccctgctggccgtcggctgcgcgctgctggctgccctgctggccgcgccggggcctgtccgcctctgcgggcgctgtctcctggcttgtcttccggctcttctgctggggtggggctgggcggccggcccggtgctggggctcctcgggggggggggctcttccgggctgtctccctccggggcgggggtttctggccgtgggggtcttgcctggcctccgggctcctgcttgtcttgccttccttctctggtcggttgtggctcggggctccgtgggtccctggcgcccgtttgtgttttgtcttttcccctggcgtccctgtgcccctctcctctccttcctctgcttctcgctctcctttgtggggccctccctgctgctcttggttttgggctttttttctcttcctcctttttcgtgcgtgggcctccgcacgcctcttgccacctcctgcgcagggcagcgccttggggccagcgccgctcccggcgcggccagcagggcagccagcagcgcgcagccgacggccagcatgcttcctcctcggctaccactccatggtcccgcagaggcggacaggcgcbcgcctcttgccbcctcctgcgcbgggcbgcgccttggggccbgcgccgctcccggcgcggccbgcbgggcbgccbgcbgcgcgcbgccgbcggccbgcbtgcttcctcctcggctbccbctccbtggtcccgcbgbggcggbcbggcgctgcccggcggggtgtgcgcttggcgctcccgtgctcggttctctgtctcccggtcccccttgcctggcgtctcgggccttcgtcctcttcctcttcttccttccgctccgtgggggctgcttggtgggggcctgtgcctcggggtcccggggcttctggcccttgccgttcatggtggctaggtggggcgttcbtggtggctbggtggggcggggtgggtbggccgtgtctgggggttggccbtgttggttgcctcttggtggtgcgccgggcgcgtcttggctttcttctccttcgggccctcgggccggtgcttgtgggctcctcccgggcggcctccccgggcgggggcttcttggcgctggcgggggggcctcctgctctgtggctgggcgttccttggtgttctgggtggtggcgggcgtggtggcctctgtgggggcccgcggctgcbggggttgcctgtctgcttcgtcctttgcgctcccgggccgccggggtgggtaggccgtgtctgggggttggccatgttggttgccgggcccgcggctgcaggggacaggggctgtaatcttcatctgcaggtggcatgccagtgaaatttagatcatcaaaatcccacatctgtggatctgtaatatttgacatgtcctcttcagtttcagcaatggtttgatctaactgaagcaccggccaggbcbggggctgtbbtcttcbtctgcbggtggcbtgccbgtgbbbtttbgbtcbtcbbbbtcccbcbtctgtggbtctgtbbtbtttgbcbtgtcctcttcbgtttcbgcbbtggtttgbtctbbctgbbgcbccggccbggtggctcggtgcttctgcccctgttgttgcggcgctcggttggtgtggcccctgtggtgcttcgtttccccctctttctctttgttcgggggttcttgtggcgggctgcttgtctcgttccgccctgtcgggcgggaagcctctctcctctccccagatccgcgacaggccgcaggcaagaaccagcgcaaccagggcgcgtccgcacagacttggaggcggctgcatgctgctacctgctccagaagcgtccggtggccgccgcgccctgtcgggcgggbbgcctctctcctctccccbgbtccgcgbcbggccgcbggcbbgbbccbgcgcbbccbgggcgcgtccgcbcbgbcttggbggcggctgcbtgctgctbcctgctcgggcgggbbgcctccggtggccgccgcgcgtccggtggccgccgcgcctctctcctctccccgtggccctgtcgggcgggtcctgccgtcctgtctccttttcttttgctgtcttgtcttcccgtctctgctttgtctgtcctccccgtctcctcccactgcttctcccgggggcttccccggcttcgggtggccggtgtcccgggctccggcgcggcggcggcttcggctgcgggtgggtggcgcgggctgccgggtccgcgcggcgcctgggcccttgtgctgctttttgcttgttccgttctggctgctccggtctgtgttgtggttgttttgtttcttcttgggtgtgggccttgcggttttggctgtgggccctttggggccttggcttctggctcgtctgtcctccccgtctcctcccactgcttctcccgggggcttccccggcttcgggtggccggtgtcccgggctccggcgcggcggcggcttcggctgcgggtgggtggcgcgggctgccgggtccgcgcggcgcctgggcccttgtgctgctttttgcttgttccgttctggctgctccggtctgtgttgtggttgttttgtttcttcttgggtgtgggccttgcggttttggctgtgggccctttggggccttggcttctggctccatccacatgattgcttagatttgtgctgtatctctcaggattatcactgattacacatccaaccagtgccagccaaaaggatgccctgaggcaaagggtttccatcttgaggcaaatttgaggacbtccbcbtgbttgcttbgbtttgtgctgtbtctctcbggbttbtcbctgbttbcbcbtccbbccbgtgccbgccbbbbggbtgccctgbggcbbbgggtttccbtcttgbggcbbbtttgbggbgggctbbgbtgbtccbcbtcbctbccbcgttgcccbccbcbgbggtcbccbcbbtgbccgtgtbggcbgctgcccbbbggbcbbtttgccbggctggttgcbcgbbctgbttgggttccgbggtgttbgtggbgbtgtttggggbgbggtctgbgtccbccgggbggbcgttbtccbtttcgbbgctbggcggtbbbgccctbctbtctgtbcbcbbcccccctctgcbgcbgbgtcctgtcgtggcgcctggggctcbgggtccgggctaagatgatccacatcactaccacgttgcccaccacagaggtcaccacaatgaccgtgtaggcagctgcccaaaggacaatttgccaggctggttgcacgaactgattgggttccgaggtgttagtggagatgtttggggagaggtctgagtccaccgggaggacgttatccatttcgaagctaggcggtaaagccctactatctgtacacaacccccctctgcagcagagtcctgtcgtggcgcctggggctcagggtccgtcctgtcgtggcgcctggggctcttcttttgtgggctctttggtggctgtggctgtggtctctgtggttgctgccctgggtctgggggtgtggccttggggccgtcctctggctcctcctcgtgggcccccggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggccgtgttgtcbgtggtgctgcccgtttgbggtbtggcgctccbccbbttcccttttctccttgttttccgtttctcttgccgtctgtggtt

SEQ ID NO: 2410 - DNA, 6225 bp; single-stranded, linear
cttgctcctgggggcctcctggtccctctggctgttcccggccctggbctggggcbggggccgcgtbggcgcggctcgccbggbcgggcbgcgccbgcbgcbgcbggctcbgcbtcctggccbcggbbttccggtgtgcggggcctggtgcccctgggcctcgggtgctgcctgtgcgctgccttcttctcctgggtcctcgccggggcccttgctgccctggctgtgccctgggggtctgggttcggctgtccccbgcbggbccbgtcccbtccbcbgcgtgtgbtgbgtbgccbttctcctgcbgccgbggggcgcgggcgbgcbtcgctttgggcttttctcctttggtttgbgcgccbggbccgcgcbcbgcbgcbgggcgcgggcgbgcbtcgcbgcggcgggcbggggggctcccgccgcgbgbggttbtgggctcccbggbccbcccgcbccgcgcggbcgtttbcbttcgccbcgcbgtgcgcggccgbcbtgbcgbbgttgggcgcbbtcbgggtggcgccgcbgbbgtggcctccgcgcbgctgcbgggbcbccbtgbbgggccbcgcgtggggccgcgctcgccggccccccbcbbtctccgbggccbgcgcggtgccccccbgcbgcbbggccggcbggbcbcbggcgbggbgbcbcgcgbgtcggcggccgbgggtcbtggtggggctggggctccggggtctctgcccctccgtgctggtggggctggggctccggggtctctgcccctccgtgccgcgtggggccgcgctcgccggcccccccctgccgggtgggctcccgccgcgcgccggcctgccggcccctcgtgggtcctgctggccgggtccgggtcccgggggtggggcgcgbgtcggcggccgbgggtcccctccbcbtctgctctgbcctgctggbctctggbtctgbbgbtbcgccbtgtbggggcgggbgtggggcctgctctcccggcctccgbtgbtctcccctgcctcbgccccbgtgggtbggbgbbbggccbgcbgbbgcbggbgtggctgcbtctttcctggtggggcctgctctcccggcctccgtgtgttgctgggtgttttcccgtctctggtctgccttcgggggtcgtccggggctgcbgcbbcctcbtcbgctcttgcctggbgtggctcbgcctgggcctgcbgggccbccbggbgbbtggcbgcbbggbtggcgbgggtcctcbtggctggggtcbcbgbtcctctbgctbggcbgggtgbccbgbgbgggcgggtcctcbtggctgggggcctgggcctgcbgggccgctcttgcctggbgtggctcgcccbgbgtcttccctggtcgctgcbbtctgctccggggctgcbgcbbcctcbtcbgctcttgcctggbgtggctcbgcctgggcctgcbgggccbccbggbgbbtggcbgcbbggbtggcgbgggtcctcbtggctggggtcbcctggbggbgggbgbgcbgggggtcctcbtggctggggtccctctctcccgtcctcggtttcctttgcggtcttggcccgggctccgggtgcccgcccgcccgccggccgccgccccgccgggctgtccccgccccgccccggcccggggcgcgggggcggccctcccgcccctctgggccggcgcgggcgtcggccgctcgcgcctggggttccctctcctccccctgtgcgcctgcctcttgctcttctgcgtccgctgccttctcccctctcctcggccgttgcctgtgctgtccgtcctgtcgcccttccgtggtgctgttgtctcttctgccctcggtgtgctggtgctggtggtggtgcctctgcccgtgctcgccctgcctgggctggcctcttcgggtgtggctttggggctctcttggttgccctttcttctcgtggtgcctctcctccctggcttggtcgttgtctggggtggtgctcctctccctttccctgctggccgtttgtcctgttttctgtcttcctctttcctcctgtttctccgtttggcttgctgcttgcggggctgtctcccttgcccctgtgggctttccctggtccggtcttctccttgggggtcgcccttcttggtgggctggctcgtctgtctttttccttcctgggggtggccgttgtgggcggtgtggtccgccttgcctctgctggtctttcctcggtbgbcgcgctcgbbctcgggtgggccggtggtgbgcggcggcgbcbcgcggbbggccctgcgcgccgbgbtcbcctgcbgggbgbbgtbggcttgcbgcbggbctcccbggbgggtgbcbgcbgccbgtbgbgctbcctcgtccttcbtggtbccgtcggtgtggtggcbcgggctgtgtgtgbbggcgbgctgggccccgtctgctgctcctcgtgccgcctcgtccttcatggtaccgtcggtgtggtggcctcgggtgggccggtggtggggcgcgcgcgctcgcgtggctccggctcttctttcccggctccgtcggcccgggggccttggtctccctcgtccttcbtggtbccgbccggcggbgccgccbgggtggbctgggbgtgggtttctccccgccgttctcbcccbccgcgctgbgctcbgcgcctbbgbctgctgtttctggbgctccttggcbbgccbcbbbcbgcbgbgbgbbbbtcbtgbgcbbbtbbtccbttctgbbbbbbbgggbtcbbbbbcctcccgttccccgttcgcctggcgcgcgctgcgggttcctcgtgggtttctccccgccgttctccggtctgttgcctttgtgggcttcttgtctttttggctgttcttttcctgcttggcgtcttttcctttctttgtgctcggttgtgggtccgctggtcctttgccctgtgtgtttctgctgcccgttcgcctggcgcgcgctgcgggttcctcgtgggtttctccccgccgttctccggtctgttgcctttgtgggcttcttgtctttttggctgttcttttcctgcttggcgtcttttcctttctttgtgctcggttgtgggtccgctggtcctttgccctgtgtgtttctgctgggbgctgbtbctgcbgatttcbgbgggbbgbbccctgbtbctcbccbgcttcbgctctggbgcbcbbgbgbbbgbgcbgcbgggggbgbggbbgbbgcbgcbtcttcccbgbgbggctgcctgbgcbbbtgctggttttcctttccbgtcttgggttttbtbbctcccbgbbggcbbgbgbggggcbbggcgttttcttctctcgctggttttcctttcctggcagtgggtgggggtgggggtggggtggcttccttgttcctgggggtgtcctcttgctctgggcttttctccccttttccttcctgtctgttttcctggggctctcctctgtctctgtgtccttgccctggccctcttccctctcctgtctcctgtccctgtgttccgcccgtcttccctctcctgacctccttttcctccgctgggtggggccctgcctgttctctgctccctggcttggggtttcttctgtgtgtcttcttcctctgttggctggctttctccttcttttgtcttcctgggtgccccttcttcctttcttgggtccttggtgcttgggctggggcgtcttggggtgcbgggcccbtcctgctgcgcctgggcgctgctgtgcgtccgtctgctggggggccggggtggctgggccctgcttgccgcacgaccccgggccgacccgaggctcggggggctgtgttctggcgctggtgggcttgggcccctctgggggctgggtttcctgctgcgcctgggcgctggcgtcttggggtgcggggccggggggccggggggccgctgttcgtgggcctgggggtgcctgtggctgccggttgccccggttggtggcgccgtcctgctgccggtcgttggctgggtccccccgcccgtttcctggggtccgcgtggggtgctccggttcctcgtgccgctgctgccttgtctttccggccgtggcggcgtggtggtccgccccccctggccttctgctcggggtctggctggttgccggtgcccttggcggcggtcttcttcctggtggctctgggcccggccggtctcgggcgtctcgtgttcgctcttgtgctgttccggccgctccttcctcttccgccgccgccgctccccgcccgctcgtcgccctggcccggcctcctcctggccgctgtctcgggcggcggccttggcgctccgtttggggctgcctctggcgcttccggccctcggcctgggcgctctcttccgcctgtgctggtggccctcgtgggcccctcctggcctccggtgtcctgtggtcccccggctggtggccgggccggttgggcgggcgtgggcgccggcgggtcctccgggctgcccttctccgccgggggtcccgcgctcctgctgttccctgggctcttctgcctctctcctgggtgggtgctgggtgccggggtctccgggcttgccccgcgctgctgggcgttctgcggtcttggggttgtctgtggccccgctcgtgtcgccctccgtcgcccgtcgccggcctcgtcccctcctgggtgcgcggcgggctggtcctggcgttttgctccttcctgggcgtcttggggtgcbgggcccbtcctgctgcgcctgggcgctgctgtgcgtccgtctgctggggggccggggtggctgggccctgcttgccgcacgaccccgggccgacccgaggctcggggggctgtgttctggcgctggtgggcttgggcccctctgggggctgggtttcctgctgcgcctgggcgctggcgtcttggggtgcggggccggggggccggggggccgctgttcgtgggcctgggggtgcctgtggctgccggttgccccggttggtggcgccgtcctgctgccggtcgttggctgggtccccccgcccgtttcctggggtccgcgtggggtgctccggttcctcgtgccgctgctgccttgtctttccggccgtggcggcgtggtggtccgccccccctggccttctgctcggggtctggctggttgccggtgcccttggcggcggtcttcttcctggtggctctgggcccggccggtctcgggcgtctcgtgttcgctcttgtgctgttccggccgctccttcctcttccgccgccgccgctccccgcccgctcgtcgccctggcccggcctcctcctggccgctgtctcgggcggcggccttggcgctccgtttggggctgcctctggcgcttccggccctcggcctgggcgctctcttccgcctgtgctggtggccctcgtgggcccctcctggcctccggtgtcctgtggtcccccggctggtggccgggccggttgggcgggcgtgggcgccggcgggtcctccgggctgcccttctccgccgggggtcccgcgctcctgctgttccctgggctcttctgcctctctcctgggtgggtgctgggtgccggggtctccgggcttgccccgcgctgctgggcgttctgcggtcttggggttgtctgtggccccgctcgtgtcgccctccgtcgcccgtcgccggcctcgtcccctcctgggtgcgcggcgggctggtcctggcgttttgctccttcctggctgccccbgtttttgbtcctcbcbtgccgtggggbggbcbbtggctgcctccccggggtttctgctgcttgctgcttctttcccgtctcccttctttcccgtctcctttttgcctctttgggttcctgttgtttctggcctgcttggtggcggcttgtgcgtttcctctctcttctcttgggtctccgcttctcgtcctgccttttcctgtctctgtcgcgccgttcctcctccggcgtcctcctgccctgtgctgtttgcctcgggtggtgcgggtcccggtgctcccccggcgggccggctggttgcctgggcctgtctggtggggtgtggggccgctgggttgggggtgtggtgggctcttctgtggcctgtggggctgttggtgtctctgtgggcgtgtgctgggtcttggggcttcctcccttgtgctgggtgcggcctccccgccccccttctgggccggtggcctggctccttgtgggcgcttctggctcttgccctgtccttcttcgcctcgtggctgctgggctgc

SEQ ID NO: 2411 - DNA, 7033 bp; single-stranded, linear
cctccttcctggtctgtctgccbgbcbbbtttgggbbgtgbbcbgttttggbbccbtgtttcccbgtctctgbgctgtggcgccctgctgctctttctgcttcccttggtgggttgggccgctggttgttctggggttcttgctgccccttctgtccctgtttgctggtgtctgcgcccccbbcbgbbgbbgcbgbcbbbtttgggbbgtgbbcbgttttggbbccbtgtttcctgtgcgctcggcctggtcccgggggtctcctcttgttgttgcttgcgcctcctgctgggggtccctctgttcttgttttgggggcgggcccggccgttgtcttggtttgggggtttccgttggggttctcctggcccgggccttgcccggccgtggtcccggcttcgttcctgtctccgtctcggctcttctggggccttgcgctgtctttggtggcbccgtccbgtgbtggtgcggtbcttgtcgctgcbgcgctcggcctggtcccggbgbgcgcgcgggccgggggctgctgggggttggcccggggtgccccgccgctgggtgccctcgtcctctgcggtcgtgtctcctggctctggttccccgctgcgcccgttgtcctctggggtggccttcgctcccgggtctggttcttgtgttgggggtccctttttgggcctgttgtggcgtggcttgtgtgttcggtttctgccctgtcctccggcgtccccggbgcctccccggggcbggbtgbcttttgbgggggbcbcbgbtgtctgggcbttgccbggtcctgggbbcbgbgccccgbgcbggbccbggbgtgcgggcbgcgcgggccgggggctgctgggbgccbtbgcgbggctgbgcctcttttctgtttttcccctctgcctttgtttgggttcgcttcctttctgcttcttccctgtgtctcctgtctccgcttttttcttcgtctttgttgttttctcttccttgctgbgcbbgbtbtctbgbttctggggtggtctcgbttttbbbbgcttgbgbbgctgcbbbcbttbtccbbbgtbtbtttgbggctccbbggbtcbcgbccbtcttcccbggcbttttbbgttgctgtcgtbbgtgbgbgctgbgbgbbbctgtgbbgcbbtcbtgbcttcbbgbgttcttttcbcccgttcttggcttcttctgtccgttggcttctcgttgtccctgtgggcttctcgttgtccccccttcgggggctggtggggccgtccttgcctgctgggttcttggcttcttctgtccgttggcttctcgttgtccctgtgggcttctcgttgtccccccttcgggggctggtggggccgtccttgcctgctggttttctctttcgctttcttttcgtctcctgttcctccttttttgctgttttttctccttcttctctcctttcttttcttttctctttcgctttcttttcgtctcctgttcctccttttttgctgttttttctccttcttctctcctttcttttcctctgtcttgttctggtccttcgtggggctctgtgtcgcgtgggtgcggccgtggccggcggbccbggbgttggbgcbggbgcbggbcgggcbggcggctcbtgtttggbtcggcbggbggcbctcctctggttggcttccttcgccggcbcbtgctbgcbggbbgbbcbgbgggggbbgcbgttgggbggtgbgbcccbttbbtbggtgtcgbtccctgtttcccccctttcgttctgcgtttgcctttggcgttttttgtttgttttctctctccgtctttcttctcccctgtgggbbtttctgtggggbtggcbtbcbcgtbggcbgctccbbgbgctbgcbbbctcbbbtgcbgbbgcbtcctcbtggctctgbbbcggtgggaatttctgtggggbtggcatacacgtaggcagctccaagagctagcaaactcaaatgcagaagcatcctcatggctctgaaacggggggtggcttcctgccgcgtctctgggccgtcccgtccctcggccccgcgccgcgctcggctcctctccctctggcccggctcggggcggggcggggcggtgggcgggcggcgctgccctgcgcgcggcgctggcccctgctggccgtcggctgcgcgctgctggctgccctgctggccgcgccggggcctgtccgcctctgcgggcgctgtctcctggcttgtcttccggctcttctgctggggtggggctgggcggccggcccggtgctggggctcctcgggggggggggctcttccgggctgtctccctccggggcgggggtttctggccgtgggggtcttgcctggcctccgggctcctgcttgtcttgccttccttctctggtcggttgtggctcggggctccgtgggtccctggcgcccgtttgtgttttgtcttttcccctggcgtccctgtgcccctctcctctccttcctctgcttctcgctctcctttgtggggccctccctgctgctcttggttttgggctttttttctcttcctcctttttcgtgcgtgggcctccgcacgcctcttgccacctcctgcgcagggcagcgccttggggccagcgccgctcccggcgcggccagcagggcagccagcagcgcgcagccgacggccagcatgcttcctcctcggctaccactccatggtcccgcagaggcggacaggcgcbcgcctcttgccbcctcctgcgcbgggcbgcgccttggggccbgcgccgctcccggcgcggccbgcbgggcbgccbgcbgcgcgcbgccgbcggccbgcbtgcttcctcctcggctbccbctccbtggtcccgcbgbggcggbcbggcggggtggbbbggtttggbgtbtgtctttbtgcbctgbcbtctbbgttctttbgcbctccttggcbbbbctgcbccttcbcbcbgbgctgcbgbbbtcbggbbggctgccbbgbgbgccbcggccbgcttggbbgtcbtgtttbcbcbcbgtgbgbtggttccttccgggcttgtgtgctctgctgtctcttggttccttccggtggtttcttcctggctcttgtcctttctcttggcccttggccgggbgtgggggtcctggbcggcbctgbbggcbtccbgggctcccttccbgtccttcttgtccgctgccbgcbccccttcbttccbgbggctgbtggcctccbccbgggbcbtgbttbggtbgbbbctbggbggccggcctccbccbgggbcbtggtccttcttgtccgctgcctctctggggttttcggtctgggtgggctttcctcctggggctgctgctgggctcttctttttgtttctggcctggtgctctctcgtgccctttcccttgggtgtcttgtttttgtggcctccbccbgggbcbtggtctttgtttctgggctcgtgccccbtcccggcttctctctggttccgtcctctgtggtgtttggccctgcttccttttgcctgttgagggggcagcagttgggccccaaaggccctctcgttcaccttctggcacggagttgcatccccatagtcaaactctgtggtcgtgtcatagtcctctgtggtgtttggagtttccatcccggcttctctctggttccaagggagbgggggcbgcbgttgggccccbbbggccctctcgttcbccttctggcbcggbgttgcbtccccbtbgtcbbbctctgtggtcgtgtcbtbgtcctctgtggtgtttggbgtttccbtcccggcttctctctggttccbbgggbgggcbcggggcbgtgggcgggcbbtgtbggcbbbgcbgcbgggtgtggtgtccgbggbbtbtggggbggcbgbtgcbggbgcgcbgbgggcbgtbgcbbtgbggbtgbcbgcgbggcgtgccgcggbgbccttcbtggtbcctgtggbgbggctgtcggbgggggtgtggtgtccgcttggcggttctttcgggtgtttcttctctgggttggcctgctgctcgtcgtggtcgctccgctcccgggttcgtctcgctctgtcgccccttccttccttgtcgtgttcctcccttccttgcctctgbtgtttgttbccbbbgcbtcbbgbbtbgctttgctbtctbbggbtcbcbtttbgbcbtbggbbbbcgctgtbggtcbgbbbgbtgtgcttbccttcbcbcbgbgctgcbgbbbtcbggbbggctgccbbgbgbgccbcggccbgcttggbgtcbtgtttbcbcbcbgtgbggtgctccggtggctttttgcttgtgtgctctgctgtctctgttccttccggtggtttcttcctggctcttgtcctttctcttggcccttggccccttgbgcbggbbgctctggggcbgggbgctggcbgggcccbggggggtggcttcctgcbctgtccbgbgtgcbctgtgccbcbgcbgcbgctgcbgggccbtcbgcttcbtggggctctgggtggcbggtccbgccbtgggtctgggtggggctgggctgcbggctccgggcggtccbgccbtgggtctgggggctgggctgcbggctccgggcgggcgggtgcgggctgcgtgctgggggctgccccgcaggccctgcggtccbgccbtgggtctgggggctgggctgcbggctccgggcgggcgggtgcgggctgcgtgctgggggctgccccgcaggccctgcgcbccgcctggbgccctggggcccccctgtcttcttggggbgcgcctcctcggccbgctccbcgtcccggbtcbtgctttcbgtgctcbtggtgtcctttccbggggbgbgbggggctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctgggtggtggtcttgttgcttgggctgggctccgtgtctccbgtgctcbtggtgtccgctgbgggbgcgtctgctggcgctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctggcgtggtggtcttgttgcttgggctgggctccgtgtctccbgtgctcbtggtgtccgctgbgggbgcgtctgctggcctgctgbggcttgggtctccgggcgbttctctgcbgbbgbtgctcbbbgggctccggcbgttcctccttgbtctggtcgctgtcgtbccbgtcggbccbgtbbttcbgbtcbtcbttggctcctbtttcttctgcbbbcbgctgbgtggbgbcbbgbbbbbbgbctgccbbggccbcgbggbttttcbtgttggbttttgcgbcggbcbgtcccgcggggtgctgagtttctctggttcctccgbgcgcbcgtggtcgctccgcgtttctctggttcctccggtcccgcggggtgctgtctggtcgctgtcgtggcttgggtctccgggcggtttccttccttttccgccggcccttctcactggaggcaccgggcagtcctccatgggagggttgggcttggccggggctgcccggtgcctcctcttggctggtccctcgttgtccttgggccccgctcccgctgctcggcctccgtgttctttggcctcttgctccgcctgctgtcttgtcccgtcccctcctcgcttgcgtttccctcttccttgtcttccaggccttcctccgcttccgctgctggggcccgcgccgggggggcgctcggctccgcggcttcctccccggctggggggtcctggtctccggggcctgcggctcgcgggctcggggctgcgtgcgccgcgcgcggcgtccgcggtgggtggcgctgtcccgccgtggtgtgtctccgttctcgtcctgcgccgtcctggtctgcccgtggggtcctgggcgtggtggggggcgtctggtgcctcgtctgccccgtggggcttcgggctcggggctgttcgtcccccctgccgctctgtggcctccggggctcctcgttttcgctgcttcgggtgtccttctcggcgtgtggccccgggtcccggccctgctgggctgggcggggtcgctgccctgggcttctggcccgtctggttgtctgtcggtgcttgtctcgggtttctggcctctgtgctgggcgcttctctgcctcctgctccgccctcctggtggctcggctgggggtgcccgtgcgggggtgggtgtggggtgttttcggggtcctccccttcccgtttcatcttggctttatcctctccccttgttcctcccctctcctgctctggrgtctcctcttccctccctcccctgccgtgttgtctgtgggtgtcgtttcgctcttgttgccctgggcccttccctgctgggggggagtttcatcttgggtttcbtcttggctttbtcctctccccttgttcctcccctctcctgctctggrgtctcctcttccctccctcccctgccgtgttgtctgtgggtgtcgtttcgctcttgttgccctgggcccttccctgctgggggggbgtttcbtcttgggggggbgtttcbtcttggctttccgtgttgtcbgtggtgctgcccgtttgbggtbtggcgctccbccbbttcccttttctccttgttttccgtttctcttgccgtctgtggtt

SEQ ID NO: 2412 - DNA, 21 bp; single-stranded, linear
gatggagggcggcatggcggg

SEQ ID NO: 2413 - DNA, 12 bp; single-stranded, linear
gcgggtcgccgg

SEQ ID NO: 2414 - DNA, 13 bp; single-stranded, linear
ggcgggcbcbggc

SEQ ID NO: 2415 - DNA, 9 bp; single-stranded, linear
ggcgggcbc

SEQ ID NO: 2416 - DNA, 9 bp; single-stranded, linear
gcggcctgg

SEQ ID NO: 2417 - DNA, 10 bp; single-stranded, linear
ggbgggcggc

SEQ ID NO: 2418 - DNA, 9 bp; single-stranded, linear
gbtggbggg

SEQ ID NO: 2419 - DNA, 8 bp; single-stranded, linear
ggctgggc

SEQ ID NO: 2420 - DNA, 981 bp; single-stranded, linear
atgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtctcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactag

SEQ ID NO: 2421 - DNA, 2900 bp; single-stranded, linear
atgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctacgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatgatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcccccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggaggagtacccccctgagagcatgtgggggaaggccttgctgtcatgtgaatccctcaatacccctagtatctggctgggttttcaggggctttggaagctctgttgcaggtgtccgggggtctaggactttagggatctgggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcggttgaccttctgaacatgagtgtcaactccaggacttgcttccaagcccttccctctgttggaaattgggtgtgccctggctcccaagggaggcccatgtgactaataaaaaactgtgaaccct

SEQ ID NO: 2422 - DNA, 1942 bp; single-stranded, linear
cgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggagcgacagagccgcacggccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccgcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccaga

SEQ ID NO: 2423 - DNA, 5962 bp; single-stranded, linear
atgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttatcgtctcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgcccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagatgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctacgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatgatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcccccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggaggagtacccccctgagagcatgtgggggaaggccttgctgtcatgtgaatccctcaatacccctagtatctggctgggttttcaggggctttggaagctctgttgcaggtgtccgggggtctaggactttagggatctgggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcggttgaccttctgaacatgagtgtcaactccaggacttgcttccaagcccttccctctgttggaaattgggtgtgccctggctcccaagggaggcccatgtgactaataaaaaactgtgaaccctcgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggagcgacagagccgcacggccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccgcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagagatggagggcggcatggcggggcgggtcgccggggcgggcbcbggcggcgggcbcgcggcctggggbgggcggcgbtggbgggggctgggcgcggcctggaaagctgagatggagggcggcatggcgggcacaggctgggc

SEQ ID NO: 2424 - DNA, 1687 bp; single-stranded, linear
cccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtagcaccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtg

SEQ ID NO: 2425 - DNA, 1733 bp; single-stranded, linear
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatg

SEQ ID NO: 2426 - DNA, 2470 bp; single-stranded, linear
gaattcccagatgggcagaggtggctgggctggtgaccctaagtgtgtctcctgcctttattctctctagtgggttattctttcatgtggtatcttgcctacagcatgctgtgtttggacacaaacccctttccttggtttctctgacccagctgagatggactgattccaaaagaactcacctatgtactggggtaggggagggagggttttttgcagtatttaactaaggttcaaagagtgctatatagtgagaaaggcttcttttttttttttttttttttttggcagagtgctgcctcctagaaatttctcttggtaacttccttctctgaagcacagataaagaaaacaattacagtagaaacatttatgagggacacattggaggccgatgaagcttttcaagttccagcagtgcagggatgtgggcagaactgacattggaaaatactagaatgatggaaattcagttggagaggactgccctttttaatgtctggggagtctgctcagggagaaatgacaagtctggcggggacaagtatgggatttggtaagacttggatcaacttgggatacagggtgggggtcgggagtggaatcaatgaatgatgccagagcagatcaactaacaagaggaccctgatgagccccaggcagaggcgtctcccttatgccccactctgaagtgtttgttagtaaacaccagaacgccattgttgttactgctgaattttattttgggctgtacatatttagatgcttaaggtaaaaatgataaagccctcaagccactgtgtgggtttgggtccaagtgttccttcttgctgcctctctaacacgcctggttaaaataatccctttggatggtgctgagaagcacctgaaccaagtgggtccccaaataacaatggcgtgcaagtgtctggttcccagaagttggtgactaggtaagcagcttcagggagagggggctgattcccagacagtcgcctgttcctgcggggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctaggtgtgagctgagaaagagaggtggaggctaagcaggtgtgatgcttctcagaggtgctgagtttttgcccttctgagcagggaatctttgcttatccctttgaccaaggatctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcaggtagcctgcggcgtggggtgggcagcaattgaggcagctgggaaatgaggctacaaagccagagc

SEQ ID NO: 2427 - DNA, 1771 bp; single-stranded, linear
cgaattcgggggacatctgtttggggaactaagagcagcagcactttcagattcagtccatatagagctgtcctacagcattctggaaacttgaggatgtgcggtgcataaacgggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgaggatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctctcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattc

SEQ ID NO: 2428 - DNA, 2100 bp; single-stranded, linear
gccgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgcct

SEQ ID NO: 2429 - DNA, 2375 bp; single-stranded, linear
ccaggaagctacctggaggaggtgagtcttagcggatgagtaggagttgtccacggaggaaggtacacagaagggcttccaggcccaggaaacagcagaggcacagaagtgagaatgggtgggtgagttggtggggaaactccaggtgcagaggatggtagcgaaacaaactggagcattaaggtccaagtcctccaagatcttgacttgcagattaaggagtttgttcacctaatctgctttgggcagagtgtggtgagtcctagagacccctctaggtctctcctctcagtagccccagaaggcctggagagctgcttctgggtgccaagcaggcagtgactccatcagatctagatttgggaaaagcatccctggtcagggcctgcatcagggcagtggctggccatgaggaccctgagaagtagacagattcacggagattctcaggaggccagacaggagactatggtgacaaattagattagagaaggggagagaatgaaggagcagttggggtaaaagaaaactgaggctgacatgggtatatgggtggcgagtgactcaccacccactgagaggagaacctcacaagctctgacatgctctggttccaggttctgttggggctgatccaagatggtagcctagaggtgcacagagatgggggccttgctttgcaaaaggatgctggctgctggcccacagcatggtaatgagatttgagctttatgtgcccagggctgggaggagggtcctgtcactttgaaagcaaagagaggctctagagaggggcatgttgagataggaatgctgccttgagacacctggctttccccactctgggtggctctcagcagggtgggtttcccctgccaggcagcactgaacctctgtgcgcttccggctgggagagtttttaccgtaactacatgtggaaccatcctgaaggaacatctggatgggatggggtacagggaagggagctgccaagagtgctggccagggacctgggtctatgagctggttggggggtggggttgggtgcagggtacttgatcctgagtgggccttctgcggccaggattggttctagagtaggaggggtgggatcggggatgggggaagcctgtaactgcgctgcagttgtcaggtcccaggttctgggtgacctactaaggattctgggtccagtgtgggtcccaggttagacgtcctagtcctgagtccgtgtccacagttctgggtgttgagtctaggacagtgatctggagttgacagtccaatctaggtctgagtcctgaccccaagtctagagttcagggtcatggtagtagcctagggtcagaatcaaggttggggtcagtaaccaggatgggatcgaggtcatggtccaaaatctggatctggggacctgttgggggtctgaggtgagtgtcgcagtctgggtatggcgttggagacccagggctgtgatctgaggtcatggttagagtctcaggtggtgggccaaggtttgagtctggggtcctgtttggagtctggtgtcaggtcgtggactgcgtccaaggtcagggagtccggggttatagccagggtctgagatgaaagtcccagatggtgttcagaggtctgaatctgtgtcttggtgagcgtccaggttccctgtgatcacgtttggtgtcagggctgcggcccgactggggagcctgggatccagagatgtgacccgaggttgtggtcagagaatgggtctcgggtcgtcttcgtgccgggtccctgtcgtgttccaggcccgggtctccgtccagcatcgagggccgaggtcacggccagggtctgagcccgcggtcgcaggtctggttcggggtcagattccgcgcggcctccagggggcgccgtcgccgcccggctcggcccctcgcgggctcgctggcgttgtgcgcggcaggcggggccggaggcggcggcggctccgggggcgcgggccgggcggcggcggcggcggcgccccgactgcagtcccggcgggagcggagcgcgaagcgcggggccgggcccggagccggcgccatggggcggcgccgcctgtgagcggcggcgagcggagccgcgggcgccgagcagggccaggcgggagcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccaggtgaggagaagct

SEQ ID NO: 2430 - DNA, 4475 bp; single-stranded, linear
gccgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgcctccaggaagctacctggaggaggtgagtcttagcggatgagtaggagttgtccacggaggaaggtacacagaagggcttccaggcccaggaaacagcagaggcacagaagtgagaatgggtgggtgagttggtggggaaactccaggtgcagaggatggtagcgaaacaaactggagcattaaggtccaagtcctccaagatcttgacttgcagattaaggagtttgttcacctaatctgctttgggcagagtgtggtgagtcctagagacccctctaggtctctcctctcagtagccccagaaggcctggagagctgcttctgggtgccaagcaggcagtgactccatcagatctagatttgggaaaagcatccctggtcagggcctgcatcagggcagtggctggccatgaggaccctgagaagtagacagattcacggagattctcaggaggccagacaggagactatggtgacaaattagattagagaaggggagagaatgaaggagcagttggggtaaaagaaaactgaggctgacatgggtatatgggtggcgagtgactcaccacccactgagaggagaacctcacaagctctgacatgctctggttccaggttctgttggggctgatccaagatggtagcctagaggtgcacagagatgggggccttgctttgcaaaaggatgctggctgctggcccacagcatggtaatgagatttgagctttatgtgcccagggctgggaggagggtcctgtcactttgaaagcaaagagaggctctagagaggggcatgttgagataggaatgctgccttgagacacctggctttccccactctgggtggctctcagcagggtgggtttcccctgccaggcagcactgaacctctgtgcgcttccggctgggagagtttttaccgtaactacatgtggaaccatcctgaaggaacatctggatgggatggggtacagggaagggagctgccaagagtgctggccagggacctgggtctatgagctggttggggggtggggttgggtgcagggtacttgatcctgagtgggccttctgcggccaggattggttctagagtaggaggggtgggatcggggatgggggaagcctgtaactgcgctgcagttgtcaggtcccaggttctgggtgacctactaaggattctgggtccagtgtgggtcccaggttagacgtcctagtcctgagtccgtgtccacagttctgggtgttgagtctaggacagtgatctggagttgacagtccaatctaggtctgagtcctgaccccaagtctagagttcagggtcatggtagtagcctagggtcagaatcaaggttggggtcagtaaccaggatgggatcgaggtcatggtccaaaatctggatctggggacctgttgggggtctgaggtgagtgtcgcagtctgggtatggcgttggagacccagggctgtgatctgaggtcatggttagagtctcaggtggtgggccaaggtttgagtctggggtcctgtttggagtctggtgtcaggtcgtggactgcgtccaaggtcagggagtccggggttatagccagggtctgagatgaaagtcccagatggtgttcagaggtctgaatctgtgtcttggtgagcgtccaggttccctgtgatcacgtttggtgtcagggctgcggcccgactggggagcctgggatccagagatgtgacccgaggttgtggtcagagaatgggtctcgggtcgtcttcgtgccgggtccctgtcgtgttccaggcccgggtctccgtccagcatcgagggccgaggtcacggccagggtctgagcccgcggtcgcaggtctggttcggggtcagattccgcgcggcctccagggggcgccgtcgccgcccggctcggcccctcgcgggctcgctggcgttgtgcgcggcaggcggggccggaggcggcggcggctccgggggcgcgggccgggcggcggcggcggcggcgccccgactgcagtcccggcgggagcggagcgcgaagcgcggggccgggcccggagccggcgccatggggcggcgccgcctgtgagcggcggcgagcggagccgcgggcgccgagcagggccaggcgggagcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccaggtgaggagaagct

SEQ ID NO: 2431 - DNA, 2599 bp; single-stranded, linear
cagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaa

SEQ ID NO: 2432 - DNA, 981 bp; single-stranded, linear; identical to SEQ ID NO: 2420

SEQ ID NO: 2433 - DNA, 2900 bp; single-stranded, linear; identical to SEQ ID NO: 2421

SEQ ID NO: 2434 - DNA, 1942 bp; single-stranded, linear; identical to SEQ ID NO: 2422

SEQ ID NO: 2435 - DNA, 1687 bp; single-stranded, linear; identical to SEQ ID NO: 2424

SEQ ID NO: 2436 - DNA, 1733 bp; single-stranded, linear; identical to SEQ ID NO: 2425

SEQ ID NO: 2437 - DNA, 2470 bp; single-stranded, linear; identical to SEQ ID NO: 2426

SEQ ID NO: 2438 - DNA, 1350 bp; single-stranded, linear
ctgctgaattttattttggactgtacatatttagatgcttaaggtaaaaatgataaagccctcaagccactgtgtgggttgggtccaagtgttccttgctgctgcctctctaacacgcctggttaaaataatccctttggatggtgctgagaagcacctgaaccaagtgggtccccaaataactatggcgtgcaagtgtctggttcccagaagttggtgactaggtaagcgactcagggagaggggctgattcccagacagtcgcctgttcctgctgggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctagggtgtgagctgagaaagagaggtggaggctaagcaggtgtgatgcttctcagaggtgctgagtttttgcccttctgagcagggaatctttgcttatccctttgaccaaggatctttgctccaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcataatcagtgcttccagctccgctcccacctgatcctgcactgtcctctggtccctgaatgaatgaactctgatacccaatcttgtctcgagccttctctatgccactcatggctcctcttctgctctttccatctttttgctgagagttactgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctg

SEQ ID NO: 2439 - DNA, 1771 bp; single-stranded, linear; identical to SEQ ID NO: 2427

SEQ ID NO: 2440 - DNA, 2100 bp; single-stranded, linear; identical to SEQ ID NO: 2428

SEQ ID NO: 2441 - DNA, 7328 bp; single-stranded, linear
aaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctc

SEQ ID NO: 2442 - DNA, 275 bp; single-stranded, linear
gcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagtt

SEQ ID NO: 2443 - DNA, 1464 bp; single-stranded, linear
gagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggagggagg

SEQ ID NO: 2444 - DNA, 2599 bp; single-stranded, linear; identical to SEQ ID NO: 2431

SEQ ID NO: 2445 - DNA, 7328 bp; single-stranded, linear; identical to SEQ ID NO: 2441

SEQ ID NO: 2446 - DNA, 2239 bp; single-stranded, linear
ctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgncctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaagggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactggcactgccaccaccagaaagctgttcgacgagacggtcgagcagggtgctgtgggtgatatggacagcagaagggggagaccaaggttccagctcaaccaataactattgcacaaccacctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctaga

SEQ ID NO: 2447 - DNA, 2478 bp; single-stranded, linear
tgatcctatcacaacctgagagtagtttttactccatttacaggtgaggtcattgtggttcaaggacgttaagtaacttccccagctcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactgcagaatatccagtggagcctcagatgaagaacatgaggccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgacctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagtgttgatgtctccggtaaaacaccggagactaattcctgccctgcccaattttcgagggagcatggctgtgaggatggggtgaactcacgcacagccaaggactccaaaatcacaacagcattactgttcttatttgctgccacacctgagccagcctgctccttcccaggagtggaggaggcctgggggagggagaggagtgactgagcttccctcccgtgtgttctccgtccctgccccagcaagacaacttagatctccaggagaactgccatccacgtttggtgcaatggctgagtgcacaagtgagttgttgccctgggtttctttaatctatcagctagaactttgaaggacaatttcttgcattaataaaggttaagccctgaggggtcccttgataacaacctggagaccaggattttatggctcccctcactgatggacaaggaggtctgtgccaaagaagaatcaataagcacatatgagcacttctgtatatcagtattgagcactgtaggca

SEQ ID NO: 2448 - DNA, 1231 bp; single-stranded, linear
atgttctctccctggaagatatcaatgtttctgtctgtttgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgctt

SEQ ID NO: 2449 - DNA, 1231 bp; single-stranded, linear
atgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgctt

SEQ ID NO: 2450 - DNA, 266 bp; single-stranded, linear
gcccttcaaagatgagctgttcccgccgccactccagctctggcttctgggctccgaggaggggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagtt

SEQ ID NO: 2451 - DNA, 275 bp; single-stranded, linear; identical to SEQ ID NO: 2442

SEQ ID NO: 2452 - DNA, 1464 bp; single-stranded, linear; identical to SEQ ID NO: 2443

SEQ ID NO: 2453 - DNA, 2599 bp; single-stranded, linear; identical to SEQ ID NO: 2431

SEQ ID NO: 2454 - DNA, 7328 bp; single-stranded, linear; identical to SEQ ID NO: 2441

SEQ ID NO: 2455 - DNA, 2239 bp; single-stranded, linear; identical to SEQ ID NO: 2446

SEQ ID NO: 2456 - DNA, 2478 bp; single-stranded, linear; identical to SEQ ID NO: 2447

SEQ ID NO: 2457 - DNA, 1231 bp; single-stranded, linear; identical to SEQ ID NO: 2448

SEQ ID NO: 2458 - DNA, 1231 bp; single-stranded, linear; identical to SEQ ID NO: 2449

SEQ ID NO: 2459 - DNA, 266 bp; single-stranded, linear; identical to SEQ ID NO: 2450

SEQ ID NO: 2460 - DNA, 275 bp; single-stranded, linear; identical to SEQ ID NO: 2442

SEQ ID NO: 2461 - DNA, 1464 bp; single-stranded, linear; identical to SEQ ID NO: 2443

SEQ ID NO: 2462 - DNA, 1426 bp; single-stranded, linear
ctttgtgaagaaggaattggcaacactgaaacctccagaacaaaggctgtcactaaggtcccgctgccttgatggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgctagtagcagtgagcaaaggtgtgggtgtgaaaggtttccaaaaaaagttcagcatgaaggatgccgtgtgtgttgttgccaacacttggaacacaatgactggagacatagttgtgcatgcctggcacaacatcaagcctgtgattgtgtttattgatgatgttgaacaagtggtggctttgagggattctgtatgccaagtggaaaaaaaagatgtctccggaattcgacaggttatca

SEQ ID NO: 2463 - DNA, 5161 bp; single-stranded, linear
tttcatctctccgggcttatttgctggtttctccgaatgcgggccttgtctggttcacgctggatccccaacgcctagaacagtgcgtggcacgcagttcgtccttctataaatatcggactaaatgcatctctgtgatggtaatacccacacggtgttgtgagaatgaatgagtgattctgtgcaagttcctagtgatctgttacaaaaagtactggtcgctaaattactcttataataaagcatacttttaggataataaagcactattcgcgaattggttaccgctattatgaaattactgagcaatacatatctacatctgatcagtctccagaattatgccaaatcctaccttcttctgaaagtatctcctaattatctgcacctgaccctagtgatgctgtgaatgtgcaagtatagctacatcctccgaaggaaggatctttactccttttacctcctgaatgggctgcgtctgctgaaagcgcgggggaatgggcggttggaagcttggccctacttccagcattgccgcctactggttgggttactccagcaagtcactccccttccctgggcctcagtgtctctactgtagcattcccaggtctggaattccatccactttagcaaggatggacgcgccacagagagacgcgttcctagcccgcgcttcccacctgtcttcaggcgcatcccgcttccctcaaacttaggaaatgcctctgggaggtcctgtccggctccggactcactaccgaccacccgcaaacagcagggtcccctgggcttcccaagccgcgcacctctccgccccgcccctgcgccctccttcctcgcgtctgcccctctcccccaccccgccttctccctccccgccccagcggcgcatgcgccgcgctcggagcgtgtttttataaaagtccggccgcggccagaaacttcagtttgttggctgcggcagcaggtagcaaagtgacgccgagggcctgagtgctccagtagccaccgcatctggagaaccagcggttaccatggaggggatcagtgtaagtccagtttcaacctgctttgtcataaatgtacaaacgtttgaacttagagcgcagcccctctccgagcgggcagaagcggccaggacattggaggtacccgtactccaaaaaagggtcaccgaaaggagttttcttgaccatgcctatatagtgcgggtgggtggggggggagcaggattggaatctttttctctgtgagtcgaggagaaacgactggaaagagcgttccagtggctgcatgtgtctcccccttgagtcccgccgcgcgcggcggcttgcacgctgtttgcaaacgtaagaacattctgtgcacaagtgcagagaaggcgtgcgcgctgcctcgggactcagaccaccggtctcttccttggggaagcggggatgtcttggagcgagttacattgtctgaatttagaggcggagggcggcgtgcctgggctgacttcccaggaggagattgcgcccgctttaacttcggggttaagcgcctggtgactgttcttgacactgggtgcgtgtttgttaaactctgtgcggccgacggagctgtgccagtctcccagcacagtaggcagagggcgggagaggcgggtggacccaccgcgccgatcctctgaggggatcgagtggtggcagcagctaggagttgatccgcccgcgcgctttgggtttgagggggaaaccttcccgccgtccgaagcgcgcctcttccccacggccgcgagtgggtcctgcagttcgagagtttggggtcgtgcagaggtcagcggagtggtttgacctcccctttgacaccgcgcagctgccagccctgagatttgcgctccggggataggagcgggtacggggtgaggggcgggggcggttaagaccgcacctgggctgccaggtcgccgccgcgaagactggcaggtgcaagtggggaaaccgtttggctctctccgagtccagttgtgatgtttaaccgtcggtggtttccagaaaccttttgaaaccctcttgctagggagtttttggtttcctgcagcggcgcgcaattcaaagacgctcgcggcggagccgcccagtcgctccccagcaccctgtgggacagagcctggcgtgtcgcccagcggagcccctgcagcgctgcttgcgggcggttggcgtgggtgtagtgggcagccgcggcggcccggggctggacgacccggccccccgcgtgcccaccgcctggaggcttccagctgcccacctccggccgggttaactggatcagtggcggggtaatgggaagccacccgggagagtgaggaaatgaaacttggggcgaggaccacgggtgcagaccccgttaccttctccacccaggaaaatgccccgctccctaacgtcccaaacgcgccaagtgataaacacgaggatggcaagagacccacacaccggaggagcgcccgcttgggggaggaggtgccgtttgttcattttctgacactcccgcccaatataccccaagcaccgaagggccttcgttttaagaccgcattctctttacccactacaagttgcttgaagcccagaatggtttgtatttaggcaggcgtgggaaaattaagtttttgcgctttaggagaatgagtctttgcaacgcccccgccctccccccgtgatcctcccttctcccctcttccctccctgggcgaaaaacttcttacaaaaagttaatcactgcccctcctagcagcacccaccccaccccccacgccgcctgggagtggcctctttgtgtgtattttttttttcctcctaaggaaggttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatgttctgatttctgttgacattcttttggctagtagaagacaaaagtaatacatttatggtatgcaaagcactatcctaggtatttcattgtaatattttacttaccccttatcacaactctgatagattctgcttctgttactaattacattttatagaagaggaaacggaggcacagaaagcctaagtaacttggttaaaggcatgtagtaagtatcaaatcctgtattttaaaccaggtaacatgacttaacgaatctgaagccttcaccactttaaattcaaatggaagtttagaaatggccagccagcacctatttgtatgaaaggtcatctttcagaggataagcatgtataaagaagaaaaggtatgcagtcgtgtttggattttactccaccatc

SEQ ID NO: 2464 - DNA, 877 bp; single-stranded, linear
aggatgatggtgatggggaactaaatggggaaatatggaaggtcacaggaaaagttaacacaagttagcaaaaagttaacataacacaaaaaggtcttgcaggaaaaaaaaaagaaaagaaaagaaagaaaaagtctccaagaatggtttggacagccaaaatgaatacttatagtcacgtatacctgctcactcctgacgcttcactcacacacagcacaggatctggtgaggctatcactaaatgtgccacattgtggttaagttttacctgattaacgaaatgctcacacttctaaactgaggtccttacagtagattccttttgcaagattgttactggcttacaacttaaaaataaaggaaaatcacaaggaaagaaaagtggggaaaaaatcggaggaaacttgcccctgccctggccaccggcaaggctgccacaaaggggttaaaagttaagtggaagtggagcttgaagaagtgggatggggcctctccaggaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgc

SEQ ID NO: 2465 - DNA, 2615 bp; single-stranded, linear
ccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcagaaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggagggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 2466 - DNA, 3490 bp; single-stranded, linear
aggatgatggtgatggggaactaaatggggaaatatggaaggtcacaggaaaagttaacacaagttagcaaaagttaacataacacaaaaaggtcttgcaggaaaaaaaaaagaaaagaaaagaaagaaaaagtctccaagaatggtttggacagccaaaatgaatacttatagtcacgtatacctgctcactcctgacgcttcactcacacacagcacaggatctggtgaggctatcataaatgtgccacattgtggttaagttttacctgattaacgaaatgctcacacttctaaactgaggtccttacagtagattccttttgcaagattgttactggcttacaacttaaaaataaaggaaaatcacaaggaaagaaaagtggggaaaaaatcggaggaaacttgcccctgccctggccaccggcaaggctgccacaaaggggttaaaagttaagtggaagtggagcttgaagaagtgggatggggcctctccaggaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgcccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcagaaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggagggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 2467 - DNA, 8124 bp; single-stranded, linear
tcccagttaatacataatcaatatgcaatttattaatacatctctccatgtccactccccctgtatcttgccattcttgacctgcatttccatcctccttaccttccctagaggccaactcattttctttgaaaaacctggcatttcccagaaaaaaaagtgaagggctgggagctgtccgttgtcctgatttgctccctctgcccttgcttccaaatgtggttggaaagaagcactattgaaaaatccctaaacgcacccctgcagggttggctctaccctgtagccatggacacatgctgttgataccacctgcctcatgagtctcacataatttgccctttcacactatctaccccatcagccttaccaaaaccatacctgcatcctgggcagcatctgcccttcaagagactaaggaatctccttgcaaccaagaatgactagaccaatgagacaccctttaaggccccagcacaatatagaaatcccacaatatggtaatcccagtaaggagctatcaagccattgcaggaccatctagaatacaactagagtatagttcctttcaatccaggaactatactctaacagcttggctcacaggaaccagaagtgaagatgatgaggatcagggctgagcctgtgagcaccagctccaccactgacaccaaccacagattaaacaagcatcttgtggacccctgggatggaaagaatagttgttgccttatcaacctcccccacagcccacacagaaaagataaaatcatcatggctacagtgttacagaagatgatgacccaaggagtaggcctgcctgagtgaatgctgagagtgataatgggagcagtagcatctcagagactacagcagaaaccatccacataaagagctttgcccaaacttatgataaagggcaccctcagagactctccctactttaatattagcccattgcagaaatggtgagtggaaagagaaatcttaggaagaaccccttaaaaaagcaaaatgctttttaggtttgtgctgaagagcctggaaaagaaataaggacacacacgctgagaaatcttcctcctgccccaacactgggataatctccaaggatctctccatatctcattctcctggatacactgtccactcagaaatattgtgcagagtgcagtaattcaaaagtgagctattgtgttaggagtgaaggcaagagtatcgtaaaataaatcaaatttgaaatgaattctcttaaattgctttatagatgtttaatgtaagccagcagctattaaacgataaaccttaaattcgagaaaaacttggtcattcagaaactatagaaacaggcaggacttattgcgagggcaaacacagagtgagctccagcctgcttcaggaaaatctgccagtgccatgaaggatgtactctgtctgctccactgcactactgctcagtatgagcccatgccatcagctgtccctgacccacaggagttctttagaagagactggtcaacaaaagtttctagggtgttttatacctgccaactcgagggttaaaacaagttgcatagaaatgctcaatcaagaaagacacagtcattactcagagaataataaacagcctggcagcacatgaatgaatagaaaaaagatgttacatgcaaagcatgaaataaccaaattccataacagatgttaatctgtaatgtgtttaggagaatttagaggaagtataagatttattctttcatcaaaaaaattatagccaatgaggatatatctatcaattatccatcaagtggtgatatggcagcacaaggtaaaacacaaaggaataaaaccaacgtttattaagaaccaatcatgtggcatttcacattgagcatcatatttaattctgaaaaaaatccttgtactgtatcattcttcatattttatggatgcagtaactaaggctgagaactttaaaatttttcctaagttcagacacatagctaagtggcagaaccaagattcaaactcaccccatctaactgcagagcaaactgcatgccttaaatgtcaaagtgaatactagcacagttaatacaatgtttggaaactcagagaaggaatgatccctctgcattatagttactaaggaatcattgccattatttaaatgccagtgcttctacatcaggcccaaattttctgtcctactaactgtgaatcaagacttgattcaacctctacttgagtatctgccgcaatgagaaatcacttacctccactaaccacacatttattttataacaacagattgttagtaagtcctttcttatacatactcaacagctgcttcccaagatgctgtaggattatgtctagagtcaaactagccagaagcaatgtccaaaatacaccataacactgtgcagcaaaggtcctactaccacttgtttggcccaaacattctaggcagcactggatatctgaatcatcaattatttccacaaacactgacccctctaccagtcaccctcactagaagaattaattccacatgataatagctccctcatgttactcccttctaagtcaaattgtacacccctttatctgattaacagagtctaagtcacatgacctaaatgcaagagaactgggaatggacgtttgtggattctaccttagtaaggcaaagttatcattgggaattcctctaatacaggaagggtgttccagagacattaaggagccatataaatggaaaatgtccactacaatccatcacttggttgccccacatcaacattcattcttttgccacacttaaagtttccaagaacaaaaattatcccactgaacataatctttactatcttttatataaaggaaaattagacttgactcagcagaactgaaataacccagctctaacagttactgcttttaacttcaagtactgtgtctctaggtgatacctgctccaacaatagtttggtcacattttcaatttgatattctctagtctcccaacttgataactgtaccctaaaccataaagttcactaccaacatgctatatataaaataaccaaagggggaagaagaaagagaaaaaggaaatctcttaaaatacacaggtatacatatgacaaagcaaagaaggaaatgtgagcagatagtgcagtcctcgtttctgaaattggtcccctgactggggctatacctattccatttcctcaccctcagccaggcaggtggagcaaaaacttaagtcttggtggatctgaatcttgatgctgtggagctgtcttactagccccagactacctgcctctcaatttctaattatatcagtgaaagcaaacagctttgatttgtttaagcctctgattttttggtctaactgatgtaagaccacaaggacaagagttctccagctccggattctcttctgttctgttaatggtgaaatgcccgagagaagagttgccaactttggcaaataaaaaatacaggattccagttaaattcaaatttagataaacaacaattttttagtattagtgtgtcccattcaatatttggacatacttaactaaaaaatgatttgttgttcatctgaaatacaaatttaactgggcattctgaatattctctggcaacccccgagagagtgaagaaagtggtacaaggacacttaagaagaccagatttgaaaagacattacggatgtgtttaaatgtcttattctagagagagttagagctgtaggtagaacttgggaaattaagttaaaagcagacacagagacctggccaatatatactaaggagtggatcactctggtcacaagcccaacctgagaccaagggcatagtgagatgatttgggaaaggcacttatacactactcatccccgtctttgaactaaatgccttataaatctccaagagaaatgacagtccaccatgtggactgctttctgtaagtccagggaaaataaaagctatgtgcttgaaacccacttctgatattataaggtgtgtgatctttgtcatgttaatgggtctgagtatcaattctacaattgtaaagtgacagtaatggtgtgtccccaggttgttgtggaaagcttgattcttaatgcaacagtaggaaaccccagcctctctggagcaaacacccttctacatctttacttcccctgcacattggcaggactctattcctctatttctctctagtgctagagcagaaagggaccttgatttgatatcaggaaaatctatttctgaaccataagctatgatagctgatttaaaaaattgactatcatgacatgataatgatcataatggtaatacatattgatagggttgccgtgaaagtaataatatatctaagagttgtgacaatatatgatacgcctagactctcagaaaatgctaattccaatcccaattgctctttgcataaagttctgtcctagggtctgttcttttcccacatctaccctccttggatctctcttctgtctttttcatgtggttcagaggaggagagagatccaggtcaatgtttttcaaattacaaggaattatcatttaaatggggaagaagctcaagttttgacgtgtagtggaattggagtggagtggagtggaatggaaactaacaggaagacactgcacatggttaagataaagattgtttcctgaaacctttaatttgtgcttacatactcacacatacatatgtgcatgcactgggactctgcaatatgcatttctgactatggaacatagccataaaagtctttgcactgaacgttcagtgggcctttcacaagctgccctaattgggaaagaaaaacatggtccctccatttcctgcccccaactccagaaaagtcaccatagttgagggtacatctgagaagccagcacttgggagttcagggctcaagttcctttctagaaaaacactgggtgattctaggggaacttccgatcagaaacagccaattcagagtgagagaagaaaacgtgaccatgcagttcctgtggttaccagccttgcccctctcttgccttctgggagttataaaacccaagactggaaaggaaaaccagcatttgctcaggcagcctctctgggaagatgctgcttcttcctctccccctgctgctctttctcttgtgctccagagctgaagctggtgagtatcagggttcttccctctgaaatctgcagtatcagctcctgaaacaaagatgtttagtctgaaatagctgactcctaaacagggttccaagatctctcttcaagagtcccacagaggaaatttccacttgggatgtgtgccaccccacccccacccccacccactgccattctctacagcctaggacacccccaggaacaaggaatttcacctcaattgtagaaaagcccagagcaagtggaaggaaaaggggtatccccaggaaaacagacatgtcctcttaatcttctgagcatcagggctacccattactttgtgactttctcactctgtgaccatgctcaagagctatggagaaatctaaaacaggaacctggacagtgggtcctacacagagacagaggagagtgggccagggcaaggtgggagtgggagaagtctgagatgaaaacatcagaatggagcagaggcaagaatgagatttcacctgggaggttatgggtggggaaagatacgaaatacaggagacaggagagggaagatgggcggaacacagggtgagaatgagattccagggaagcctagctcagctttaacccaatttgtccattcattggagagagtatctatggccgtgttcaaaccctggggtgctctgttccaggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtgagacaacagggtctatttatctccaaatgggagatgaacaaccagagtagcatccaggaatacacctgcactggggactgaagagggggtcctgggtcttgtcaactttcaggagagggaagactttgggctgaaagactttagtctgtgtttgaatagttccttgagcctcagtcactgagctaagctcccttcggaggaaaaggaggtcctgtccgaaggtccctcttgttgcagtagcacccctcacccctacccaactcaagacacacggctcacttttcagggccccacccagtctcagggccacttcctctatggccttttcaagaacactggctctagttctcagggtcctgaacccatcattttatgggagcagagaacaggtctacataagacccccactttcccgttttaactgatatctcctgcttcaggggctggccctcatgcagggttccctgaattaggaagtgtgaaccctgtcccctgagtcctccctggcctgttcagtccccagcaattccaggggtcgtagaaattgtgtctgtttcctgagaaagctctttcatgagttaagcctgagccctcaaatgccacaagtggcccatgaaaagggagatgggtagagtccggcnacccagtgacagagtttagtcctcttttctcagaatgagctcacctcagaagaaaccccaagccatcactgtcgcctccttttccttccttcttcctcacagcaggtctataacagtcacccttggagcccataacataacagaggaagaagacacatggcagaagcttgaggttataaagcaattccgtcatccaaaatataacacttctactcttcaccacgatatcatgttactaaaggtgacaacacctctcttctccctttccacttcccattctcctaagcttctccttcaggtcctcattgccctgaatttttcttaggacttggctataacatgaagctactcaccctgtccctccctgatcacctccaactgtccagagcccatttcgaggactgacagtccttcattcccttcacagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaaggtgatcctccaactaggtttcctctccaaaactcactgttcagggacctgaatgctcttagaaggagatggggtcagcaggttgtcagtcaggtgacagggtgagcatcacaggaattgctgtcctcccgtggtccaagacagcctctgaccatccattccagtctactgcactgggggcatggggtgactgtggagaatgtggatgacggtcccaagaaaggaagaaggggcatcagaactagatgtataagtgaggagctccacctcctgggtctgactttaggtctcactgtgactccaagctggctggcagacaggagtggaggacttcccgggctcaccttcttctctctctcctccccctacagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaagggaagctggaactggaccttagcagcaaagtgtgtgcaactcattctggttctacccttggttccctcagccacaaccctaagcctccaagaggtctcctacaggtaacagaactttcaataaacttcagtgaagacacagcttctagtcgtgagtgtgtgtccctctctgctgctctcttctcctgcacatgtgacctgattcccagcccaagcaccaagga

SEQ ID NO: 2468 - DNA, 681 bp; single-stranded, linear
atcatcgggggcacagaatccaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaa

SEQ ID NO: 2469 - DNA, 1310 bp; single-stranded, linear
gccaccatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgcctccatctggatcctgtcctttatcctggccattcctgaagcgattggcttcgtcatggtaccctttgaatataggggtggacagcataaaacctgtatgctcaatgccacatcaaaattcatggagttctaccaagatgtaaaggactggtggctcttcgggttctatttctgtatgcccttggtgtgcactgcgatcttctacaccctcatgactggtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcct

SEQ ID NO: 2470 - DNA, 1868 bp; single-stranded, linear
gaattcgggaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtatcccgaattc

SEQ ID NO: 2471 - DNA, 2008 bp; single-stranded, linear
taccagtccaaaagtctgatgacctcggtccccatgaacggaacaagcatccagtggaagaaccacgatcaaaacaaccacaacacagaccggagcagccataaggacagcatgaactgaccacccttagaagcactcctgaattcgggaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtatcccgaattc

SEQ ID NO: 2472 - DNA, 362 bp; single-stranded, linear
gctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtat

SEQ ID NO: 2473 - DNA, 575 bp; single-stranded, linear
agtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgctttccagggtcacaggcatctgtattctttggattccttgaccttccccatttattcccggcattttcctaaaacgtgtgctttgctcctcctgcatcctccccttgcatgccctcacctaccccacatcttccctaaaaaaagcaagcccaactcaaagaccagttccctcatggaatcatagtggatctgccaagggaggggatgcccagtcctctgttcttcacaagactcccttcttctggctaaggtttcttatgcaattat

SEQ ID NO: 2474 - DNA, 2030 bp; single-stranded, linear
ctgcagtggtaaaaagattctatatctgctgtttgatgaatgcagcacccactagccacatagtgctcgtgagcacttgcaatgcggctagggtgatttcaattaacctaaaagagaacagccacagggagcatgtggctgccatattggatggtgctgctttgagaacaaaatgagagaaatgaagcctctatttaccttggttggcggaacacattgaagggactctgtattgataccaggcttcaaactttgggaagtgtactggccaacttaaacacatccacaggagaatgaagaggtttgggaagggaccagaaaccaggcattgaggacaatgagaagagtttttcaaaagtggaattactgcaaaaagtggaaaaatagcctttggatggaagttactgatgagacaatttccatcggtgtgaaagccatctttccaacagagatctgcaacatgagaatgtactgtctcctagggtagcgatggcctcttgtattagtccgctcaggctaccagatttatcgtttaaactgcccataaacagaccaggcagtttaaacaacagaaatttatttcctcgcagtcctggaggcaggaagtctgcgatcaaggtggaagcagggttggcttcttctcaggtgtctgtccttggctggtagatgaccgccgcctccctgggtcctcacatggtctttcctctgtgtgtgtctgtcccaatctcttcttataaggatgcaagtcttatggatcagagcacaccccaatgaccgtgtttaacttgaatcacctctttaaagtttctctctccaaatacaatcacctcctgaggcactgttagggcttcgacacaggaattcttttcctaggggattcagttcagtccaaaacgcctaccagtggagacttgcaacatggcggcctgctggtccctcgccaggaatatcacaggcgactgttccctgttgcatggaatagaaggctattccagagtactgtctctatttatcagatctgggatactgggagaagggcaaaataaagtccaagtagaaaaaaaaactatgaaagttttagagagtaaccataatttcagcccgatgtgaaacgatcctagatttcagctgaaatagtgatgtgggaagtgagggggccgggattcaaggcagagggaacagcgtaactgaaggcatggaaggagggaagtgtaggctgtgtttgaagagtggcagctgcttccacatttctaaaacacaggatgtgattttggggtgtgttgagacaaggcagaaaacttgtttggaaaaataacttgaattccctgcacatttaaaatctctcagcagaagaaaaccccactcagaaccccactgttcattccttggcttgtatttggscacagctggcatagccccagactgagtaagctcttcagacacctcatttcatgagtagccccaaagatcaatcatgggccaatttcttggaagagaagactctccggtgttttgcagttatttgttctgctttcgcgagatgttctcaaatcgttgcagctacaagccatgagtctgaagtgtttgtgttccctccttacaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgagagtgaccagaagaaatgacgcagaagtgaaatgaactttttataagcattcttttaataaaggaaaattgcttttgaagtatacctcctttgggccaaaatgaatcttgtgtctcaattggaagaggtaaagaagtagggggttagggtgcatgggttggaacgtgagacaggtcgaaccacaaagcctgcctggaaaaggggagtgacgtcctaggcttcagtgatgtcacctccactttgtttgatccacaaaccaacaggtgactgattttg

SEQ ID NO: 2475 - DNA, 322 bp; single-stranded, linear
gtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactt

SEQ ID NO: 2476 - DNA, 4799 bp; single-stranded, linear
gaattcacatttctcaccttttgatgtattaagaaagtatggagaaatatatcctctatcaaattttcatgccttcaataatttctaattcatcagtcagtgtttttccatcctttactgtgatgatgccctttcttccaaactttttcattgcatcagagatgatgttaccaatttctttgtctccatttgcagaaattgtagcaacctgtgcaatttcttcaggtttggtcacaggtttagactgctttttaagttcagcaattacagcatcaacagctaacatcacacctctcttgatttccactggattagcacctttgctaaccttctggaaggcttatttggaaatagagcataccagtacagcagcagtgatagtgccatcccccagtctctccatttgtgttattggcaacatcttggacaagtttagctccaatgcttttatatttatcctttaagtcaattgactttgcatcagtcacaccatcttttgttactttgggacttccccagctatgttcaataattactgttcttccctttggccccattgtaatggctacagcatcgacaaaaagtctacactttgaagcattaaggctcagacatcagcaccaaattttacatctttaccatcacttcaagtgaggtgaggagccagtagcctggacactggtctcatctggtgaaagactgtgggtaatggaagcatttctgtggggtggtggcaggacatgtgcatggtgaggcaggtcatcagcagcaagtgagagctgcctcttactttctaaaggtgacatagcaagtatacaaaaaaaaataaaatattaatttaggcagagcacataaaggctttatttcatattccatttctctgtatgctttcttcaccaggaagaaatagttttagtgtcaggaatgaatgagtctgcccctcaattccagcctgctcagcacacaaggaaacaaagccctgacaatcagagtgactccctggtgactaagctccagtcctggatgcatatttgtttagcagttctgacagcatctgacccagccctctctttgcataccccaccagaaccttctttttttttttttttctttgagactgagtcttgctctgtcggaagcgattcccgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaagtgctgggatgacaggtgtaagccaccatgctaggctcagaaatttccttttataaaaatgtcattaaggatcttggctgcacaatatcgttaccagcttcctttaaatccacctctggcctgccaggaatcagggttcttcagaacctgacattttaaatgaagaggtcaggcaggtcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaagaaggacagggtcctgagagacaccagagacctcacacagccctgaaaacatggggctccttcataagtgtttcccatcaccaacagggagaccacgtggaggccttgcagccctactcggtgcttctccaccaaatcccaagggcagtgacgctgacgtctgtggaaagcagagaaagccctggctcccaaagccctgaagtcctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctccagggtccctgggtttgagccagccctgtatcatccccaggagctgaatgtccgaacaatggatagaattagatggaaagagctctcaatttggcctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggaggaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctctttttttctgtctttctttttcctctctccctagagcatgtctttctttctttctctttcctttcttctacccacacttttagactgagtagactgaatgccctatttaattgaaccaagcattgcttccttcaatagaaaaggagtttgagaacccaatggacaactcactcgttcttctaagccaatatgaaggagcccagtagtttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagagtagatactgcaacctagagaattccagataatcttaaggcccagcctatactgtgagaactactgcagcagacactctgcccccaggacttttctgatcagaggccctgagaacagtccctgccactaggccactgcaggttcacaggacagggacagcccattgaaaccaacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatattttccaaaacctagaacagtataatgaaggaaggagggaaggagggagggagggagggaaggagggaaggagggagggagggagggaaacaaaaagaagaatgaggttgaaaccaggacttagatattagaaacaagccattacaaaatttatttctatggttaattgtggttttcaactgtaagttacttggtgttaatttcctattaaacaatttcagtaagttgcatcttttttatcccatctcagatcaaatacttaacagactaaatgatttgaaaaagcaaaagtttactggcttgtgtgtgttaaaatggaggtatggtggctttgatattatcttcttgtggtggagctgaattcacaagagatcgttgctgagctcctgccagaccccacctggaggccccagtcactcaggagagatcagggtctttcacaatcaggttctacaaaaataaacatcccccaaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgc

SEQ ID NO: 2477 - DNA, 3710 bp; single-stranded, linear
gaattccctgtaagccctgttacaggggctgcaccccagatacaacctgacctgtgtccaaggcgggcaactcaacccttagatattgaatgggtcccatggcaccaatgcttaaacaccagcagccctcacaaccacagatcgtgttttaaggatgaggaggtagttctctggatgcacaggcttcaatccaaatgggctcatgacgccgcagcacacacccagtctgcagcctgaagagttggagcattgcattcacagaaagcatccagacatgatcatgggctcagggatacacctgttctccgatgtgtaccagtgaaggatggaaactcctatgcctcccagaaagcaccactcaagcttttgctgaatgcttctctgaaggcccacaaggctgagaggctgtgcaacaccagcagtaaagtgaatgcccagactcccacctcctttcttgggtggccatctggaaaggccactcccaccctgatggctaatgcctcagaccagttcttggcccagatgatcctagacaattgtttaagcttaaactgttcattggccaagcaaacaggtgatagtacctctggggaaccacatgccgcgtgtacatccagatctcaggagaacccaaaaatgtctgttccacatagcaacagaagcccaggtagcactcagtctcacctgggtgttctccaacatcccagctcagccaaatggctttcattagtttttatggttagaccccaggtcctcgggacactgctttagaaacacattccaaatcctcctctgtgtgcaggtggcattcctatcccaatctctttgcagggcgtatactgtgatacgcagccaggctgtcccagaggccttaaatattcccttggtgcaggtagttcagcttagccacagccaatgcatcacagggtcaactgtgttaggagccattgagaatccatagttggttgctgcctgggcctggccagggctgaccaaggtagatgagaggttcctctgtggagttctactttaacctcaccttcccaccaaatttctcaactgtccttgccaccacaattatttaatggacccaacagaaagtaaccccggaaattaggacacctcatcccaaaagacctttaaataggggaagtccacttgtgcacggctgctccttgctatagaagacctgggacagaggactgctgtctgccctctctggtcaccctgcctagctagaggatctgtaagtactacaaaacttaaactttacactgagttttcatcattgaagctatgcctccaatctgacctctgactgtggggccgccccagagggacccagcgggtgaatccctgctaggaacgtctgtccggacctctggtgactgctggggacgatggcttccagctaacttaatagagaaactcaagcagtttccttctaaatacacatgtcacatgtcctggttgacatgtccagtaagaagactatcacaggtctttggaacattcttttgagagaaacctatttaggtccttggtctgtttttcaatcaggttgtttgatttttgctattgagttgttggaattccttatgtattcagatatttgccccttctgccatgtaggttttgcaaatattttctctcattttctgggttatcttttcactcggttgattgtttcctttgctgtgcagatgctttagcgttaaatgaagccacacttgtctattttcccttttattgcctgtgcctttggtgtcatagccaagaaatcattacctacatcaatgtcaaaagctttatccttctatacacttctagtagtttatggtttcagttgttacatttaggttttcaattcattctgagttgatgttcctacatggtgtgagataaagatttaaatacatacatatataaaatcatgaggtagtgtacactataaatatacaattgttaattgttactcaagtctaagtagaggtggaaataataaactttcttttttttacttaaaccactctgtgtcactgagctgatttcacctttagcctgataaaatcattgtcctctccaccctgattcctacaggagactactcaccccataacctcaaaaacctcttcatgaggatggtaagtcacctgaatcctgaagtgaattactcgctattccattggaactcatataggacaccagaatctagacctccagagaacagcaggacccatcttcagaaaataagaagcatttgttccctgagcctgttgaatcaaagtgcaatttctattctttttggaatgttaaaaagtgaatcataatatttaagcaggtgaacccacgagtaacatagcagggtctttcttgtcattattagctccaacctagcacagacattaaaggtacagatgtatactagcatgaaactgggagaacaggagcattcgagcaaccttgagaccaatgggcctctcttataaaatgcacacctcctctcactgagattgaggaaggtttcttgtctccgagccttctcccagtagagctataaatccaggctggctcctccctccccacacagctgctcctgctctccctcctccaggtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggtgagagaggcaggcatgcagagctgctaagtctagagggaaggacgggagagaggttccagagttgggtctcagcagtctatgtcactgaggtggcttcacttagaatctctgggcattgattttctcatctagaaattgaacagagagccaaataaacctgagaaactttatttctccaaagacttgattccaagaaacatctgtgaaattcactaagtttaagatatgaagagacagactagttatttctggatctaaacaagtagacttagttgtaaagagaacattttactctatctacagaagagcttttaaaaactgcagccaagcctgagggtaagttcaggtgtgtgtgtgatggggcaggaatgcaaaaatgagagcaaaggagaatgagtctcaaattctgtgtgacaagcactgctctgcgtgtttattcctatcgactgaggttgttcgtgctaccggctgcaatgcagccagcatcacctgtcagctagcatgtgacttccccgagattctttttcttacccactgctaactccatactcaatttctcatgctctccctgtcccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttacaagatttctgtgtttccacctctttaatgtgtgatatgtgtctgtgtcaagacacttgggatacacgtaccaaaacgcaaaatcaaatttttgaacaatata

SEQ ID NO: 2478 - DNA, 464 bp; single-stranded, linear
cctaccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttccttt

SEQ ID NO: 2479 - DNA, 3834 bp; single-stranded, linear
cctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattatatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagacggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatgtgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaaagtttcagagaagttctggctgaacactggcaacgacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 2480 - DNA, 141589 bp; single-stranded, linear
gatcaaaatttttacctattatgcatttgatatataaataagtatataaatgcacacacagacacagcaatgatggtgaacagtcttcatacaattatatggatgaatctcataaaatgctgagttaaagaaatcagaccaaagaacatatactgaaagattctctctatatacaaagttcaaaaataggtggaccaattcatggtggtgttagaaatcagaagagaggctacctttgtggggaggggacagtttaatgcccagaagcggtaaataaggaatcctctggggagtggtaatgatctggatgctggctacaggatgtgttggttgtaaaaatgcatttttttatatctagctttttccatgtgtatattatacttcaaagaagttcagttaataatttctcatgtcactgtagagtagctcagttagccccagcaagcctctggcttaatcttgttttaccttaagccatcagtcatttacaagtaggaaaattcacagggaaagttagagtataaaatccagaatgaaggtttactgggtaagagtctctccattttccaaagcccgtttatttcttgattccagttcttaagaagtctcagcattgtgtctttttcatgtatcttacaagaagacagcatgtgcttctaacacctgatacattgtatctaccagcacttggtaaacagaaaagaaccacatttttcttgtaggagaaatttggtgcctatttcctaccaggcaccaataagtgggaccaataggtgggattaaagatacagtagaaagtatttaaaacttgccagggggcaatagtctgaaaataagtaaattggtgctatagaatggaagttacaggcttctttcttttttcccacaagatctgctccttgagcccctagagacttttctgtctgttactgtttcttcattcctcatctgcagagccagccctgagaagtgcagaccaaagccagggaaggctctgcaaagatgtacaaatggaagtcaccttaataacctctgactgctgcgcataatacatttcactcaaaagaggggttaaacaatggaacagaatacagaggccagaaataatgctgaacactgacaaccatctgatctttgacaaaatccacaaaaacaagcaatggagaaaggactccctattccataatggtgctgggataactgtctagctatatacagaagattgaacctgggccccttccttacatcatatacaaaaaataactcaagatggagtaaagacttaaatctaaaaccaaacactataaaaaccctggaagatagcctgggaaataccattctggacataggacctggcaaagacttcatgacaagacaccaaaagcaatagcaacaaaaaccaaattgactaatgaaactaatgaaactctttagttgtacaacagatagtttatctgtacaacaaaataaactatcaacagagtaaacaacctacagaatggaaaaattttttgcaaactatgcatctgacaaaggtctaatatccagaatctataaggaatttaaacaaatttacaagcaaaaaaatgacctcattaaaaagtgggcaaaggacatgaacagatgcttttcaaaataagacattcacacatccaacaaccatatgaaaagatgtttaacatcactaatcattagaggaatacaaatcaaaagcataataagataccatctaataccagtaggaatgactactattaaaaagtcagacaataacagatgctggtgaaggttgtggagaaaagggaatgtttatgcactgctagtgggaatgtaaactagttcagccattgtggaagagagtgtggtgattcctcaaagaatgtaaaaccgaactgcctttcaatccagcaatcccattattggatatacaccaaaaggaatagaaattgttttaccgtaaaggcgcatgcatgcatatgttcattacagcactatttacgatagcaaagacatggaatcgtctaaatgcccatcagtggtagactagctaaaaaaaaaaaaatgtggtacatatacatcacagaatagtatgcagccataaaaatgaacaagatcatcatgtcctttgcagcaacatggatgtagttggaggccattatcctaagcaaattaatgcaggaacagaaagccaaataccacatgttctcatttataagtgacagctaaatattgagtacacatggacacaaagaagggaacaatagacatgggacctacttgagaatagagggtgggaggagggtgaggatcaaaaagtacccataggacactgtgcttattacctgggtgatgaaataatttgcacaccaaacccctgtgacacacaatttacctatatagaaaacctgtgcatgtacccctgaacctaaaagttaatggtgggggggtggggttaagctactttgtggtataaatctgagcattcatattaaaataaaatatttacctcattagagtaattaacatttattaagcaaagagccaagtaccttacacacatgatgtttaatctcacaatgatctttaatctcataacaaccgtccattgtatgtacatatgtggaaattgagccttggagagattaaatgcatggggcatgccatttgactagaaactggaagcatcaggatttaaactcagttctgaatggttttgtaggctttgttttttccacattatagcatggcctgccatgaagaacaggtcctttctggtgtttgtcttgtttggtttaagtgaagcaaatatttatttaaatattcaagatatgctgttaaatttttactcaaaaatttgagtacagtatggatcttctgaagccaaataactcttattcaatgcttagttgagaaattttatggagtagttctcaatttttatgtagttccactgcaaaggtaagtcttatggaaagattcactgtaattttttttcctcatttggacatcagctttttcttttcctcagacccgctgaaagataatttttaaaataaaaaccttgtttttatatcaagtggggacattttttccaaatgaaaaccgtgtattcattttatatgataaaatcaatgttattatttttaaaattttgatttaaaaatcattaaaaataaattttcagatattacctgaaattctaccatccagagataatagtgcttaaagatttgatatatagacacacacacatatatacatatatatcatcctaaacttctttgtataaatgtatataaagtttttaataaaaactaggagattaatgccctttgaatgaaaataaatacaatgtgtatgctttaacatcttgcctttactttataacatttatcacagcagtcatgagataatgatttacatggtcattgttagtaagctaatagctaagtgcatgaactctggagctagcctccctggattttaatcccagatctgtcactgaccagctgagcaatactaggtaaattgctcttgttccttagtttcttcatctgtaaaatagagataaaaataatatccacctcataggattggtgtgagcattaaatgagcatacgtatgtaggccacttaacaacaatgccttcacatactgaacacaaatatacgagctgttgtcttattgggctcatgtttttcctaccactaagccgcatgcatgcaaggaccatgttggttttgttccacattgcatccccaacctggtatacagtgtgcattcaatagttgttgactattattactagtggcatttaacaaatatctgttaaatgagtgaagaaatacccatttactgcaagtgtgtctaatattgatggcataatgggggaaactcaaactctggagtcaaacaggttttaaaaccttattccctcatcctcagttattgacgttttttttttggcaggtgtgtgtgtgggacaacttattgaacttttctgaatttccagcttcgcatatataaaatagagatagtgattcattcttgcaatgtatggatttgagacaattgtgtaagtttatcaataaatagtagctatttttgtataagtattacatataatatccaggccactgctttgcataacccaaaaggggcaccattcatgcagaatacaacataaatggtgtccctggagcagtgcagtataggaaccctgaggggacctacagtatactttatagttcatagattacaaattatccctttatcagagtctctcaaggttggatgtatttgaggtccataagagcaatttaggattaacagtagctgcagaaaccatctgcagtgatattctcattttaaatccgcgggaaagaagacagctataaacttgggacctgggtttaagcattttaaatgccaagttcaccattttctaaaacacaacaaatacccagtgagagagggagaagggaagtaaatgcctctgaataagcaagttaatgtcagtagttgtactgtatgcatattgatgaacaatagaggaaccaatgtccaatcagatgagcaggatatttggcaataacaagttgcctttgaggaaaaatgattttcttggcaagttctttatcagcattacaaagctaaaagctacgcttatcatcacttatactagcataccctgttgtgcaaatgctgtctgtgtttgcatctgctattgttgatgcctggtgcatgaatcaggactccagcccacaagttttcccagaactttcttatggccatcatctttaagtgtctggtgaacagtcatagtttggtacacaaaagggtcaacctgggggatggctagggtttgactcagtcgttacatttcaatagagcaggaaggggaaatggtggcctgtaacctcagggaattttgccagttggtccaccccactctctctctcctgctctgaggaagtggcacagcctagaacagcaccacaggtgagagaaatgcaaaccctaaccagagaagcagactctttgccagtagtaatagttcaggaccaccaccagcttttattaaaatttttaataacactcaagtattggcagaaagaaataatcttgggttaactataactagaatattgactcttcctctgtggaagaatcagccaatcacatttgtttacatcagttcccctgaagaagaaaaatacactgatgttgcagcaagacaaatttaagctagatgtaaataacttcctttagcctgtaatgctaggctaattacatattggaactattttttcagggaagaattgtgtagggtttcagggaagaattctgaagaaaatatagagctgaaatgatcttgcagctcactgaaactgcagggtttagatccacactgatactcgttctattatcactgtaatgaaggctgatggaataagtaaaaatgttttgtattagtatgtttttacacttatttgcaaggcataaataggttaggttttgatcttaatttaattctaacatgtattgtgcacaagctgtgagcagttttcaggagttaggtatctggccatgactgatttttcaggagttaatcatctggtagaagggtcatacacaataggaagatgtgtgtgacaggttgtgatcattactataatcacacagagagctgtagaattttaggctggcagggtggctcacgcctgtaatcccagcactttgggaggccaaggcaggcggatcaagaggtcaggagatggagaccatcctggctaacacggtgaaaccccgtctgtactaaaaatacaaaaaaaaaaaaaagccaggcgtggtggtgggcgcctgtagtcccagctacttgggaggctgaggcaggagaatggcgtgaacccgggaggtggagcttgcagtgagccgagatcgcatcactgcaatccaacctgggcgacagagggagactcagtctcaaaaaaaaaaaaaaaaaaaagtcatgttagatccagaggggtagcaactggggctgggctgtcagtcaactcagtcaactcagtcaactctgctcccccacaggagatgccagtgatgcattttcatggccaacattgtcagtcagcatcattgaattactcctgattatagagacacagctgcaaacgattccccattaaatatgatgtttcttgcaatgtttggaaggtactcctttttagtaagggaaatcccctcttctggcttgctgaaagttttttctttccattttaaaaatcgtgaattcctttttgcaatattgaggtggttatatggtttctcttctctaatctgttaatatggtgatttaatggttagaaattttctaatgtaaattccactcatattgcagaaataaacctaaactgagcatgaggctatattttttatttgcttctatatttggttgctatacagtattatgtttaagatttgttcacatatatttgtgaatgggattggactatttttccttcttgccgatttttatctggtttttaaattaaggatattttagacttatgaaatatttggcaaacaatccttggcaagtaattttttggggaatttgttttggctattttgagtattacccaatatattttaattaagttattcttaatgttttcttaattaaaaaaattacctactctagagatattctttatgtactccagattttgtctatttataccacttttcttttttcctcgatgagtgtcatagatgttcatctatttttttatcttctttgatcttctcttattccttgtttctattaacttctgaagtttattattttcttttttccacttccttatggtttattctttcaatttttctctaacttcttaagttgggtgtttaatttttagcttgctttgcttttttaggataagcattaaaactacaaattttccttgttattcttttgctgcaccccaaattgttgatatttctattgtctaatttctattcaattagaatactttaaagtttctttttggtttttaaaaactaactttttaaattgacaaataaaaattgtgtatatttattgtgcacagcatatggctttgaaatatatgtacattgtggaatggctaaatttagcttattaatgtatgcattatctcacatacttatcattttttgtggtgagagctatgtgacttttgaacttatgagttatttaaatatttttaaattattaagcatattgggattttaagtaatttacctttttattattaacttataacaagtagaacagttaacctgtatgattctacatcattgaaatttattgacatttgcttcatagtctattatatggtctacttttgttcatgttacatctgtagtagaattggctaatagttgagtaaagtacacatatgtctatgaaatcaagtgtaatccagagaaaaagagaaatttactgaatatattgttctaggtgctattatatgttgtcatgtttaatcctcaccacaattgtatgaggcagccataattaattccactttacacatgaggagcctgagggttaaaaaaaaagctagctctactatttgtaaagaatgaagcaaagatacaaatgaaggcccacatatcctataactagatatttaagcattttaattcaagctttaaaactgctaaataaaatgtgctccaatttctatattgacagacataccttcctaatgagctggggttcgaatttagaaatctttgatgcttcagagtccacactgaaatgtggaggcacatagtgagttggtccccagccttcagtccacccaccttctctttactaaatcacctttcacatacatgtatgaacaccccagcctccaagtccaaaccctaaacaaaatgggacacccttgtgcatacacagagacacagcccatcctcaggaaaacctggaaaagtccatacaagttctggaagcaagcttgggacggtttcagtagtgtggtctataagggaggcctcagaagacaggttttcttaattctgtgaacttctcccacagtagaaagggtgctggaggagggtcagagtgaggacttctaaagcatgggtcctgagtaggggccactcttgcccaagtctaagaagggtactagaatagcacactactactagatactagaacccagatacaagcacaggtcttctgaaattaataataataataactattaccattattataccagtagctgtcatttatttagtgcttattatttgccagtcactgttctaaattctttacatgtattatacaactgccatataactgccatatgagggatgtaccctcattgtcaccattttaccgatgagaaaactggcataaaacgtttaagtaacttgtccaagttacagagcttagtgaagccacaatgttgctcaatttgctctcaaacttcaaagggatgggaaggacacctaagtcatagagtctttaagaatcagagctagaaggaatcttagatgttatctagtcagcctcctcccattacagtccaagagaagatggccctgagttacttgtagctatttttgcatgtgaattgcaagtgaatatacattctactgaagataaaagatatttaaagatatcgctggatataggaacagtggttttaaatctctaggctttaacttttctcagaacaagaaatcctttttggttttaatctatatgcacatctgtatttttctcaattatcgggtagtaaaatataacttttcttctgtaatattttttaactttaatgagtgttcctcataatagaaaagtttggaaaccattgctatgggtatatactttctaaagggatagtaatttctctagaatattcatttaatgctccagaagtaattagcacaattgtgcaagtctgtgcatcatcaactatacattctgcctgtttactccaaatccacatgaaactgattatacagtcaaaggcgagcccagtggagaggcatttttggagacttcctggtacattgagacagggtcggccagtctgcgttagggtcttggtcaaaactgcatttctgaaactaaactcagattgctttcttttaaggggtcagaactgattcaaatctacatttttaaaagccttagatgtggggcttttcctattcccagtctccgctattggtctttgtgaatccacaggcaatttggccacatccttgactctctcttatattaagaattaaacagctaagttcatgcagaggaaatataacaaaggagggactttcctacaagatctttgaaaaatggaacatttgcataagtcatatttagccagaactgttgttttatattttcctttctgaatactttgttacacctcctcccagccaaccccccccctccctgaccccaactagtcagagaccaaagccttcacaatggtttacacttgaaccttcctggccccaccctcatcatcacgcctgaataattacattcactgactggtctcccctgcttccgtttatctccactcctaaaccctctgacaccttaatcttcccagaataccattgtgatcctgttccactcttgctcaagttttcccagaaactagagtacaaactttataagctttagagttgaaagccactctatctctttttcatccccaggtctctgccaaggcagtataacctgtccaacatctctaacttcaatacctttgtcttagatactagactctcctcctggtttctaattaaacctgatctaggatctaattttgcctctgaattctgttgccctttgccaagtgatctcttcctcctctgagccgcagcatctctgagcttgcacacttagcatagccatagcacacacagccttagcttgcagttcagggtgtttaccttccctccccttccagatgctggatccccagggataggaactctgcccttatgtgtccatagcccctggtagtatgtcttgcagtcgtacattttcagcaaatgtttaattggttaattgaagacaactgtcccatgccttaagcctctctttttgctaaacatgcctgtgtcctttgtcattgaacaactattttgatctattttcttcctgacataggggtcagttccgaggatgctgaaatcaagagacatagcttattctctcaaaattgctttcaagagtgattttgttgtgaattgagaactggctgcctacttttggactacccacttcagcaagagtgtttgaaaccaaatctattctaagtaattttttattcccttttctctatggcattagacacacagctcttttaaactacctttcgttatctattaaacagacattcagtaactctatagacactgtctagctatatgaacttagacaaactaatatctctgagcttcagtttcttaaaatttaaaatgaggacaataccatctatggccggggattaaatgctatgaggaatgtaaaccagatgtcaggtaccatctctctaaaatccagataaaatgaattaaaaatactggccgcaaaccctctctaagagttctcaaaattctcagagagcttaattttcatgctcaccatagcaccgattttcttctaaatattttgtttctaccaaaatattttgtcccaattttgccttttatggctatttcttcatatccactttcccaaactaaagaagcagccccttcaccttaaactcctccttcaaagcaacctaaatacaggtctgggtttgtattcctagtgggatgttacagaggttagtgtgatgcagaggaggagtcatgctgtttaaatccatactagtccccagaggccaggctgcttctgccacccctacccctcccgccacagagctcttcagcttctcacatttctagttcttctctctctactttcattaccttctctctttttttttttcttctcatgtgctcacgggagcagagaaaattaactcctctaagttttcttaacacagagtgccttaattacatattactattgtttgagttcctgccaacactacgtctgtagggtcacacctgctatattagaggcttatcaaaaaaagatagctttctcctaaaaagggatttggatgcctactaagataactggatgccaagataagtttaacctaacaaactttattattattattattattattattagagataggtacttattctgtcacccagactgcagtgcagggatgcaataatagctcactgcagcctcaaagtcctgagttcatgcaatccttctgcttcagctccctgagtagctaggactacaggcatatgctactctgcccagctacttttaaaaaaataattagggatggggtcttgttgtattgcccaggctcgtctcaaacttctggtttcaagcaatcctcctgccttttacctccctaattgttggagttacaggcatgagccacagcactcaaccaagatttaaaaacttttaaaagaaatcacattacttactgttatcatcattatggttactaccagtgttaaaacaattggtattgaaaacaccactaccagatcaagcttcaaaccaagatgtcaagtaaatattattgtcagacctctgagcccaagcctgcaggtatacacccagatggcctgaagcaagtgaagaatcacaaaagaactgaaaatggccggttcctgccttaactgatgacattccaccattgtgatttgttcctgccccaccttgactgagggattaaccttgtgaaattccttcccctggctcagaagctccccgactgagtaccttgtgacccccacccctgcccacaagtgaaaaaccccctttgactgtaattttccactacccacccaaatcctataaaacagcctcacccctatctcccttcgctgactctcttttcagactcaacctgcctgcacctaggtgattcaaaagctttattgctcacacaaagcctgtttggtggtctcttcacacagaccatgtgacatttggtgccgtaactcagatcggggaacctcccttgggagatcagtcccctgtcatcctgctctttgctccatgagaaagatccacctatgacctctggtcctcagaccaaccagcccaaggaacatctcaccaattttaaattgggtaagtggcctctttttactctcttctccagcctctctcactatccctcaacatctttctcctttcaatcttggcaccacgcttcaatctctcccttcccttaatttcagttcctttctttttctggtagagacagaggaaacgtgttctatctgtgaacccaaaactccagcactggtcatggacttggaaagacagtcttcccttgatgtttaatcactgcagggatgcctgcctgattattcacccacatttcagagctgtctgatcactgcagggacgcctgcctggatccttcaccttagtggcaagtaccactttgcctgggtggcaagcaccacctctcctggggggcaagcaccacctctcctggggggcaagtaccccccaaccccttctctccatgtctccaccctctcttctctgggcttgcctccttcactatgggccaccttccaccctccattcctcccttttctcccttagcctgtgttctcaagaacttaaaacctcttcaactcacgtctgacctaaaacctaaatgccttactttcttctgcaataccgcttgaccccaatacaaactcaacaatggttccaaatagcctgaaaacggcactttcaatttctccatcccacaagatctaaataattcttgtcgtaaaatggacaaatggtctgaggtgcctgacatctgggcattcttttacacgtcggtccctccctagtctctgttcccaatgcaactcatcccaaatcctccttctttccctcctgcctgtcccctcagtcccaaccccaagtgtcgctgagtctttccaatcttccttttctactgacccatctgacctctcccctcttccccagactgctcctcctcaggtcgctccccgccaggctgaatcaggctccaattcttcctcagcgtccgctcctccaccctataatccttctatcacctcccctcctcacacctggtccagcttacagtttcattctgtgactagccctcccccacctgcccaacaatttcctcttaaagaggtggctggagctaaaggcatagtcaaggttaatgctcctttttctttatccaacctctcccatctcagttagtatttaggctttttttcatcaaatatgaatacctagcccactccatggctcatttggcagcaactcctagacattttacagccttggacccagaggggccagaaggtcatcttattctcaatatgcattttattacccaatccactcccaacattagaaaaagctccaaaagttagactccggccctcaaaccccacaacaggacttaattaaccttgccttcaaagcgtacaataatagagtagaggcagccaagtagcaacatatttctgagttgcaattccttgcctccactgtgagagaaaccccagccacatctccagtacacaagaacttcaaaatgcctaagccacagtggtcaagcattcctacaggacctcctccatcaggatcttgcttcaagtgccagaaatctggccactgggccaaggaatgccctcagcctgggattcctcctaagccatgttccatctgtgtgggaccccactggaaatcggactgtccaacttgcccagcacccactcccagagcccctggaactctggcccaaggctctctgactgactccttcccagatcttcttggcttagtggctgaagactgatgctgcctgatcgcctcagaagcctcctggaccatcacagatgcttttggtaactcttacagtggagggtaagtccgtccccttcttaatcaatgcagaggctacccactccacattaccttctcttcaaggtcctgtttcccttgtcttcataaatgttgtgggtattgatggccaggcttctaaaccccttaaaactccccaactctggtgccgatttaaacaacattcttttatacacttctttttagttatccccacctgcccagttcccttattaggctgagacattttaaccaaattatttgcttccctgactattcctggactacagccacatctcattgctgcccttcttcccaacccaaaagtggcaactcctttgccacttcctctcatatccccctaccttaacccacaggtatgggacacctctactccctccctggcaacaaatcacaccctcattactatcccattaaaacctaatcacccttacctgggtcaacgccagtatcccatcccacaacaggctttaaagggattaaagcctgttatcacttgcctgttacaacatgtccttttaaagcctgtaaactctccttacaattcccccattttacctgtccaaaaactggacatgccttacaggttagttcaggatctgtgccttatcaaccaaattgtcttgcctatccacgccatggtgccaaacccatatactctcctatcctcaatacctccctccaaaacccctccataacccttattctgttctggatctcaaaacatgctttctttactattcatttgcacccttcatcccagcctctcttcactttcacttggactgaccctgacacccatcagcctcagcaacttacctgggctgtactgccgcaaggcttcatggacagcccccattacctcagtcaacccaaatttcttcttcatccattacctatccaggcatagttcttcatgaaaacacacgtgctctccctgctgatcatgtccagctaatctccccaaccccaggactggcaaattgactttactcacatgccccaaatcaggacactaaagtacctcttggtctgggtagacactttcactggataggtagatgcctttcccacagggcctaagaaggccaccgtggtcatttcttcccttctgtcagacataattccttggtttggccttcccacctctatacagtctgataatggacaagcctttactagtcaaagcacgcaagcagtttctcaggctcttggtattcagtgaaaccttcataccccttaccgtcctcaatccttaggaaaggtagaactgattaatggtcttttaaaaacacacctcaccaagctcagcctccaacttaaaaaggactggacagtacttttaccacttgccattctcagaattcgggcctgtcctcgaaatgctacaaggtacagcccatttaagattctgtatggacgctcctttttattaggccccagtctcattccagacaccagcccaacttgaactgtgccccaaaaacttgtcatccctacaatcttctgtctagtcatactcctattcaccattctcaactacttgtaaatgccctgcccttttttacagtgctgatttatacttttcctccaaaccatcataactgatatctcctggttttacctcaaaccgccacccttaagtctctcttaaagtggatagaagatcttcagtgacaaggtacactccaatactttcaccctaataaagccctattctttacttttatattcactcttattcttgttcccattcttatgccactctctacctctccccagctatctccaccacactatcaatctcactcactctctcctagccatttctaatccttctttaacaaacaattgctggctttacaatttctctttcctccaaaatcaccgagtcctcaatttactcactgctaaaaaaggggactctgcatatttttaaatgaagagtgttgtttttacctaaatcaatctggcctggtatatgacaacataaaaaaaactcaaggatagagccaaaaaccttgccaaccaagcaagtaattatgctgaacccccttgggcactctaattagatgtcctgggttctcccgattcttaatcctttaatacctgtttttctccttctcttatgcagaccttgtgtcttccatttagtttctcaattcatacaaaaccgtatccaggccatcaccaatcattctatacgacaaatgttttaagggaggagaccacccctcatattgtcttatgcccaatttctgcctccaaagaaagaagtaaaaatgaaaaggcagaaatgaaatccacaggcagacagcctgatgccacaccctgggcctggtggttaagatcaacccctgacctaatcagttatgttatctatagattacagacattgtatggaaaagcactgtgaaaatccctgtcttgttctgttcctctaattaccagtacacgcagcccctagtcatgtaccccctgcttgctccccctgcttgctcaatcagtcatgaccctctcacgcagacccccttagagttgtaagcccttaagaggaaaaggaattgttcactcggagagctcggtttttgagacatgagtcttgccaatgctcccagctgaataaagcccttccttctttaactcagtgtctgaggggttttgtctgtgtcttgtcctgctacagtttcatctaacaaccccataatatcaccccttaccacaaaatcttccttcagcttaatctctcccactctaggttctcacgccacccctaatcctgctcgaagcagccctgagaaacatcgcccgttatctctccacaccacccccaaaaattttcactgccccaacactttaccactatttcgttttatttttcttattaatataagaagatagaaatgtcaggcctctgagcccaagcctgcacgtatacatccacatggcctgaagcaagtgaagaatcacaaaagaagtgaaaatggctggttcctgccttaactgatgatattccaccattgtgatttgttcctgcgccaccttgactgagggattaaccttgtgaaattccttcccctggctcagaagctcccccactgagcaccttgtgacccccacccctacccacaagtgaaaaaccccctttgactgtaattttccactacccacccaaatcctataaaacagccccaccccatctccctttgctgactctatttttggactcagcccacctgcacccaggtgattcaaaagcttcattgctcacacaaagcctgtttggtggtctcttcacaccgacacgcgtgataattattatattacttttaactaaaaccctttcagagtctcgcagggaaggctgtatatatctcataaaatgttggggcccactggatcagacaaggccacaaaggccaaagggaagtaaagatctcattatttctcctaataatttccctgtcctttgtcataaatggtgggtaggctgttatggtgatggcagattttctttccataaaatgtccataataggacatttgaacagaagggaaaaatcaaattgctgaagttgaaagagggcaatgcaaagaactttggagaaagaactgtacagagaagtcaactggcagatgggaggaagtttaaggggaaaaatatagatgtctaaagaatacatttattcattttccacagtgcaatttggacaagaagcctctttcttgcttctttctattctcattaaatcattagagctcaagcaatccttctgcctcagcttcccgactagctaggactacaggtatgtgctactatgcccagctaattttttaaaaattagattttaatttggtgaactatttctgtaggaaactacaataatacagcccaggcacattgatcttgggtgaacaaatcagaaggaatgaataattctgtgttcctgggactctgacaatttcatgaacttggtactctgagtaaagcataggaggagttatttcataaaatgtggagcacaatcatgtgacaaagataatgggatccccatttcataaataaatctgaagttcagagagagtaacaactggccagggtcacatcacggagacagaggcagggttcccactgatgcctctgactccctgtcccaggcccttcctcctcccgcaagcagaagtgcagggggcagagctgaccctgtgcagtgaaaatctgagggctgagttcctattggaacacaagtgaaagacttcctggcttctaatctcaggataaggactcagagctccatctgttccagccttaggataagaaccagaatcttacaccatgaaagcatgaaaggtaagatttgagtgaggaaaaaaaaaaaaaaagtctgtgtttcagattcagttcacaaagcagtttcatacttaaggtaccatcacaataaccctgtggggtaagcaaggcaaatttcattcttgttttatgggcataggaagtaagtctcagggaggttaagaccaaggtttctggagaattttatattatgaatcttgatttatgggattactattatgtaattcctaagatcatataggaatcctagagcttgaatatagaactttatttttaaatctatatacatcataattacaaggagtagtgtccatttgggttccttggccctgatgtgttagtggaataaacatttttgtcagggttgccatgtgtgtctgtgcacgtgtgcactgtacacctccaggggatgtaccctaaaccacatgaatgtgatttgcacatccaagatttacagtgtactatagggagaatcttttgcaacagcttttgctataatacagaatctgagatgtctttgagaaagaaaagtgtaatcattaccaaaaaattattctcataatgtgtgcaaatttgtatgaaatctatattggccatgggacaaggaggtatttccagctagcttctgaaagggctctattctctcataagaattcagctgttgacattaggtgatatctgcccaggtcatcagatgccatagagaaagagggtttgctgaaacttatatcagcagtgcactgtatgctctttctgatttatttgaacattcatttattgagtgtcaagtaatgcactagatactccagggatctgacacaaactctgccctgaaggagcatgtaatctcactggggagaaaacaaaacatatgataatttcaaaataacaaactaggcaaactagttaacacttaaaaagcaggctttattcaaatgcaaaattgcatgttacagggtaacctttcagtaagaagccaggaagaggagctcatcatgggttggattagtaaaggactagttataaaagaagtggtggggttgagggaggcctgagatgaaatttaaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttactaataatatcgtgataaaagaaacattgactataagaaataggaatgggtctcataaaaggaaacagcaaaacccccaaactaaaaaacagcgcaggctatttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgagcaggaccccattacttcactggagttagaaagaaaggagagcgtagactttttgaactttctataagagtgtacctccacagtatacagaagacgacgtgaaatttgatctgcaagaaaactgagtccatattcacatatgtatcaaatttgcacttcatttagaagtgtctgtcatcaagtacagcactgaattgaaactgaaaacaagagtcaagaaagagcaaagtcagccatctttatattccacatgaatcctttccctttatggtcttatttgtttctcctcagaaaagacaaaaagctgagctgtataaacacctgtgggctgggggttgagggataaatgaggggcgaaatggaagctgaaggaactgttggtcaggtagaaatcttcccagatgcactgaaggaaacacacttcatgtttgacgtaggaggtgccaccacacaaaacgtttcatggaaggatttaaaggatctcatgatttttagtattccaagaattttctttcaccaagggcgatttaatatgggtcattcatactgaaagaaaaacaaaagataataagagtttaaaaattgcaaaacttggagtgttagtagtaaaggtaaatattcattagagatgagaagaggagcaaggaaatgctttcagctggaaatctcagacaagaggccaggctttaggaacctctgaagatgaacaaatgtaagcaaaccctagtagcagcacttctcagattttcatgtgcttaccactcagagatggtgttaaaatgcagactctgattcagtaggtctgagtggagcctgagattctgcacccctaacaagctctttagtgatgcttatgccactggcgcacagaccccacttggagaaatttttgtggtgcatacggtctttgtctccagatctaatgagtctgaaggacagtgtagattgattttttaaatttatgtttattttaatttaatttaatttaatttatttatttatttatttttgagatggagtctcactctgttgcccagtccggagtgcagtggcacggaggcagctcatgcaaccacggcctcctgggttcaagcgattcttccgcctcaacttcctgagtagctgggaatacaggcacgtgccagcacacccagctaatttttgtatttttagtagagatggggtttcaccacattggccaagctaatctcaaactcctgacctcatgatccacctgccacggcctccgaaagtgctgggattacaggcgtgagccaccgagcccagctgtagattgattttgagcagtggaaagtcaaggaattagaaggcatgcttaaatggaaagtgaaattggagaaaatttaaactcatgaaatagtggtggttataaactcgtgataaattatatcctgggatataatttaatgagatggtaacacatttagtttaaagaaataagtgacactttttttgtgtgacacaactgtcttattcttggaaaggacaaggagagaatgaaatatggtatgtcttcacagcacctttcaaagggagaaccagattctgaggagctggtctcatgatgaactgtcagggtaaaccacagttcagcagctgcaaatgtgcttgccaaaatagagacaaaaaaatgtttctgaaaacaaaatttcacatatgccctcctctgaggttggcatcatatcttcctgtgtatcttgggtgtagcttctatcctgccagaatttagacagtagaaaccaaatgaggtgataaacagagtcattttgcagaagagtcaaaataacccagcaagaaatgaaaccacaaatgcccaaggagtcattcattcaccattcaaaagctaatagaaatgaacacaaactactatgaaaattcacccaagaacttaaaaaaaaaaaaaaaggctcatggtgtttagtgtgatagtattcattttacctttgacttgttctaaaaacacaccatacttctaccccacccttcctcagtgccgtcacacaatggtttcagtgtgaaaaaaaaaaccacgttactggaaaaggagggtgcctgggacttgccactctaagctggtagtcaagggtcttgagttctaaaagcatacgcgttaagagcatgattcctggatccaaatgagtatggatctcagcattgccatttattgtgacctcaggctattttatttctctgtgcctgtttctttatcagtaatgaagatgttcatagacccttctcccacagacttaaaggcatatttcatgatttaagacatgtaaaccattcataacagtatacaacatggaattaatatttgataaaggtttatgattattgtaactaactctgtcacttgctcaaggcctatagaaaacttacttaattagttcaactacaaaaagagtttgaatgtgatatccaccaagatcatattcagacctagaattctgtgattcttatgaattaatacagccttggtcaataaatgagagctgggcaaataattcttctttgctaggcctttctagaccatctggtgaagcattcaagacttatgttattggggccagccttcctttccaacttcaactccacaactcctcaataagccatgggctcaagaaagttctgctcagtggcccctgaaaaatgctttcatagtctcactaccataccactgcttacacaatttccttcctacagactgccttcctttcctgcttttctccatatacctaaatcctatctattcttcataagcaaccttctttataacattttctataaccaccaagccaaatgaccttttccttcttaaatatagcacccattggccattaccatgctctgccttgtatttttctgatttttttctttctatattcctgtcttaactccccagctaggtaataattttcctgaaatcagggaccaggctgactcctcttgctgtctcaagaaagcttagcagtttccaacacaaaaatgttcaataaacaactattaattgactgattataaaaaatcagtgaaccattaaacttaatatagcaatttgcttagcatggtaattagctttttgctaatattcttccagccagtctctcctcctgtgcctcaaggacatcttaaaaaaaaaaaatctagttgatctgcttccatctagtggcaattaaaacaggtggttccggtagccagaaaacagctctgggtagattgtgccagaaaatactttcactcagtaggtgcgagtttgaaagaaatcttcacatctgtgggtttcctgccacagacatagggagaccagcccagagaaagaagcctttcctcactagactccatttgcactagtaaagagaagacagagtaattaaaaagaataaaaagaacctccactgatcgtacatcctcatccagttacccctgccccacttctccttcacagccaaacattttaaaagagatgactgcttgttctgtctctactttctcatcctcagtaatgctcaatgcttggccgtctgacctctgtcttgatgtctgcactgcaaatagtctccccactgacacccttgttgcatccaggggatacttactggttctcttggcaatgtttgaaaccgttcccctttctttgtttccttggcattcattaccccacactctttctcctcttccttctccctgcctggcaacatcttttcatttctctttcccttaggtgacttattagataatgatgttcctctggctcccatactctctcccaggtcctcttccattcttaaagcactcacaccctccctggatgatagtacccactcctgagatggcagttacctcctgaaatgtgagggacccaaatccacttctcctgccatagcctctgtgctttggataggtccaatgagccacagtgaatgatgtgcatacacccaaagctcagtacaaaactgaacccatgatctttacctccaaaacctctcattcttttatgttcccttctcagaagtaaacaggactaccatccgccagtttccaggtgagaaagatgataatttgattcttctctctcacttttagccaattaacagacacattcagttaatatcacctcctcttatttcatgaacccattcttactactagttccctagacaggcgccatcggttttaatctaataactgcaaatgcctccaaaacaagtctctttgaatccaggctcacctgtctcccacacttgccatactgctctgcagggtgaccttataagatgccagaggtaaggctactcactgtttaaacccctttagtgatatcccaaaagacctcaagataaagcccatatcacatggcttatacattagtttatgatctggcttctggtgcctcatttttccccactttttcctttgcattctaagcaatggcccatactaagtttgtgattggtaggatggttgcccaaaccagcatccaatcccttcagaaatcatctcacttcatttctagcattttaaaggaagctcagttgtccagctgggtactgaatatgtcaccaaagtcctcctttcatagtttattttacttaaactctccttcctaaaattccagagcaagtcactaaaccctagatactgagaaatatttttccatcttcatttctgccaggtgggccatcaactttcacatgtctgcatctcctcccactgtgctatttctccagtagaagaaatttgagcttcaagaccaaactgaaaaatacttgcctccttggggaagctgtaggtagaattcatgctccctatctttcccacatttctgaaggacaatgcctgttagagcaattgaatgcaaatagtcaattgaataagcatttattcatttctcaataagtgcttgttcaattgaatatttcttaaataatatatttaagaacaagaagaacacaccacaatgtttttaaccctcagaaaaaattctgaggtaatcagaaaaatctccctttacataaactgcccttttctaatagggattacttgttcgttcattcattcattcagctccactagcaccaaaaagcacagctctgaaaggaagctagtagatttatcaccttatctggtcatttggatgaggaccccaggtaaataaactactatggggttaatgtgtctagctagagcaggaagtaacttaaggaagtagagaatgaatcagcagatgtggaaactcctcgccactaataaaacttaccttctcttggatttcttgcctgaaaatagaaaatagagaaaaggcattagcaaaaattagacaatttaaagtttttcaagtaagggagaaggaagactcccactctcaaaactgtcttttgaagtatattaggtatttgttaggtggaccctatctgtgtcaaaggagatttgaggaactggcttaataaacagtggtagacactaatacagaacagacatgttgatgcagatgcctcctgaggttccattccattctccgtgctactcaagaagacagaattgctaaattgcctggtggcaagacccaatatgtccattcaagtgtttatcccttcccaatctgccatctcatcctacctgcagattcttcccttgagggacagctgctaatactgtaaaactatgtgccattacagctcacagcatcatctctatgagaatccacaagagaatttcactttggtcttgttggtaggaattgtgcagcctcatctgagtaactaatgtgtttttatcttacaaacacaaggaatatcacatggttctcctttgactggctgtaaggaaactcagagctagatctgagaccctctcctaccaagtatataaaactttgtgacatacatttttgtgccataacttcaaccttggttccaaatgatttttgtaccctaagtttaaatttggctttcttttttttttttttgtactcaataaaacatcaagctcatttattattgcgaagagcgaaacaacaaagcttccacagcgtggaaggggacccgagtgggttgcccaaattggcttctttttcttactttttaattaattttaatttgctatactgaacacattttgtactgttctcacattctttttgaaaaaagcagaatataaataagtagataacttaaaaaaaactctttgagcagaaagaatcatttgggaggcaatatatttcagtggctgtaaagtggcattctagaatcatcctacccaggtgaaagccctattttgccacctgtagtgtagtgtgtatttgaacagctactttcttttctaaactacaatttcttcatctgttaaagaggcataataattgtatcatcctcattgggttgataaaataaaatatttccaagtatttagttcaggtcctagcacgtagacagtgttgcattactgttttaatcctttaaagtattaaagactactatttgaaatcttttcttctaaaattcagcctgctgatgaccaagtgcacttgagcagggggaatcaaatctgaattaatttcagattctggttagcttcacataaatattttttttagggatgatgaacctaacagcaatagatgagtaagaatctgttcctactgagagagtttcattttgaagaaaaaggaactaagggggcatgtgttcagtttcatgccctggtctaaccctgtgtgttggttctggtgggaaattcttccaaccgaggaaaaaaccagttcacaaatctgaagaccagtgattttagaagatgtatctggactggagtctaatctctgactctgggtcctgctgatatggtatttttgagatttggcctaaaacatcattgccctggtttccttatttaccaaacagggccaatggtagtgactaatcagaaaatgataatgcctggtgcacaaaatgtgtctagatgagcccatgcacaaggacacatgtttctggaactgttccttattcctttcctaaaagaaaggagggaaagtctccatactaagactactagggcaggggacaaagtgctagagtcagaagattcatctgaggacagaagaataggggtgaaggctctagtcacttcattggctaccatgctctaaatagttacctgtgccctttttctaactattagaacccaaaaagcctataaattctctctctctctctctctctctctgtgtatatatatacatatacacacacacatagacacacacacacacctaaacacacacatagagatttatgactttttacttttatccttgtaaatgccattaactatattttgtcttagatttagcctgggaatgtagccattatttctaccattgcctccataggaaaaatactcttcatgttttaaaggaccaacctacaactaaaatctttggaaagcagaatcatttgtaagttggtgaaaatggaagatgttgttttataaatgaagactttttttttttttttttttgagacagggcctcactctgttgtggagtgcagtggtgctgtcatggcttactgcagccttgacctcctgggttcaagtgatcctcccacctcagtctcctgggtagctgggactacatgtgcatgctaccatgcctgactaattttttgtatttttgtagagatgtggtttcgccatgttgcccaggctggtcttgaactcgtgggctcaagtaatcctcctgcctcagcctccaaaagtgctgggattagaggtgacagccaaggtgcctggcccacagatgaagactatttaatgttatcttaaagataccctaagcttcctaccaagccagtgatcttttggggcttctgttttctttgttggcataactgtaactagcctaactgcccgttatctgtttcctgtttgccccacactgattcccacagcagttttcaagttatcggtttgagatcttgtacagaaatgactccaaggtaaaaaatttaaaaacaacccctctaatttttttacccttgcttataaaacagccttagccagctaacccctcactacatgcaaatgagtttgattctattcttttgattctacaaacacttattaaaagattttagaattcggaaataaatagcttccttattaaggtgacttacagccccaaagtccttaaaattatttagacaatagccaccttatcccagggggcagtgtgtaataacccaccctgttctctatccgtcagttctgccatcatcgcccaaggtaggaagaaagacaggacaaccggggtcaagatttgaagtctcaatggaaagaataatcagtggttggagaaaactgtcattcttcttttgccttaatgcagtacttgatacttatacttagtactgtatagtacttagtactgtataatactataagatagtgagattcaatcagcacagaatttctaatagcaagggcagagacattttaactgctcagtgctctcaggttatacatagctaatgaagttcttgcatatcaacaatccccacccccctcacacactttgtctttctggattggttagaaaacttacctagcgcccactattctcaaatttaaatgaaagataagatcagagtggcacgcaattagggactgataaataatatttttgtaattgccagtgtaaatggacagggggcaacctttacataccatattcagtgaacagaatacgtactaactaatttgatggaaggaaaattaaaatgacaatcaactgagcccacagaaaggcaacacagagcagttggttagcaattgtttcgagatcatccctgaacttgaaacaggtatatcttttttttttttttttttgagacagagtctcactctgtcaccaggctggagtgcaatggtgcggtctcagctcactgcaacctccgcctcccgggttcaagtgattcttctgtctcagcctcccgagtagctgggattacaggtgcccgccaccacgcctggctaatttttgtatttttagtagagacagggtttcaccatgttggccaggctggtcttgaactgctgagctcatgatccgcccgcctcggcctcccaaagtgctgggattacaggcatgagccaccacacctggccaaaacaggtatatcttaaaagctgcccaatgtccatgaatgttacagccttgaatggttcttccaggtgagtttggccaaatgtggcaccatacacccaaggcctgctgcaggctagtgggttgctcacactttaaagctgagacacactcatgccttaaggtaaagggagtgataatctgggcagcagatgttaacttctcaaggcagtcctccttctcttttcctctccagtgacggatggttggaaagcatatatggtgcatttggttagagctgtggccttggtgaatagatacttgggagaatacatgggaatttctcccagggttaatgcaatgcccatgtgttgggaaccaggtgactcttgaagaggtcaggtatttgggagcagtgccttgaaaccttagtggacattagacccacttcctagtggaattgtagcattgaaatccaaggcatgtaggctcttagaggacagagatagtgtgtcattttttcagaattaattaagagcaggccaggcgtggtggctcacacctgtaatccaagccctttgggaggccaaggcaggcagatcacgaggtcaggagatcgagaccactctggctaacacagtgaaaccccgtgtctactaaaaatacaaaaaattagctgggcatggtggcacgctcctgtagtcccagctacttgggaggctgaggtgggagaatagcttgaacccagaaggcggaggttgcagtgagctgaaattgcaccactgcactctagcctggtgacagagtgaggctctgtctcaaaaaaaaaaaagtattaaagaattacataagagcaaagaaccattagaatatctcacttagttgttatcagcctagcaagctgccttgaaggtaatagacatttttaaaagtttatcagatgaaaagcgaaaatcagccaacctgttttaatgaaggtgtgtcctgggctgatttacatgtctccagggactgatggctctagaatgtaaagcttggcatcctgcttgtgttgaatctatcacatttaatttcctgtgggtttcttttttttttctttttcactttaaagttgtgttcttttcatgtgaagttaaactcacatacctttttttaatctccttgccagccaaatgataaatgccaacccagagaatgcagtaaccatgactgccactggaatgaagagggggttataatcaccctccttaatcattgagaaacttttgtccaattctgaaagagaaatcagtaaggcacatagcatgagaccaccagcattatttccttagtctatctcatgatatttgacttttttcctccttacatctcccagtagtagcccatttgatgccatttgacagatgaggaaactggcatgggaaggcccctgatgagtctacagcataggcaaagactggaccagccttgctagtctaatgcctacagaatctcaatgcccagatttgtggttcatagagttcctgaaaatgcacctaaaaatgttggcaagaatggtcatcgttgtatttagctccatggacttgttcaatgactggaactctgaaacacagagaagagctaaaagcctaatacaacttcaggaaaaataaaagccaatgatctgaactggataattcaccagtcaaaggaaatcattaatgcttttactttaaagcagttgtgcaaaaataagcacttgatttttacatgccaaggacctgcactaatttctttccaatgcagtagttaccacttccctctacttccttcacgaataagtaaaagggcatgtttagagatactcttgtaagtgtaaactaagttcatttgggagcctctatttgaaaatactggtataaaaaaaaatctgtctcctgatactaacatttgaaggaatctacttttttacatattggcagagggtctgattctatccttagttcttcccattactttgatgaaccttttcaaggtgatttgatccccacacccaaatatatgattgagagaaggctcaagttcccaggagctccagacagaaggtacctgttggcttgatgaagatgaggaggaaatgaacactagctaggccttaaagggaaatgtctctgataggcctaatacacagtcctctgctaaaggcctccctgcctctctctgctcatccactctactccctggccctgggcacgcagcacacagagatcagcatttctgacagcttctgtagatcctaccatttaaagacttttgtcatccatgcagatagtctcaggagcagacacaggtagctattctttcacatgctagcttaacatgcatttgctttagcacctattgccaggcactgtgtcaggtggagggtatacaaagatgaacaagacatgattcttctcatatacagatagattttggaggcattagcttagtgatgattcaggagtatccattatttggggaagtaggtggtcattagtgaccttttacaggcatttcaatgggctaacagagatgttagattgtagtggaatagaagaatgggtaaaaagtaaatcagtgagttcagattttaggagttaagatggcaagaggtgagaacaaaaaaaggaaatgattgtcattaaaggaggaggaaagaccagccaaagattttacagtgagttaagcatacaaatttatttctaggccacatattcttagcaaaacaacatgtaaatgtttatgtatgtctttcctcatatctgctcatccatcagctccatcgttaagatttcagttttccaggacaaacttactcactttgacatattggactaggatttgaccagattccagatgattcacaaatggttttcttcttcccaattaactcagttccttctgagcagatgaaggtacatgcagaggtaaagctgaagctggccaggggatggctacagttcatgatccccaaatctggtgctgatagaggctcacactgaatcacttcaatgaaaaagaaaaaaaaaaaaaagacaaaacagtatttctgagtagagaccctcccttgagcaaaggatttttagccaaagctgcctgactacattacttgtgatattgcttccaggctttattttcttgagaatgatggtgggtggtgaatgagagatgaaggcaaggaagcattgaaagctgtggggagaggagtagctactccaggctgctgccctagctaaggtgaccctccccttctgctggaagtaccatgccatatggcctctgcatcaagggctcttatgggatattctcagagaatctctgccgtttcatctgttctgatatctacccaagcattttgaaaaacatcccaattcactgaagcaagtccaacttccgtaaattccagtaggtgggttgacagttttataatttcaataagggattttgatagcacttctaagaattaaactacttaaactaatgcatcaggagcatacttgtagaaaagttaaccaaaacttcgtaagttcagatgacattggttttctcccatatggagataaggttggcagttaaaaatgaaaaaaaaaaaaaaacctaccttatttcaaacttgaaaagatcaagagattgtgtttttgtttttcagttgttattctcctaaaagtttatgcatgaggaaaagtaaaagtgattttaagaataagccaaataaaacaaccaagaaagacctccactaccctgggaaggaaactggttggtattaagtaggacaccacataaaacaggtgttattgagaggagaagaaccaaaatgtaactgaggttcaacaagacattatttatgcaatggcaatgagaaaaataaaaaacacagtataaccatgctgtattgctataagtcatgttacacactgggagatggcttcaggggtatttggtttttactttttgtttgggaggtttttcaaaaaaatttagttagaataagtcctttgagaaacatcacagtaggttaaacaaagttaggttaaattaggctcctaagtttgacttctcagcaaacttctactgaatgttctgactgtaagcccaggattgcatgacaaaacctctagtctgaagttactcaccttgacaggttggttctggagatgaccagtttccaaatggtccacaggtggtttcttcaatcccagttaagtttgttccttcagagcagctgaaggcacactgtgagctgaagctgaagtttcccaaagggtgagtacagtccatggtacccagctctggggcctccaaaggctcacactgaatcacttcaatagggaaagaaacagtatggggaagagttaagaggaactgacgcctggatttgaatcctagccctgccacttgataaccatgtgcctttaaacaaggttacttgaaccctccaacttcagtttcttcatctatataagaggaataatgaaattgtgttatctttatcaaattgatatggaaactaaatgtaattcaattagcataagtcaaggaccttagaacaaagcctgactcatcagaaattctaagtaaacattagctagtcttcatattattatcttcagcattatctgtagtgagaatccttaaagccaaataggtgtaactgggaatgaccagcttagtcgggaaataactatcacatcagagcccctgagtctactagagtattgggagcaagatgttcagagaaagagtgggtctccataataagccttctttgcaaggagagaatataaaagtctaggaagcattttgacctcaattctgtcttctattctagctcagttccagaattttaactcttttgattttgacaaccctctccagaaactgtatctatttccctgttctgattggtggtacaataggtaaatttaagacttggaaatcaaagttttcacattttagaccctgccatgccatttagtaaacagtacaactttcatgtcttattcctcatctgtcaaatttaagccattattgctaccttgctctagagacttcaaggaagaatggactcaaggaatcagaagaatttttgtatttggaaactatatgagatgagattagggagaaacatgggaactaagagaaaatgttatcttttttcattgatttaaagagtatctattatatatcaagcattactctggggcttgaagagcttagatttcaccctgtaggacaaaatggtaggtagaaattaatgggtggattgtcatgtatgtgtgatgtgttttaattgcttttaattgatcagtctccctgtagtatgaataatgtatttgaggggagctaatttaaaattgtggaactcatctaataaactattgcaagaatctagaagaaagataatgacggcaatggtagtagagttgacaagtggaagacaaattagaaaaacactaagttgtaaaaattggtagaatgttaccctgcataaatgttgggggagttaagagagtctcataccagggtgcccatgtaaatggtgattccacatactgagataagaaatacgaagagaaaagctgactgggaacaattggttttatagtcttttaaacatcccaaaggacatccttagcatatttgagttcagagctggagataggcttatcagtccaaagatcacatagatttgtgagtccgcaaaagtcagtaagtttgaccaaaggatacatgtagattagagtcagaagagcaatatacaaaagacaaaagctgagaaattatagtagtttatggtcctggataagtgctcatgaaggatctcaggagaaatgatcacaggtagaaagaatgagaaaagagtgatatgagagaaaccaagacaaagaaaagtaaaatgttaaaaatgagtgaaataggcataccaataattaaaaatgagtaaaataggcataccaataacataagggttaaaaaatagagttcaaaaatggggtgagggtaaagtattaggaaggagtcatggcccagggatcaagtgaaatgagttagatctatagatctatttcagttggttgacatttaaatgtattttggttttaattctttattgtttacaaacattgcttttttaaaaaattaaattgtccaattcaattcaggctcacaagcaagtgcctcatatatacaggcattttgtggatcccaaagatgcaatgataaataggacacttactgatctcaagaagttttcagtaccagaggagacggacaagtgaacagatgacttcaacataagtgggagaaatgaggaagaaatatgtggagctatcagaactaagaaagcttcctagaagaaactgtctttgaacaatgtcttaaagatgacatgttttttggccatgtgcaaaatgagagagaaggccaccagcaaagtcagtgtgctacagagcacatgtgttaagtgtggagaactgcaagaaggaaaggaactactagaaggaaaaagcaagatactttctgggtaactcagcctcctaatgataaatggcatagtttcttccagaccttagagttctaattaatctaacaagctcattagatcgtgagcttcttgagagcgggaatctaccatgctaattccttatggtaaccctgacagcttttatcccaacactgtgcttcttgtggtactcaaaaagacttgttgagaagtgagtcgaaacttcatgctgacttatgaaatctttacggaaaggtaacaatattgtgaaagcagagctttctgatcaaaacttcccatttctcagagtggctagtatcattttgttccaaccagcttcatgataagctataatgattcctgtgactttacctaagaagaagcaaagaaaggaaagagacttaccaaactgacactggggcccatagtaccccacatcacagttgcaggtgtaattattgatgatttctacacattctccatggccactgcatgaccagggctggcaagaagctttaaggaggtcagaaaaaaaatattttaatgtgattacattttagtactcaaagtcatttctttagacatagataaccttttgtctgagatgatttaaataatcaggaaaggtttatttgtaaattcatagcataaaaatcatatgctaaaatttttacgtataaaatacactaagcatatagtcataggcatttatttgcttttggaatgaaattaccaatactaatattctgtaacacttataggaaacttagtggcataccttgaaactcttgaaattacttgtttttaatgagtgagaaggttaaatgatgacctgacctcaatcatttctgcatgcaattatttcttggcaatccctttctttatagaaatcaaagattaaaaagtccaaatttgctaaaacggtagagtccaatttataagagaccaaattaactatggttcattattaaaacatcacttggaaaatgctggctgttttggaattgtagaagattttacagaaatattcatacaccaaagatagtgcaatttttatataaaattatataaggttagaccaagaaggaagcacgcagcaccacactctctacttcacaatgtgaaaactgaggtgatgtgagcctaagtttccaactggccccagctgtcagcttctcctcccctgccttattatcaaaggcactgattgtctagctcttcctctgtacttcctacgtagatctatcattttgatgtaacttgatttaggggtatagcttttgtgcacagggacaaatcttacacaccaaaaattcttaggagtgacacgatgcaagattatatagagggctagatgtattttagaatgaaccagaagctgttctcatccccccacctttccatggggtaaatctgagtattctcttaaccgtggcccttcctgagtctgaggcagcatagccgtcttgtcactccctacctgtgtaacagagggctgcctttagtttgtggcaggcgtcatcgttccatttgcctgcatctttgtttctcttgatatagatctccacgcagtcctccttgttcttcttgttgttgggctcaccatctccccagttctctgcttcttcagtaagagatttgttggttcccacccacgtccatattcctcctatcttccggattcctatccagtagtaagaacgactgaaaggcagagtcttctccagatactcaatttccgccttgttttgtatggcaactaaatctgtgtaattgtctcggcagaatcttctagccctttgccagttcatgggtttttcagaataatggtaagtccagcagtcggttccatgatgtgccaggaaatctgcaagacatcagtgtgacctatgcagacttacataatgttacagctaaaaagaacctagcactactccaggctgagctagacacttagagatgaggaaacagagcctaagagtgtatgtgaccatctcaggatcacagaatagttgtttgcagatttgaagtagaacctagaccttctggcttgaatataagatgcttttatctaaggttctatttgaaacaaatttagtggttttctaggtttattttcttattaatttttttctcaaaattatttcaggtgaaatttaaccaacatattttagacattcatatttctttttctttgtagctgttaatgatttacaactaattaccgtgtaatatcatataactatacaatttacgtatactttttaatcctggaatcatttcttgaaggccaacacatatgtacctatgggagaagcataataaggacaggaagaacagtgacatacttttaagtaacctcttttacataaaaaacattttattttaccataggaagaactgcttctggaaaagcccaatataccactcaactcttatatatctaactgtataatttttaaaaagaacaatttacaaagccaaatggtataggattatgaaattcattagatcatgttctatacacaaagagactcaactgatgatgtttaataaacatatggacccatcaaatatgagggctttgaagatatctaattaaacacataattacacaatgacttcataataatatatggcattctaagcatggtatgatctacatgaatcactatttaatacagtaaagaaacagatataattgatggtaaagagcatcataaaataaacattttgaacagagttttgaatgagcattccactagaatgcaagttctaagagggaaaaaactgttgtgtccactgctgtatccttagtgcctagcataaatttcacacattgtagggactcagaaaatacctgttgtatgaaaagagcactaagtttctatgtgacacagtgcagacatggcataaggaatgtgtgaacgggagagttagcatgtttgcttggctagagctgaaaatccaggctagggagaaagaagacattagtttacttaggaaatgaaaaaccaagttcaaagctattgctggagagtcttcaagaatcagatataaaatttgtcacaacaatgggagaaggaccaaaaaatgataaacccccgtcccttaataagctcgtattgtaattgtagaaatgacattaatgtacactgaactatgaataaaaaatagaaaatgaggtgctaaatatttggtacagattgtaagtaccttaacagagatttcttaattaacattattcctttataattgagggattttgtggggttattgggatttgaactctacagcatgggctattataggttaaaaatagtgttcaggagtttctggggaagaactaaaggtaagaagaaaagagatgtttacagaagggatagaattaacagctctgtgaaataattttcccttagactatgtataactagtggatatttaagaaaaatgaatataagtaaaatagacttagcgatatataaatatcataacataccacaacagagcattgtccacccccacaacttgaagatgttccataagtccctctgggtgctctgacatttccatggaaatatctgcaaatgaaatacaaaattatatttagatgtatactcttaaaccacacatttatagcctttgaggtggtgcttacaactttcttaataatcagaataaaacacatatgtctactaaccctgtctgaggtaacaggtttctcagacatagatgaaaaattacttcaaatttacatcagaactgatgcacagttttgttttgttctattttatttttacgctttagtctcaagttgctaatcggtactgccctgaattttttctatggtttggtaatttttatacctgcttttctgctgagctattagataaaactatttaatatttactatgtatattttttaaagtattgttgctgcttaattaactattgatgcttatatttaatgttatagcctcactcttgatcataatgggtcaatgcctcaaatacctaaaaaaaaaaaaaattagatagccagacaccaggaaagaaaagtatttctttttttaataaaaagaaatacctttttgagcaactgaaatgacaaagtcacaaatttcctgcacaccttaaaatatacttaatgtaaatgacgagttaatgggtgcagcacaccaacatggcacatgtatacatgtgtgacaaacctgtatgttgtgcacatgtaccctagaacttaaagtataattttaaaaaaattctatcttccaaagcatatcacttctcaggtagacacagtgtttattgcaaaagatctgatttcaatagtatttcttcaagagtctccccagagacaaagtcaagaagaggaaatcagcatatctgagaagaaagatttcaggatcactttttttgagggtctgagaaaatgtttagtttctatattatttaaaaccagaattgaaatggggtgattcctatccttgccacctgcctctacaaccccaagagtttctatctgagcatctaaacgtcttttaggctgaaaggctcaccatggctttgcttggtccttctctagttcttctgcagcccattgagcctcttgacttagcacaagggtctcaggtccttgcccaaagggagtgtgctgtgctgcaggtagactgcactgaatgtcaacagaaagccttgctttctttcatttctctaacccagtctcacatcctcctcctcctccccttttccctccccttcctcctgcacttctctttcctctttccccacccctttcctagactggcctctattgcctcccactgagacaaaaatgaactgctgatcagaaagtaatgtgactagattctctcttccttccctcctttctatccttccttccattctcctatgcatctttccttaccctcctcctccttcactcattgttgttgctgttcttcttcctcttctttttcctcctgctcctcttcttctacttgttcttgttcttgtttttgtttggttcttgttctcctcttcctccttctctctctcctcctcctccttcttttccaccaccctcccctatctttttcataaatgctaaactaactcttggctacctgtggtaaatggcccttggaaattgcaaatactacaaatcaaaactgcatttcagacatatttatgatgtttgcaaaacttcagtagagctaagcagtggacttgactcgtttcggttccttcacctccgtctttccttgctcaccacctagtggacgtccttgttagtggcacttcctgaagttaacccctgaagagagcccatgctctctagcttttcaccgtgtaggtttgggagcctacaagtacctttaatattcttggactataaaatgagatggttttataagactgcatgtgaaattaggacccatatgatgaaggacaataaaaaggaagacccactgatgtgagtcaatgagtcaaatgcaaatcagatttgcatttttaggaaaataataataacaacaacaaaaactctgaagctcagcgccccatatttattatattgtttaatctttataacagctctctgctatagatatgattattatccccattctaaagagtctcaaagaggttaagaaacaaattcaaaaactagcgaaagacaagaaataactaagatcagagcagaaccataggaggtagagacacgaaaaagccttcaaaaaatcaataaatccaggagctgcattttgaaaagattaacaaaatagatggaccactagctagactaataagaaagaagaatcaatagacacaataaaaaatggtaaaggggatattaccactgatcccgtagaaatacaaactaccatcagagattactataaacatctttacacaaataaactagaaaatctagaagaaatggataaattcctggacacatacaccctcccaagactaaaccaggaagaagtcaaatccctgaatagactaataacaagttctgaaattaaggcagcaattaatagcctaccaactaaaaaaagcccaggaccagatggattcacagccaaattctaccagaggtacaaagaggtgctggtaccattccttctgaaactattccagagaatagaaaaagaggaactcctccctcactcattttatgaggccagcatcatcctgatactaaaacctggcagagacacaacaaaaaaagaaaatttcaggccaatatccctgatgaacatcattgcgaaaatactcaataaaatacggcaaactgaatccagcagcacatcaaaaagcttatcaaccacaatcaagttggcttcatccctggaatgcaaggctggttcaacatacacaaatcaataaacagaatccattacgtaaacagaaccaatcacaaaaaccacgtgattatctcaatagatgcagaaaaggccttggataaaattcaacaccccttcatgctaaaaactctcaataaactaggtattgatggaacgtatctcaaaataataagagctatttatgacaaacccacagccaatagcatactgaatgggcaaaaactgaaagcgttccctttaaaaactggcacaagacaagtatgcctctctcaccactcctgttcaacatagtattggaagttctggccagggcaatcaggcaagagaaagaaataaagtgtattcaaatagaagagaggaagtcaaattgtgtctgtttgcagatgacatgattgtatatttagaaaatcccattgtctcagcccaaaatctccttaaactgatcagcaacttcagcaaagtctcaggttacaaaatcaatgtgaaaaaatcacaagaattcctatacagcaataatagacaaacagagagccaaatcatgagtgaactcccattcacgattgctacaaagagaataaaatacctaggaatccaacttacaaggaatgtgaaggacctattcaaggagaactacaaaccactgctcaaggaaataagagaggacacaaatgaatggaaaaacattccatgctcatgggtaggaagaatcaatatcatgaaaatgaccatactgcccaaggtaatttatagattcagtgctatccccatcaagctactactgacttttttcacagaattagaaaaaaactactttaaatttcatatggaaccaaaaaagagcttgtatagccaagacaatcctaagcaaaaagaacaaagctggaggcatcatgctacctgacttcaaactatactacaaggctatagtaaccaaaacagcatggtgctggtacaaaaacagatatatggaccaacggaacagaacagaggcatcagaaataacaccacacatctacaaccatctgatctttgacaaagctgacaaaaagaagcaattgggaaaggattccccatttaataaatgatgttgggaaaactggctagccatatgcagaaaactgaaactggatcccttccttacaccttatataaaaattaactcaagatggattaaagacttaaatggaagacctaaaaccataaaaattctaggagaaaacctaggcaataccattcaggacgtaggtatgggcaaagacttcatgactaaaacaccaaaagcaacagcaacaaaagccaaaattgacaaatgggatctaattaaactaaagagcttctgcacagtagaaaaaaaaaaactatcatcaaagtgaacaggaaacctacagaatgggagaaaatttttgcaatctattcacctgacaaagggctaatatccaaaatctacaagaaacttaaacaaatttacaagaaaaaacaaacaacaccatcaaaaagtgagtgaaggatatgaacagatgcttctcaaaagaagaagtttatgcagtcaacaaacatatgaaaaaaagctcatcatcactggtcattagagaaatgcaaatcaaaaccacaatgagatgccatctcatgccagttagaatggcgattattaaaaagtcaggaaacaacagatgctggagaggatgtggagaaataagaatgctttttacagtgttggtggaagtgtaaattagttcaatcattgtggaagacaatgtggcgatttctcaaggatctataactagaaaaaccatttgacccagcaatcccattactgggtatatacccaaaggattataaatcattctacgataaagacacatgcacacttatgtttattgaggcactattcacaacagcaaagagttggaaccaacccaaatgcccaccaatgataaactggataaagatgatgtggcacatatacatcatggaatactatacagccataaaaaaggatgagttcatgtcctttgcagggacatggatgaagctggaaaccgtcattctcagcaaactaacactggaacagaaaaccaaacattacccattctcactcataagtgggagttgaacaatgagaacacatggacacagggaggggaacatcacacactggggcatgtcaggggatgtggggctaggggaggaacagcattaggagaaatacctaatgtagatgacaggttgatgaatgcagcaaaccaccatggcacatgtatacctatgtaacaaacctgcacgttctgctcatgtatcccagaaattaaagtataatttaaaaaaagtttaaaaaaagaaagttgccttagtcacataactagtaagagacatggttgggaatttgaacagaggccaatcagttccaaatccatgctcttgatcattaagctgaacttatggcaggaacttggaagacatggtaaaatggggaaaaacgtggagccagggagacttgtgaaagtgccagtgctcccactataccctgaaagaagtatctagacttacttttttctaagtcctctcctctaattctctcaatctctctctctctttctctaagagatgggaatgctgctctgtcactcaggctagagtgcagtggtgcgatcatagctcattgcactcaaggaatcctagggtctagtgccccttctccctcagcctcccatgtagctaagactacaggcacatgccccaaccctcgactaatttttttattttttatttttgtagagacaggatctcactatgttgctcaggctgtaattctgtcttgaagcttgtccaatcaggctttcagccacaccaattccctgagactgctctcaccaaggtcctacacttcactaacacaaacagcctattctccatcctcatcttacttcaccagggagctcctggttttcctcctacttcactggctatttcttctgtatcatgtgttgattctccctcatctccccaacctccaaacccttggagtactccagagatcaccgctttgctcttctgtgtctaacctcactaacttggtggtccaattcacactcttgactttgaataccatttaaatgcgaacgaattctaaattctgtacaaccagaaccattctcctgtagccaaatgcctactcaacatctccatccccaaacaaatttagttgttcaataagcctctcatattttacatatcccaaactgaacttctgaatttctcctccaatctgtagggctcttcccacagcctttccatctcagtggattataactccatccttccagttactcagaccaaaacttttggagttaactgagacacctctcttttttttcacaagtcatatccaatgtgtcaacaaattttggtagtggaaatattgcgggattttttaagaaatcagagagaccgatggggttcaggaggatatttattatttaggtgcactggccaagtcagattaacatccaaaggactgagccctgaacaaagagttaagttaccttttaagcattttgtggggtgggagagaggggtatctgtgcagggggaagcatactacagaagtgagaaataaagacagttattcaattaattgagacatgcattacatcatttcttacttttcaagaagaaacatgttttgcgacttgagtttatctgtctagtgaccttgcagctgcacagctagagaaacagggtcttcacaatgcctgggaaaggaggagaggtaagtctcactagccacagaaaaacaggcagttaatttttaaagggctccagctctttctctttctcagggggagttgggttttgttacatacaactgagtttccgcttacacattatttaatttcttttaattcctgttccaaaagaagccagatacaaaaggttacatgttgtctgattccatttatatgaaacatatagaagaggtaaatccatagagacagaaagtagattagaggttcccaggggctgaggaagaaatggggactaactgcttatagggtacagagttttcttctgataaaaatattttggaactagatagacattttgttaggccattcttgcattgttataaagaattacctgagacttggtaatttataaagaaaagatgtttaattggcttacacttctgcaagctttacaggaagcatggtgccgatatctgctcagcttctggtaaggcctcaggaagcttacaatcatggcagaaggtgaaaggggagcaggcatatcacatagcaaaagcaggagcaagagagggatgtggggaggtgacagtcacttttaaacagccagatcttgtgagaactcattcactatcatgaagacagtaccaagaggatggtactaaatcattcatgagaaaccccaccctcatgatcaaatcacctcccaccaggccccacctccaacactggggattacaatttgacatgagatttgagtgagaacacggatccaaaccatatcagagatggtggttatacaatgcgataaacgtcactggattgtacactttaagatggttgttttatgttgtgtgaacttcacctcaataaaaaaaaatatttaatgtacattcagccaaaagaagatttggaataggaaaggtcatggagatatattaacagccatttgatgggtggtaaggaaaagagtggttattagactgttttgtggccctcaaaaggtagaactagatcgagttggtgagcattataaaaccatcacaaaaccctggagagaggacccagtgctgaagaaccgtttgcctgccatgagacatgagggaagtaccagtgaatgccattgaaagcagcatccctgggtccaagggatggtcaaaggaccactacccaacccttccctagcctacgcctccattacagatgaccgcaagatttatttgctcattgctgccaaccaaggctgcactcactgcagttgctatcagtttatcatgggtaaaaggaatgtgcagtagagaactaactaactgcccacctacctccacaatcctatcaggacaaatcaccatggctcacatttccttacatttggcatgtaagcccctcttactgtctgtcatctatctcctacacagttcacctaaactgttctctcctgacccaaccttgattttcatcccaaatgcttccttgccatctctgggattcctgtcttcaccatcaccaaactcccctcaatcttccagtttcctgttcaaacttttctcctacctccttgctttgtcattagcccgactgcctccctaggacatcacttcccctgcagatctctcaagatgacaatatttattctccacacagcacatacttcagggttggaaggcaggggcaatcttctcctttataatgagtgcctcttatatatgtttattcatctgccctcttgtaaaacacacacacacacacacacaaagaagaaataaaataactctgcttctttgaagcttgtgacactgagataaaccatctcactgtcctcattgtagtgacctctcaactcctcatgcaagattggctttggcacctagttcctgatcttcctttccctgtaagcacttctcatagtcttacgggacttcaccatccatggcacaaccaataccacagcccagatcctcagctctccaatgacattttcctccactagacttgagctacctccttccctaggcacagcctcaacctcgacaacacctaagactgtaccgtctctaaagtcacatgttcaaacacttcactctttaaccactgtctcctattcttgcaagtgtattgctcaagtatctcattgcaatgctttttacttctacctcattgaacctccaggccattaaacatttccttatttctaaccatcaggtttctccttacttgtttgtttgtttatttgtttcttttttttttttttttttgagacagggtctcactctgttgcccaggctggagtgcagtggtatgatctcggctcactgcagcctccatctccctggttcaagtgattctcatgtctcagcctcccgagtagctgggactacaggtgcatgccactacgcctggctaagattttgtatttttattagagaaggggttttgccatgttggccaagctggtctcgaactcctaacctcaggtgatccacctgcctcagcctcccaaagtgctgagattataggcatgagccactatgccccacctggtttctccttatttatttcaagtctatgctgcactattaaaactgccttgacaaaaattataatagtgagaaaattatgacagtgaaagagatctgaaataatcaacccccatcttgcctttaccttccagactgcccttaataattcctgagcttgggccaagctatctttggcagaaatttagtttatagtttaaatgataatagcccttctccaaaactaaactgcctttgtaaaactaataaaagaccaccaatgaaaggttaggaggatgagaggagcctgaattctgctaaggtgtagatgtaaacaattaccaactgttattccggaggtcacaagatttgcaacatcgccaattactcctgcagataacagcactatcatagaatctgattggccttttgagatgtcttttcagattcttacatttcaactggtggctctacctggacccatcaacaagtcctgtggctccacccagaagcagacttaacatgcacaaggaccattttccacaccgctatgattgcatcccaaccaatcagcagcaaccattcctctgcctgccaaattatccttgaaaaatcttagccttagaattttgggggaggctgatttcagtaataacaaaaccccggtctcccatttggctggctctgcatgaattaaattctttctctattgcagttcccatcttgataaatcacctttatctgggcagcaaacaaaaggaacccattggacagttacactgttggcagatatatcttgcttccaaaattggatttttgtttaatgaatttattctgttttcttgatatttacaactgtgaatgttgtgtctgaattctctttatttcttgttgaaaagaactatattgctacagccagtacatacagatggatagctaattactcaacacggggggatgtgaccatcaccgcactgtgcaaatgaatgttacccattgtccacttttcccaaactacatagtgttatatggtatatgacccaatcaacggtggcaaagctccagaaataccacatagacatcagggacactttaaactaatcagcctatagtcctttttcagtaatttccaaacctggttgtgcatccaaatcacttggtaacattaaaaaaacaaaaaaatatacacgcaacattcgctcccaatcctactgaatcagaatattttgggttggttcaggaacattcaggagtttttcagggtccaaggtttatataatttgaggtctctctttgagaaaaggaacgtaaaagcgtcttgcttttatagatcttacaaagatgtattaccatgtaaacacattcctaggacccaggcccttgtaatttaaaggtttatctaagtaatgggccctgaagcttaattttcattatcttcagggcaaattacctgtgggttagggtttaggaatatatctctctgtgtatgtgtgtgcacattagcatgtacgcttgtgtggattttttttttttttttttttttttctgagacagagtctcgctctgtcgccaggctggagtgcagtggcgtgatctctgctcactgcaaactccgcctcccaggctcaagcgattcttctgcctcagcctcttgagtagctgggactataggcacgcaccactatgcccagctaatttttgtatttttagtagagttggggtttcgccatgttggccaggatggtcttgatctcttgacctcgtgatccacccgcctccacctcccaaagtgctgggattacaggcgtgagtcaccatgcccagcacttgtgtggatgttttaagctcccaggtgagtgaatacaaaactagatctttcccttctgtagcatctgtactgtttactctatgcatctcaatattttttcttttagtatctttcctttttctctcttattacttcctcttgtgctatttttacacctccttttttaaaaaattttttcccttttatttctattgacctttagccctcacaatgattcctacaagccccatttctgtaaatggggattgaaataattgctggacttttgagagatagatatattaaattgcaaactggcagtagtgggggcagttgatacataactaggttttaaagtctagccttctgagaccactcattccatttgtgaaaagtgattctacttcttattatgagccaaaatatgcattcattcacccatgcattgatttattcattcaataaatatttgttggatgtccactctgtatcaggaatgtgctaggttctgggaatacagcaatgaacaaggtaatttttccctacccctaaggaacttagagtttagtggggaagacagacattaaacaaacaattgtgcaagtaataatctataattatttattacaattaaaggaaggaagagacatatggattatgagggcattaaagaggagacctagtgtaagtagccagttctcgtgaagggacatgtattagttggagttctccagagaaacagaaccaatggtgtgtgtgtgtgtgtgtgcgtgtgtgcgtgtgtgtgttggggtgtgggggtgtggtattttttatagaaattgtctcacacaattatggaagctgagaagtcccatggcctgctgtctacgagctgagaaccaggaaagccagtggaatacttcaaagtccaaaggccctggaaccaagagtgccagtgttggaaggcaggagaagatgggtgtcccagcttaaaaagacagtgaattcactctttttgctctacatagggcctcaatgggttggatcatggccacccacattggtgaaggcaatcctcttagtctaccaattaaatactaatctctttggaaatactctcacagacacactgagaaataatgttttatcagggtgatagaaatcttctggagttaaacaatggtgatagctgtacaatcacatacatttttaaagggtgcgttttatggaaagtgagttttatctaaataaaatttctaagaaagagacttaacacagagataaacataagcacatttattgtcaacctttatagtgttatgtcaaataggtctgacataagcttaaataaatatatactttaaaaattataaaatattttaagttataatttaaaattctcaataaaactcaaacacaaaccacactggtatttcacacagctaatttctaatgcagtttacataaatatttacaacacttaaacaatttcaaagaaaataacactgtattccatacatagcctgatcacagtagttgttctctcttatttcccagagtttttctgcccctttaaaagaacctctgctgttctgatccttatcacatctctgttttgactgttggctttgttgttgccagtgttcagccagaacttctctgaaacttttttttcaacacatgctaagttaatggaagtgtaggagagttttgattctcacactcctcaaggctagagcagctttggcaattactgactgagaatttttcattgccagtgatcaactgaaaactggagattcctttggaattgttaaatctgcttataaataaacataaatgcttgctcacacaggcattcctctcttccagagcaccctaacatacagaagaaaacaaatagggaataactattagacatcttcattcgttaaaaatctaccagatgactcttttacatggtgagtttctattgtgaatttaaaatcttccataatatacaagaattatgtttacatatcatatctgacaaacatctttgtaggaatgcaaagcacatccatctttctgtattcttttccaacaaagacattcataaaattatacctttgtgtgtttgcatttatgcttttattagttcaaaacgtttggcctcatggaagtttttcatcgtggaaaccacatatttctgaaaaaatatctgacaatatacaaaccttccattcagtttttactctccaattctaccatgttttcaaaaaacaactgtagtaaaaacactcagaactttattctggttaacatcatgccttgctaggggacaatagtttccctttttgaaataaatttaaaacagatgtaacataatttgttaataaacaatgagggggtaatctagaataagtaacttttaccatatcatagttgacagcatttacaagttttttaagtccctaccacacttgtattgaatgaagaagtatggaagattataatatattcaatgcaagtaaaaatatcacaatccttaagaactctttaagaagcactgaatcccatagggatgaaagtgattaaattgtgcatagtaaccctcgcacagagcattcagtaggatttgcaccattaacaaccctccatgcatttgcctgtgggcattcaacatctgtcatttttttaagttataatatttttagtcatttttttcctctaaactctggataattattattcattcttatgacagcaactgtgtaatcagctgtcgaaacactgtgaagggcaaaagaaagaaagccacaaaatattgtgtttctgtgccaagattttacagcgagcaagggagagttagaaaaggaattctgagatttcagagtcttggtctcttcacctttgcttggaagaaaatatcctttcccttcattagccaacactttcttgatcctgagagtaggaaagggaacactgagtcttttcagttgaaggccgtccttgcctgctggactttgatctattgaagtggtgatgggtgttgcggtttcagccataaaggcatctggcatagtaggcaagaagggccagagacccgaggagagttatctgtctctgttaacttcagtgtatccctctagttccccagatgcacctgtttctgtaaatataaacatgcatgtcatcagaacacttaatattctgcatactgatcatgacaacaaaatgtaccttctaacacagacactctcactaggatagaccatgtaggaacatcgaattctattcagttaggacagtgatgatgtctacatattatacctctgtcaaaacctacagaatatacaacacagcacagagtgaattctaatgtagcctgtggacattaatgaataataatgtatcaatattggcccatcagttgtaacactaatataagatgttaataacagggggaattgaaggggtggtggggagatatgttggaactctttgtgctttctgctcaatttttctgtaaacttaaaaccgcacacacaaaaaaagttattttaattttttaaaaagtattcagagggacttgacctttccaaattctctcaaagcaggtcggagtagttaagaacacaaattttagaaccagactgccagagtttgaatcctggctacaccacttactagctttgagatttcagacaatttacttaacttctctgtctcattttcttcatctgtgtgataagaaataaagtaacaggccaggcccagtggctcacgcctgtaatcccagcactttgagaggccaaggcgggtggatcaggagttcaagatcagcctggccaacatgacgaaaaaatacaaaatctctactaaaaatacaaaaattagctgggtgtggtggcaggcacctgtaatcccagctactcaggaggctgaggcaggagaattgcttgaacgcaggaggtggaggttgcagtgagccaagatcatgccactgcactccagtctaggcaacagaatgagactccatctcaaaattaaaaaaaaaaaaagtaaaaagaaaagataagaaatatagtaccagcccctatctcagagttcctagcttagaaaaattcccagaatataataagtgcaatgtaagggtcagctatcttcattattattatctatcataaatgaaattacacaataaagctagatccgtttctttcctctccttctacaaaaaataaagcaactttccagaacaatacccaggtgatgatttctcccctgctccctccctaagatattggcaagtttggagggttcaaggagaaacagagcatgtagagaagatacctctctcataaccatttgtgatttacaagtcttacctgattcttttgaacttaaaggatgtaagaaggcttttggtagcttccatctgattcaaggctttggcagctgctgtggaatacatgagaacactaggtaaagcactgtcttccaacatgaagagagaaaaatatgtggaatgttcaatggcatgctttgtataagaatgcaacttacctggcaggaacaaatttctttgctgcaaaagaaaagacaaacaaccattaattcagactaaatgacttttaaggatatattaaatccagatacaatatgacttaattcatcaagtgttgcaaactcgatgcttcagggcctctgtaataatcagagcacaagcatggctctgtggcatctagggtaaaatgcaaagtgcacagccatccaaagggcatagcagcttcctaatgccagcaaatagctacggggtcatcttgcccaattcagctcccaatttttcatgagaagtccaaagtcttaatttaaatgtgagatttcctattttgtaaacgtcagaacttaactcaaaaatgttttaagtactcttaaacatgtaagccaaacaaaccatgagtgtagtcagatgtgcttccatattccttatgagagactctcaaatttaagcctgtactccaaataaatctccttaggaagaattttatccattttccttagagtgctcatcatggcagttccattgcacaattccgggaggcatcatataattcaacatgaatagcaccccctggagttgtacaatattaggcacgactaacatttttatttcctgaaacacttcccacactgagttgtactactaactcttttcttaatacttctgcttaattatactgcattttatccagattctaattattgtttaaatcagtaagcaagaccatgacttatcaatgagaaagaaatgtattttcaaaaacatttttgaagtacattcataaacttcctcacctttccgtaagcatttccgaagccagaggagaaatggtgctaatgtcaggagggagagtccagcagcagaaagtccagctaccaagggaatgttggactcagtgggagctaaggaagtaagagacgaagaaaggtcatgaggaagaattgatgttaaagtctctccgtcctgtccctttggccttttttctgtacattcattactaggagcagaagagctatctagtttaatacaagaagcagagatgtggcattacaggcctttgagatctgctccaagccacctttgaagctatttccaccattggcaggcagaactctaacttgccaagctcgttcacaataccacaccacaccttggttaataaacactgcacttgcttgctctcttgctctcactccctcttgttttccatttcccctttctcctctcctctctctgtctcctttttccagttgtcagaattctaccctttccatcaacatgcaacttctgttttttctctatccccatacaacttaatattcacaacttgtcaacctgggcgaactttctggtttggatataatgaatagttgattactgtaacaagatagctccccctttttctttttaatcaccagacaaccaccatcaatcaatgcatcaccttcacaggtaggtagcaggccagaccagtgtcctgtggctccacatgtccgagctgcagagccattgagcgtccatccttcaggacaggcgaacttgcacacagtgccaaacacgggctccccactgcagctcatgttgatctttcccggaactgccaggcttgaacattttaccactgcaaatgttaggtacacaggcagagtttcagaaaaatctactggaaaacttccaaaacttgcttaaaagtcaacaatgaatgtaaagtgtaagcgctacttagttttcagcatgtaggaaattaggaccaaacccctttggggcaatctaggttcagaaactttatgaagtatttgacctgtaccctaaaaaagtctgcactcaattctaccttggcaggaaggaacctcttctgtccattgtccctgagatgtgcactcaagttgagttgatccatgtaattcaaatccctcctcacagctgaaggcacaagaggacttgtaggtgaattctccaataggggaatgagcacacctcaccaaacccttcgggggctggtggacagcatcgcatctcacagctggaacacacgagagagcactttagaagtttgtttgcatctccagcaatacgtttcccaaggtaaccaagttcccaagctcttcaatagttctttttatcttaaaataaaataaaaacaaagactgtaccttcacatgtgggcttctcgttgtcccactcccctgtggggccacattggagccttttggatcccttcaacacaaaaccctgctcacaggagaactcacagctggacccataacggaaactgccagaagcactaggaagacaattcatgtagcctcgctcggggttggacaaggctgtgcactggaaagctgagacatcaaaatgatggtcagaaaatattgcagtggaactagagagtacttggcgtttgttgagtgaacccagttcattcaagcaacacttggagaactgaagattctttataattccctggacaaatgggaagatggctgtgttttctttgaatttcagccccctcactgatcatggcactaattaaaagactaattaatcagaacattagttcctgagcactgttcttctaacacacaaaataaattatggtccaaggaaagatttcacgcagtctgaggacaacatatgggtcatggatgtttatagatggtgccaaaaagaaagaaaagaaagcacccctataaaatttgtctgttttgcagtttggtttttgtgttatgttttgctactggaaatcattctgtgctggctttggctaggacaaggccagtgcctgatagtaaaaactgcttgttttcaatatccttgctctcactttaaagtgaattaaaatttactgcttatatatgcatcaatactatctctgtagctgacaccatgcttgaaacagtctcatcactgctaattatgagccatttcagaagacaggtgtgatgagagttttacattcaaatcatgttctcattattctgctttccgaattttctaatatgattcctttagattaagaattctgtctattccatgctaatgtctacaaagttttatcagcacatcacagttaaaaaaaaacagcaaagaattcattcttaacacatatgatcctttccctggccaaacattagttcttttaaatgaatctcaaagatacgagggttgctcatcaaatctgatttctatagttaaagtgggtattggttttttttttcactgtccaagtttgaagatggttgttctttaagaaagtataaatcgaaggatctcaagcttaccttcacaaactgggatttgctgtgtccactgcccttgagtggtgcattcaacctgggctggtccctgcaacatgaagccttcctcacaggtgaagttgcaggatgatttgaaggtgaactctccagcaggggaatggctgcacctcacagagccattctgaggctggcggacggccctgcatgtcacagctgtaacaaatatacgcattgatattagcacggcctagaattagcttgcccatttccagtatgggttgagagaaagaatgttcacagtaagtctccatgtggaacaactctacctttacacgttggcttctcgttgtcccaattcccagatgaggtacactgaaggctctgggctcccattagttcaaatccttcttcacagtcaaatgtacaggttgtgttccatgggaagcttccagggttttggaaacattccacgaacccattggctggatttgtcacagcatcacactcaaccactgaggattttaaagagcaccatgaattttacagaagaatgatcttttcacttcctattgagctgggtgcctaacagagtgaggaagctgccttcaaagggtagatcccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatagattccagattaggagttatgactagtactgacatacgtaggctattcatttattttagcccatcagagcctgaagaactgatttttctttttttggcctctggttcagaaagataaaattaagagagaaaaagagatactaagactgcttgactatcatggtcttaagttagtcccatggcttggaaaagttaaacagggaaacaagatgagaaatccattgagatttctagagctttattgttttatggtctcccttacaaatcaccagagcctcagaaacacccatttcaagcatagaataaaaaaacctctctcaacccaagcaggtactgggttggcaatatacattggctgagagaacaaattgtattaaaaacaaaaacaaaaaaaaaactttccctgaagttttgaaaatgtaagttgaatcaaaaaacagaagcaatgagggatgagttacagaacgttctgtgcattctcagagggatttaccattgcaggctggaataggagcactccattctccagaggacatacactgcatggtctccatgctgcttggcaggtaacccctatcacagctgatagagcaggaagaattgtagctgaagtttcccagtgggtgactgcaaaccaggcttccatgctcaggggattccagggctgtacagttcacaactgaaaaagaaacccaaatcagttctgctcatctctcacctttaacagataagaacactggaaactagaactacagtttggttttttttttttttagtttaaaaatttataaaatttctaatggaatttgtaaaattgactgtaattctaccccttttcttttattcaagaaaatgctgatccataacaacaacaacaaaaaagcagtgatgacaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatactacagtaagcttccaaccaggatgagaaccattcacaaagctatatttcaaatttaagtactagaatacattacaaattttaaaaccctaatgctgcactgtctactatagtagccactatctgtgtggctactcaaatttaaacttgaattcgttgaaatcaaataacatttaaaattcagttcctcagtgtcaccagccacatttcaagtactcaataaccacatgtggctcataggtacacactggaaaacacagctatggaacatttccattatcacaaaagctctactgcacaacgctgtgctaaggaatcttggagagaagctcatctaactctcttaatgtacaaatttaggaactgagacctcatttcattcaagtgacttgctccatgctacacggctagtcattacagagccagaggccagagcatgaaccaagataccctggactctgtaactcactcatttctactgcaacgtcttgttaccacctagatgaggtgagtacatgttcctcgcagggacacagaattacagtttattgaatgtgtcctgtgtgccaggcaccatgtaaccatgagcctatgaagttcacactattattatcctcattttacaatgagaaaactgacatagagagttaaactatcttgtcaaggtgccaaaataaataactggtgaatctaggactcaaacccagcagggtctgacttcatagtctcagctcacgatcaccatatgacaccatctgcaccagggaagggaaggcatgcagacctgactctaatgccagctaggacgtgagatggtgctaccatctcaagtgaagaaagaggcaagaaccagacttactttgctcacacttgagtccactgaagccagggtcacacttgcaagtgtaattattgatggtctctacacattcaccgtggccactgcaggatgtattggtacaggcagctacggaaaatacaaagcatgatgaggaggactattactgtgcttatactgagtgcctttgattttagaatcaacagtgtgcaacagagacatcagcagtcctacagagtgccatagactttaactgaagtgttttacaaagttccaaatctgagtttcaggcccacctatcctaaaccttgatgctaatgtatagctgtggctggcacctaccgtagaaaatttacttcttcacaaactctgaagacagttcccctaccacaaataaacaagtaattaaaatatgtattgtgtgtgtgcatttttatatgtaaagaactacatatttgcctacagtatttatatatattttatatatatacatacacacatatatgtgtgtatatgtgtgtatgtatatatataaaatgtatataaatgctgtaggctatatatatatacacacacacatatatgtgtgtgtgtatatatgtgtgtgtgtgtatatatatacatatccacatattcttgcccacattcacacaaaacagcaaaagagagaaactttagcagttaaacagaatcttttggaacataaaatgaccacaatagagagcagtttttgcatgctgtaaatttgccaagatgcccacacactgaaactacctcccactgctgccgcaaactccctacctgtgtagcatagggcaagcttcttcttgctgcacctctcatcattccacatgcccacatctttttctctcttgatgtagatctccacgcagtcctcatctttttgcctattgttgggttcacctggagcccagttcttggcttcttctgtcagaggtttctgggttcctacccagacccacacattgttgacttttctgattccaatccagtaataacttggtgaatagctcaatatggagtttaggtactcaatctcttctttgttttgaattgcaaccaggtgtgtgtacctttgctgacaataagcactggcctcatcataagtcatagcttccgtggaggtgttgtaagaccaggctccactctctttaatgagaagcactagtgggagaaaaagaaaagaaatggtagagtttggtactgttgtggtttaactctgacaactgtgctttttattgtcttatttttggcaatgtttgtgacatggcccagacttttctcatcttttcaaaagtaagaagtacgtatgaagaaacagcgacttattgtttatctcttttgtgactgccacccactaggtaccttatccacactcactcacaacattatagtatacccattttgtagtagaataataatcagaataactaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacagccccagacaagcaaggatatttcagtctgaaatatctatagtgcgagaatgagaaatcttggtctaatggcactgacttacccaaagtgagagctgagagaaactgtgaagcaatcatgacttcaagagttcttttcacccaaaggtttaggcttgaaatactttcctggggagataaaacacaaaatgaattaaagaaggaaatcgtgggtagctagttacattattctaccatgatgtttaaggcagcatcctaagattttgggcaaaggacactagtgcaataatctttatttcagagtttaatcaaataaataaacaaattttaagactttcattatttaggtcaaagagaaaagacaggttttagctacaatacaataagagcttgtacagatgtggtttttattagaaggccttttgcatatctgtgtttcatggcccgaggctgcccttataaagcgttctgcacttaccgttttgggaagcagttgttcaaacacaggatctctcaggtgggtatcactgctgcctctgtctcaggtcagtataggagttttgatgtgaagtcagccaagaacagctgaacactacttcggctgaggcccttttataggagggattgcttcctgtgaataataggaggatattgtccacatccagtaaagaggaaatccccaatggcatccaaaaactttcccgggaatatccacgatgcttaaaattacaatgatgtcagaaactctgtctcttgaagctacttcacctttgtccatgcctttatatcgtatatgcaattttattaatatgacaaaaatgcatgatttttaattataataacataaagtctatgtctttaaaaagttgtaaaactttgcttgttagtagtgtctctcatgtagttgtggtagtaattagaatttcagaaacagaaggaaaccaagaataggtttgtcatccatagtctactaccttcaatttctcattcatagctgtggataaccaatcactactcattttttcttcctttttcacctgccaattcaacatatttaacatgcactgtctcacagaggaatgactcacaaggtagatattaatcttcagattttgcacggcagttatgcctaaattaaaatattatctaaaaataatatctaacactcaaatggttaaaataatgccttattttaaaaaaagaaaaatgggaaatagatatttacatctgggaaagtttcatggtttgttcagtgaaaaaaataaaaaggaggccaggcacagtggctcacgcctgtaatcccaccactttgggaggccgaggcaggcggatcacctgaggccgggagttcaagaccagcctgaccaacatggagaaacgccatctctactaaaaatacaaaattagctgggcatggtggcgcatgcctgtaatcccagctactcgggaggctgaggcaggagaatcgcttgaacccgggaagtggaggttgcagtgagccaagatcacgccagtgcactccagcctgggaaacgagtgaaactctgtcttaaaaaaaaaaaaaaaaaaagaaaagaaaagaaaaaaaataaaacggaaaactatatatatatatttaattggtcaaaattttgtttaaaatttttgaaatgttaatgtgcaaagaataaaaattcttccacaatgttaacagtgactaactctggatggcaggatttgggataatttttatatccttcattattattttcaggattttaaagtttttttcaatttccctttttttcacctttatagtaacaagaatacagtttaaagaaacttgtctctaggccaggcatgatggctcatgcctgtaatcccagcactttgggaggctgaggtgggtggatcacctgaggtcaggagttccagaccagcgtggccaatatggtgaaaccctgtctctactaaaaatacaaaaattagccggggtgtagtggcgcatgcctgtaatcccagctactggggagcctgatgcaagagaatcgcttgaacccaggaggcagaggttgcagtgagctgaaatcacaccattgcactccagcctgggcgacagagcaagactccatctcaaaaaaaaagaaaaaaagaaaaagaaaagaaaagaaatttgtttccaaatgcaacagaaggagatgtatgtggtatcctatattcctgctcttcattttgacatttcttctgggtgattgtatacattccccatctctgcatcttaccctatctaaatgatggtaacagtaaatggggatcattttaatttccatattctgtaggttttcagagctcaagtcaagctaatattctatatctacagcctttcaaaataggaggtctatctaaaaatgtactgtcagcagacctgaacgagtagtggtaaaagcctcgtttttctctttacttgttagcactggtctttctgtgttcataaagatgtcaagacccaaaaaaaaaacaagaaaagagaagaaaaattccaaaaaagacaactgattagaaaaaaataacttaattaacgaatttaattcaacccctatcaaaaagcatagaatttattccctccaccttaccactctcttacatgatccagatactgacattattccaattctttatcccactttacttagctcaatgtggttgttgcttcaataaattcagaagagtaatcactcatatagtgtttatttagattttagggcagaatgtcaagttgggttaatacattatctgtatgtattttatttttaataaagtatgaatacataatctgctatttttaaaaagcatggtcaaatgtatagagtagccaaatcttaaaaaacaatttatcttcgatatcaataaagtacctaataattatattgctaatagaaattagtcgttaacatccctagataactaactttattattgcgaatttttcataactaagtttatagtttatctcttcccctttttaaaattagttcaaagatatctaaaaatagccccagtggtgatgaagtttctattttacttacatatatatgtcctggacccccaattataatctctaacatttattgagtgcttactatgtgccaggccatattctgagcattttgtatgttcacctattgattattcaatccgtacaacagcctatgaaataggtactcctattatccccattttacagatgaggaaattgagaatctggggattttatctcattcaaaagcacagagctaagggttgaaaccaggcagttgatatccagagcccactcccttacctgctactccaaaccatgatttcttttgttgttatgccccgagattccttgttctacccaagtttcctgtactcttcttgccctcttcttcctgagacatccttgaccatcacagctctccactgagataactgtgtcctgggttctgagacatgggggctggaagggaccccagggacagtgagcagtagggagaggatgcagtgagaacagaccctggatccccggtgcataggcagggagaaagtggacaaaggaaaaaacaagcaaggcaggtggagccatgcctaggtaaagttgatccctaagccacagttcccagaagttcctgattcaaaagcaaattttctctaaggtcaaagggcaaactgattattctaaattctaaactgattatttctaaattgagaaagcttcagggagagatcccaatattcgaaggataagagaaatgaggagtggaagagataggtgagtaacagtaacttaaatgtagactatatataatatataatatatgtagagtatatatatataattacaatatattatatatgtggaatatatatattatttatatatatttatatattttatatatatagatatttttatattttatatataaatatagatatttttatattttatatataaatatagatatttttatatatattatatataaatatatgtaaaatactgtgaaagaagaatagaatcttgagacctcaaattcactatgccaaagggaaagttaagcttgggaaatgagtcatgcaaaaactgccttccttttgttcccaaatacctgtaatttcacatgcttactttatcttatataaaatgtagatgtactgagcatgagatccatgcataatttccctctagtcccttctttttacatgtaaagtgtagactcactgagtgttacagagccttgccacaatgtaaacacttgtctcattgccaacccatctttcgtttattttcttcccctcctgcttgctctttcccctctaaagatggaagttcccaaaactctctttggaaaaagcgcaggtcacagatcctacagtgatttgtgtttcttttacctgggacaaaataaacctctaatctgttgagatatgcttcagttactttttggtttacaatatgtacatgtatgtatataatttatatgtatataatatatgtacttgttttaaccagaggtatgttattcaaaatccattcatccttacaattacctgcattctcccacagtattttctgtgtccctgcccccgaggttgtcactgcaaatcaggtacatggatactgggagctgatgggctcccctctggctacctgggctgctgaaggggccatagacagacccagctttcctctcgtggagaggccctgggccagcgctgcgtgggagtgggattacaaccagactatagcttcttcacctgctttttcctatcaggatttcataagaggcaattgcttgttttttgagggtgggggcaaatcagggggagttgaagaggaaattgggtaagatttgaatagttgggcatgttgaatattatgaatatcatctccctcttcaaataatccaaaatatacccccaagaaacaggctgattagaggtgcttcaaggctccactgaatctcccaagctctgaagatgtagctagctgttaccggattgccggttttcaagcctcgcctcacatggaccctcttggcagtttctcgcatgggggaagcatccgctacatagatgggaatgaaaagaggaaagaagacggtgcaaactcaggcacaccccggtgtctgccaccagtgctatttaatctctgaggtgtcacccttcctggctttattgtctcttcctggaagtctcttgtcctctcctccacaccctttaatcaggcatcaaagactttaaccagttttgctgtgtgcccaggcccactcattctcacttttatggcaaagggagtgggagacagagagatagccagaaagaagagattggggaccccaagacaaatgttagaattttaaccaaggccaccctgtggacaggagattattgggtttagtggaaagcagcactggccacaaccacacgtggcaaaagcatctatcgaggagtgaagttatatttggtgaatgtgaccgggaagcaggggcagtggtgtcctcctgccttcctgaggcactctgttcccttacctctgcgaaggcttattttacccctgagtgcttagttttgaaagccttagttccctctctcccataaaaaagctctactctgctaacatctaagttacctttgcagagtcttaggtagagggaggaaatcccaataaagattccaccctatctgcaaaatacaaacatggtatttcttgcattcccaaaattgtgaaagaaaatgtgtatcaccacagtagagaatggcattttttgtttgatcaaaacctaaatatatttgatgaaaatgtgtctggttctaagtttatttcccagaaagccatgtttactcacttggaatttatagacatcttataatatctgagtcgagtaggagctccgggctctacctcactcttttctcccacacccagggggaagtgtagggttctcagactttagaataaagaggaatcacctggacaactcacctaaaatgcacatcttcaggtctcatactcagaggctctgactcaacaggtctgggtggcgcccaagaatttgggctttaaatgagtatctcagatgattctaatacagaatgtgtaagatgaccagatcctatcacacttagatgtattggcctagggccacctaacttggagaaaatgttagtaagaccccgtggttggtgctcagctataggtaccagaattttgatcaaaatttactatcattgtgacacttctcttcggaactggaaggccagaaccccacttgtaaagtgctgggaaaatacaaggaaaatttagggtgagtagcattttgaattcttacacatggaaagtaaatgtataagaattcttaccaataaaaaaaaagcaagagagaatagctgctaaagaattaacacaaatatgtatatattagttattctcttttctcctctgattccagaggactttgtaattccactaattcttcttgagcttccaggatgatctgagacttgaatttttcatgtgctttttgcttcctatttggcagcatcttatcttgaagtttccgctttctgcttggggacctaaaaactaactaatgggaatttcttcaaaatgagcaaactctggtgaattcccaaagcggaagaaacaagtgaggatcgggctggttaattaagagaacttttcctgaatgtagccagactgtttgccgactgttgttaacatgagggaagaaatacccctggattttagaagagccccttgtttgttttccttggccatttgtgctgcttgttttgtaagtcagaaatttcctgaaggactattattagctttgttctcacgtcagaaaacttctgctctggccacttttaaacatataacttggattttactgtattagaaaatgtaacaattacagacagcactaaaaggacaccaaagggcaaagaaaatgggtaacttttttttcttccccaaatctaaaataggtgattttggagaagtaggagaaaaacctggattttctagatctctttagagctcaacaactgatatagttaattatgtaagtctttgatatttggaaatgattggattaaccggataacaatgaatatttaaatacagtgatttggccaggagcagtggctcatgcctgtaatcccagcatttggggaggctgaggcgggtggatcacctaaggccgggagttccagaccagcctggccaacatggtgaaaccccatctctactaaaaatacaaaattagccaggcgtggtggtgcaagactgtaatcccagcaactcgggaggctgaggcaggagaattgcttgaacccgggaggcagaggttgcagtgagccaagatcacgccattgcactccagcctgggcaacaagagcgaaattccatctcaataaataaataaataaatacagtgatttaacacaagagatttctatttcacactaatgagctctgtcactggggcaagcttctttgcctcattaagtctcagatttcccgagagcttatttatttataccaagagtgctttactaccgtctctgctagctgtgacataatatgacaaaaggtataaatatgggaaaaggcactaatttatatcaaagcgttcttcgtttttccttgctgtgaagtttttagctaataattcataagaatataccatatttagagtgtttactatgcatgggcctggcacttcacatacattgcttcttacaaattttacaaagtgaaaggtagatattaatctcattttatggaggacaagatagagatctggagaggttacataacttgccagtgttttttcagttaataaatggtagggtggagattcaatctgtgttactctaaagtccgtgtcctttttattggctccatgcctactcagatttaaatctcagcagggaagtaaaccttagtttttacatgagaaaatgttacagcagccttctcggcttcctttacccccatcccagtttcacgagcttagtgccttagatcgggttcctttagaagcagacctcgaaataaggatgtgggtgccagtcatttattgaaaagatgatcccaagaaagcctagtaggagagtgaggaagtgagatggggaaaggaagaaactccacaagaagtgtgttaataagcaggttaccgctgtgggcagccatggggctcagctgcactaacaaactctgtctagtacagaaaacctcagggtctccccaaggaggggcaagaagtctgcctagggtatatatccgccaactcagtcactggctgagagctgatcctgggagggcatggttaattcctctgcactttcaagtggattcctgtggtcagaaaaagccctctacaatgaattccagatgcttgtatttaaatctgacatgatctgaatgctgtgttgggacagggtgggcgttattagttttctgtcattactgtaacagattactacaaacctgatggctgcaaacaacacatatttattatgtcatagtttgtgtgggtcagaagtacaggttagctcaactagtttctctgctctaggtttcacattgccaatatcaaggtgtcatccagttgggctcttcttgggaggcttggggatgaatccactttcaagctcattcagattgttggcagaatccagttccttgtggttgcaggaccaaggtccctgttgccttgctggctgttggccaggagtcattcttagcttctagagactacctgtactctctgactcgtgtctccacttcacctttcaaaccagcagcggctagtcgagtccctctcttcaaatgtctccaactgtgccttcacctcatttctcctctgtgtaccatgtctgcctctactgcttgtaagggctcatgggattacattggatttattcaatccaggataatctccatattttaaggctagctgactagtgatcttaattccatctacaaagtcccttccaatagtactgtattagtccattttcatgctactgataaagacatacccaagactgggcaattcacaaaagaaagaggtttaattagatttacagttccacatggctggggaagcctcacaatcatggcagaagtcaaggaagagcaagtcatgtcttacatagatggcagcaggcaaagagagagagcttgtgcagggaactcctctttttaaaaccatcagatctcataatacttattcactatcacaagaacagcatgggaaagtcttgcccccatgattcaattactcccaccaggtccctcccacaacatgcaggaattcaagatgagatttgtgtggggacacagccaaaccatatcaagtacctagattcatgtttgattaaacaaccagggagcagaaatcttcaggagtggggggcatctttagaattctgcccaccaaggctgggcgcggtggctcacacctgtaatcccagcactttgggaggccaaggtgggtggatcatgaggtcaagagatcgagaccaccctggccatggtgaaaccccatttctactaaaaatacaaaaattagccaggtatggtggtgggcacctgtagtcccagctactcaggaggctgaggtaggagaatcacttgaacccaggaagcggaggttgcagtgagccaagattgcgccgctgcactccagcctgggagacagagcaagactgtctcaaaaaaaaagaattctgcccatcatagtaggctgtcctacagagacataacccaggaattaggtgaatggctaacctaaattagcactgtgatgtgttttctgacttggtccttatagctcctctgcttagatgtggaactaatccatgaatgcaagggtttgtctagagttttaagtgggagttaaatatccaaagtacaggagatattatgggtgcctcatccatgtccccttggcatttatctttcttggataacccaactctattagtttttatatctcacttgttcctatactctgtgaactgatgtcccataaatagacatttcattttgccagtcttcttgaacaataattacgattattaatctagcagttatcattaattggccacttcacattagacacagcacttaggacttaagaataccatgtcatttgatcatcataatatggtcaggaattaagtattgctatccaaattttacaaagaaggcactgagggttagagtttaaataacttgcttaagatgtcatagcctgtaagtgacaaaactaggactcaaatacaggtccatctgactccaaagtctatgttcttggctaccacactgcctctcctacaagtgacctgtggttttactactatattcacactctactaactttaccatctcccatgagtctgtctagaggagggcacacacagcacagaaaacacatgaatgcaaaataaggaagggcctacttactacacagagccattctaatacctgatgtttgctctaatccagttttactattaattagttgctggtgcccaagtttttactgagaaatggggataattttggaagtcataatgatgccttcttctcatagggtattttatttgttgttgtatctccaggccccaacacagcctggcttttagtaaatgatcaaaaatacctgttgaatgaataaatggagtcacctgaaacatgttaaacatttgttcatgtgtcctaatcgtggatttcaggatagtaagcatcctaaaaggaaagcatgcacactgttcttgctacattaatttctcacaatataaaaaaagaaaagcatctgaaaaaagctgccagccgctgtgtctcctaatatcaaactgagcacagatatggagaagctaagggagagggatgatgggccatgcctctaacctcatcatggcaaaagtcctgggggtcagacccgaggagagcaggaagtgtcttttgagggatacatttccacagtggaaataatgagacttaaataaatattatatacacagttcaactgtttttatgtgtaaaggtagtaggttttcacagtaaggaagcacttctttttttttttgtttgagacagagtctcgctctgtctcccagcctggagtacagtggtgctatctcggctcactgcaatctctgcctcctggattcaagtgattctcctgcctcagcctcccgagtagctgggacaacaggtgtgtgccattacacctggctaatttttgtatttttagcagagatgcggtttcaccatgttggccaggctgatctcgaactcctgacctcaggtgttctgcccgcctctgcctcccaatgtgctgggattacaggcatgagccactgcactcaccaagcacttctactgatagcatttacaaacccttcttagaatatttaaaaattctaagagaagagtaaattgagccttcccaactaatactaggaggttataaccttcataccaaaactggacaatgcttgcacaaaagaaggaagccaatgaggccacctagaaggaagactgggcattgggcccagtgagtcctggaaacctcatctgtgccagccaccccggcatggcctgtatgagtggatgagggtgacttgtccacagacaatagccatctagctgtgataaaggagtcaaggtagtcagctgcatctctttcacctgtttgccaatgttacacaggttgaaaagctaaggtttatgtaaagcaagcatcaaagatgatgaaatgatcaacctgacaatgagtactatgctgcattgtccagaaaggaactgtggaagattttgggctgaatttcaaaacagaatttcctcactctctggatgttggcttacttggcctttgatgttcagaggtggtgcctttgtgttgttgaacaatgttgattttggagagaaaacagagttgaaaaacccacaagtcattccctggggagtattaccggaatacagaggataatttcagcaagccagcaaggcctcatctctgcttctaatagataggaagaaaggaagagaggaacaatacttttttaagaagctcagctttatcgccttatctcatagaaagatgcctccagtctgtctggctaaaggtaattggcatgggaaagtctttatctgtgattctaacaagtggaatgtttcccttcattaagagagccttgtctggcttggggaaatgaaacactttctccgatatgagtgggctgtaacccctgctactaaatactcagaagaaataaggcggttgtggagcagtcaggaatgagtcacttgcctccctggaatattcagaaaactgaatcaaaagtacattcttctgggttttcttagtctaatagactaagggtctctactttgttaaatttctgggaaacagcatagaatgggagaaaaaactggtcactgtagtcatgcaaatctgcaaaacaaacaaaaaagtctgggtattgctgctaactagctatgtgaccttaagcaaggtattaactctctctgaatttcaggttcttcatctgttaaatagcatatctgtaaaatgggaattattttcatatcataatgctgtagctttaaaaaataaaataaaatggatgagataatcagaattaaagagcctgggatatatagttaatatatagcagcatgtaaagatcctgttagaaatgctaattttacagttaaccatttggagatgatccgccaaagctgctagtgtagaggcaactgagaatttgcctgtccttcagaatatgaataaataactgtcaatgatgtctcaagcctagaaaaacctatccatctggatgggtgggaaatttctaggctagtattgagaagcccatttcttgggaaataggtcctggactgagtgaaggaaaagaaacagtaaaacccatggtaaagcagcaaggctctctagaggctctggagaggatgaattgaattctagaagatgaagtagggaagacgctttaccttcttgtgaaatggattcaaagattcaaagaccttcgggaatctccaattgtataaatggcaccatagctgtatgttccatggaacactacttcccagagatgcccagtgaaaaaagaatgccacagtcaaataagtttggaaacactccattatgtggccacctccttgaagactctaatgcacattagcatgttaaacagtcttgagaagtcctgcagagcagaaattgcttcacatctgctaagccggcagtttcccaatatacttgattatggatagttttttccttacaacaccattctctgatatgcttccaatgacatgaaataaatatatatgcatgaggttcttcattagggcatactttttaatagaaaatattgagaataatctaaatataaatgcacagcatttaccttttctgcataaactatatacaggcataccttggagatactatgggtttggttcccacaatatctccaaaaccacattcggttttatgaccactgccataaaaccagccacatgaattttttggtttcccaatgtatatcaaagttacatttttactataccatagtctattatatatacaatagcattatatctaaaaaacaacgtaaacaccttaatttaaggctgtggctggtttgattttctacccagaccactaaaactttcttcatatcagcaataaggctgtttcactttcttactattttttgtgatagcacttttcctttccttcaagaatttttcctttctattcacaatttgtttgatacaagaggactagattttagcttatctcagtttaaggtgtttacattgttagctaaaaatgctaatgatcatctgagacttcagcaagtcataatcttttgctggtggaaggtcttgcctcagtgttgatgtctgctgactgggtggctttggcaatttcttaaagtaagacaacaatcaagtttgacatatcaattgacccttcctgtcataaatgattttttttttctctgtagcctgcaatgctctttgatagcattttacccacagtagaattttcaaaattggagtcaatcctttcaaactctggtgctgttttatcaactaagtttatggagtattagaaatcccttgttgtcatttcaacaatgttcacaccatcttccccaggagtatattctacctcaagaaaccactttctttgctcatctataagaagcagctcctcatccactaaagttttatcctgagattgcaacaattcagttacatcttcaggctctacttctaattctagttctcttgctgtttctatctcatttgtgcttactttctccgctgaagtcttgaaccccttaaagtcactcatgagggttggaatcaacttcttacaaactcctgttgatgttgatattttgacctgctcccatgattcatgggtattcttaatggcatctagaatggtgaacgttttcagaaggttttcagttggctttgcccggatccatcagacgaatccctatctatggaagctatagatttataaaatgtatttctttttttgtgggggcatagcgtctcaccctgtcacccaacctggaatgcagtggcacagtcataactcactgaagactcaaactcctgggctcaagtgattcttccaccttggcctcccaaaacactggattacaagcttgagccactgtgtctagcccaaaatgtatatcataactaatgaggcttgaaagtcaaagtgactccttgatccatgggctacagaatggacgctgggttaccagacatgaaaacaatactcatctcctcatacatctccttcagagctcctgggtgagcaggcccattgtcaaatgagcagtagtatcttgaaagaaattttttttctgagcagtagatctccacagtggacttaaaatagtcagtaaactatgctgtaaacagaagtgctgtcatccaagctctgtttttccactgatagggcaaaagcagagtagatttggcataattctctagggccttaggatttttggaatggcaaattgagcattggcttcaacttttttttttttttttttttttgagacagagtcttggtctgtcacccaggctggagtgcagtggtgcaatctcggcccactgcaagctctgcctcctaggttcacaccattctcctgcctctgcctcctgagtagctgggactacaggcacccgccaccatgcccggctaattttttgtattttagtacagacggggtttcgccatgttagccaggatggtctcgatctcctgacctcgtgatccacccgcctcggcctcccaaagtgctgggattacaggcgtgagccacagcgcccagcctgtcttcaacttaaagtcgccagctgtgttagcctctaataagagagtctgcctgtcctttcaagctttgaagccaggcatcattctcttctctagctatgaaaatcttagatagcatcttctcccaataggaagccattttttatgccctaaaaatctgtcgtttggtgtagccaccttcatcattgatcttacctagatccgctggataacttaccacagtgtctacatcattacttctgcttcaccttgcacttttatgttatggggatggctcctttcctctaacctcataaactaacctccactagcctcacattcttcttttacagcttcctcgcctctctcagagttcacagaattgaagaatgttgggccttggattacactttggtttaagggaatgctgtggctggtttgattttctatccagaacactaaaactttcttcatatcagcaataagactgtttcactttcttactattttttgtgatagcacttttcctttccttcaagaatttttcctttctattcacaatttgaccgtttgatatgagaggcctagattttagccaatctcagtttacaccatgcctttttcactaagcttcatcattttagctttttatttaaagtaagatgtgtgacccttcctttcatttgaacacttacatgatgatgcctggcttcaaagcttgaaaggacaggcagactctcttattaggggctaacacagctggcgacttttaagttgaagccaatgctcaatttgccattagaagccattgtagggttaattaatttgcctaattttaatattatggtgtctcagggaataaggaggcctgagtagagggagggagatggggaaacagccagtcatcagagcacacacaacatttatcaattaagtttatcaccttgagggcacaggtcatgatacttcaaaacaattacaataataaaataaaaaatcattgatcgcagatcaccataacagatataatgataatgaaaaatttgaagtattgtgagaattaccaaaacgtgacacacagacacaaagtgagcacatgtcattggaaaagtggtgctgatagacttacttcatgcagggttgccacaaatactcaatctgtaaaaaattcaattatctacatagtaccataaaaacaaggtatacctgtttatataatcaagaccaacagaaccctagagaaaatagctcactccctagctcggagacattctaaccaacatacacttacctttctttttgctgtgtacagaattcaaatccctgtctcagcaaaattgcaaagtatcaaatgtcatgtccatctaatactcaaaactgcaaatgttaagtcttgtaagcccagagaccactgtatatacaagtgttgctataagcattagttcttctccaaagaaaatagtccacttggtagaaacaaacaaaaagaaaaaaaaagaaagaaaaaacattttttacaagaagattcagtctcttacctacataagcaaaaatatgagatgttctcttatcatttttccatctatcttataatctttggtgctgacttagacactcattttcctttttgtacgtgaccatgtaaaagttcaagtcaagaaaaacttgttttgacatttgttttgctgagtgatgggtccctaaaagaaatttggctttgcttttgaaaagttcagcatgatattgtgtgaatttttcatggctaatgatttttagaacagttgtgatgtgtttaggtgttttaagaatatgaagcattcagtggtttaagttggttgttataaaatgaaagaatatgaaggaaagccttcttgtcttagaacacactgattcacaaataagcagcttctctcaaaatgttgtaattacaaaaattccaaggcaaatataataaactccttgtcggtgctatgtctagaaacttaacagccccaaagaaagtcctgacaaggcaaaaaatatatatatatatacaaattgtggaagcagggtgttgaaagaagaataaagactatataaggacaaactgtttaaaagggagggtatccttgaaagcttgacacttgactcttttgacgaggctgagggaaaacactcagtttcatagattgctggtacggatgtaaaatagtgacatccctatagagaggaatttggcaatatctagcaaaagtgcttatgcatttattctttgacctagtaatcccgcttctaggattagtggtgaagatacacctcaacaataaaaatatatatacattaggttattagttatggtttaatttttaatagcaaaatatttaaaacaacctacatgaacaaataggagacttactgaataaactatggtatatctgtacaataaagtgcaattcacttatgttgttaatttgttccaaaaatccagagccaaagagtatttgttatgctctctttagtataagaaaggggaaataagatatgtgtgcatctgtttatttttgtgaaaataagtacagaaaggataagtaagaaactagtaaaactagttatctcctagtgttagtagaaatagaatgaaagtgaattaggcttctttgagtatatgtttatatatagttttgacttttgaattatgtttatgtttacatagtcaaaaatataaattaatcaacagaaataacaaaaaaagaagaaatcacaagctttaaaatttaatacaaacagaaataattgaatctaacagtatatcaaagtgataacgtaaactcagaagaaaaaaacataatccaacataccagtggaacacaatattctaactgtatacattcagtggttatagtctaaggacaagaaaaattgcaaaaatatcttgaactttagcttgtaggatttttattggtagcaatactaatgtactaattctgaaattaatgttcgtgtattatagaattgagtaaatgaataaatatgttgatgttattgggaactaaaattatcattctgggagtagagaaatataaatatggacttggcaaatgaaacaaagacctgcagagagataaccatataaactcattattttaaaaattataagtgtcctagctctgttactgaaaaggcctagattcaatcttatcttgatagacaggagggcacccctttctcagaacatggtttccaaatgccattctccattaaaaggaacaaggtcttcttggagaaaagactgattctaggtctggattaggtaaagtacaacgttagtctggaatttcttgctgaatcagaagtaagaaagtgctcaaaaacatgggaacatgtcacaaacacacgtgaggcaacttgaatcctcactggccatatttaggacaatcgagcatcaaaaaaaaaaaaaatgttgagaataatggattctaacacttaaaacaaaaaataatccatagcccacagaaggggaagagagggggagctcttatttacagatgaatatcaaatagcaaagacagaagaaatgacagaattagagaaacatcattttgcaaaacaccactgtaataatcaattcaggcaagtattattaatggatgtattactattgcgtaaaaccagttggggaacaggatattcatacagtctgaaggtgtcaccctaaacataacttattacaagtggaaaatggtgcctttacaatgaagaaatctagcagaaaccatcttaatctagtgatcaaacttagtatcaccaataatggatcatactgagtcatgtgtctcctaatatgatgcaccaggaaggatgcaacgtcatgaacgttgtattcttttgtattcaacagaccacccagggtaaaggcagctttctcacttactaatcagaattgttggttttaattcattttggattttaagatttcttactttcttgtcagctcagaaatttatttaagatgatttttatcttttattcaatactttagcttggagaaccattcagagtttctaactcattgtattgccaaaaatagaaaacagcatggtttcttttgaaaatgtctaactttaaagttacttgtgtgtgtcactcagattcacatagcttttttgcctagtaatgtagtatcatgtggcaaggctataaaaatgtttacaatcttttatttaatatgactcttgagagtttattctaaggaaataattgaatagtaacaaaacactattaacacaaagcatagcaatttgatttgggcaaccaaacactggaaacaacctaaatgtccattacaggaatcatttatgaagcaaacactaaaatatttattgtgaagattatgagaacatagaagacagttatgagagtaaatttgaaaacctgaacacaaaacttacatatactccaattgtaacttataaaaaatacgtgcatataaggataaaacagtacaaacaaaaaaatagttgcgttagattggtagaattatggctccttttgctgtcttaattttttccttttacattttgatacattattttaattttaattttaaaattcaaaagaatttgccactcatctttgccacttcaaggaaaaaagaaatgtgttcgattattctgttcttagtatagttttggcaatttcctcacgtgtaaaaagagaatactattaataatttcagtatctataagacaatataaaattaaagaatctagcccagtaactggtacatggaacgtaattaataaatcattatggactttttttctcacacccaagtagggaggaatcagtggtcccctagaggcccagtgtagaggtggcagcaccaatccctaggggagaagatcttggtgatgataattcctgagcagacagttagctgagaattcaagagcagaaaagtaagaaagaaacaacttcttgctaacacctttccacccacgtttccctgttctgttgtactctgcttaccctttcatggatggaggcagaggaaagagaaccaagtttgctcttagtcattcactatgttgtttaatctgccttccatctttcttatcagttcaaattagaatgtagacctgaatttaaatccccgttctgtcagttataatgtgaccctagacaaaacacattctctgaacctcagagaacattcttcatttgtagaatgggaagattaatctatattccacttggatggcaagtcttttataaactttataacctaaacatgtgtgagttgctagtatcattatgttggtaaagttattctgagatatgataacagaactgttttgtctaactccactagcatggttcaggtttagagagtgtggaattaaaaggctttatcctcaaatatgacttaaatccgatttttctcatccactttcctccacaaacaaatcctcaggaaatgacaaactttacatggttaaacatcagttttgtttagtctttgacatccacatggttaaatcatacatttgaaaactgcttatatttgtgttgtctatgtctaaattgaaaagacttattgaggaatagaagactacacatttttcagcaaacactgcacgttttgcagaatttccccaggcaccagtctccaggaatttattggctactaacaatactaagatatggatgaatgaggaaatcaaaatggagatcttgcaagttttgtgagaatgggtgaatggtccaaatgaagagataagttgtgaaatattagtacaagtaaaaattatttacaatgaaagacattttgtcaatagctatgagaattttaccattgacccagaaattccatttctttcttcagaaatacccacgtaggtatacatataaaaagttattcattacagtatcgtttttcataggaaaaagttttaaaaatcagaagctatctaaactatggtatatctaggtcatagaaatcaaatgactaaaaatgttaatataagcatatgtttttaaattaacttggcttgggtcttcagcaaaattggcttcttaacattgcactccagagttagacttacccactcagtcacttatcatgcaggagcagactcctaataccacatatcatagagcagagtaggacacaggttctctgcaggcaggcaaatcccaaagagaagggaggaaagggctgagacactgcatggtcaatttcttctgaactctgcaatgtacggaggtggacagtgtccacaaagattgctcccctggacccaccatcataataacacaacggctttgttttgtttttgtttttgttttttgacacggagttttgctcttgttgtccaggctggagtgcaatggtgtgatctcgactcaccacaacctccacttcctgggttcaagtgattctcctgcctcagcctcctgagtggatgggattacaggcatgcaccaccatgcccagctaattttgtatttttagtagagacgaggtttctccacgttggccaggctggtctcaaactcttaacctcaggtgatccacccgtcttggcctcccaaagtgctgcgattacaggtgtgagccaccgcgcccagcccacaatggccttttgtttacatctctagtgcagcactcatttcatgttctttcaagaagaatacatatttcatctttttattttatacagcaattagcacagtgcctggcataaggaaaatgatcattaaaagctgggtgaaaaacctaataaagctactgaggataggaactgcagaccagcatggaaagaaaactatgagccagatattgacatcatcctgaaaggcagaagatttagtataggcaagaagtatgcttttggaatatagaaaatctggattatgataagaaaagaatcatatttgtcttatcttacctactcacttctcagttccacatgtttctgaggctgtttgtccttactttcttttctgttttatccactctttctgttctttagattggatcattcctattgagctgacatcaagttaactgaccttttattttgtccaaactgctgttaaatgcatccagtgaatttttaactttatatagtatatcttttagtcctagaatttccacatgagttttttaagtttccatttctctgctgagatctcctatttgttcattcattatgaccatatttttctctacattattgagcataattataacagctcttctaaaattcttgtctgcacattctaacacctgaattattctggggtcagtctctgttacattgccttattacaaaaacagtataagtcacattgccttgtttcttaatatgcaaaatgatttttgattgcagactagacattttgaattaaacattatagagattctggattctcgagagagtattgacttgttttttccatcaggcaggtaacttgactggactcaaactccaaactctaggtcctctgtaatgggcaactgcagtaatctttgtttagttctttaagacttattggccaggcacgggggctcatgcctgcaatcccagcactgtgggaggccaaggtgggaggatcacctgaggtcaggagttcgagaccagcctggcccacatggtgaaaccctgcctctactaaaaatacaaaaattagccgggtgtggtggtgggcgcctgtagtcccagctactcagaaggctaaggcagaagaatcacttgaacctggaaggcagaggttgcagtgagccgagattgtgccactatactccagcctgggtgacaaaagcgagactccctctcaaaaaaaaatttattggcactgcttggcatctgctatgaatacatgaagttcatgggtcagctatagatctgggcacgttatacacagaatttgggtctccctttctctggatttctccttttctggatttcttttctcattttccagcagctgtggttgccctaaactcggtcctctgtttctttacggcagtaagatttgggaacttttaggttttacctgcctctcagacaaaataaaaaataattttcatcttgatgctactcctttcttccagatgtagacacctctctaatttccagttgctttttattgctctccagagtctaaagattatcattgttttctgtgggagagttggtctgataaaaactactcccccaaaactggaagctggaagcttgtaattatgaatagactttgagtagtattcttctttggaaaaggattttaactactccctatgtacttctttatttcctgtttttctcatccgtaatctttttattttcatacttcctaagtcagacaattttcctacttgaagattcagtgactgctatcaaatgacccccatattactaaatacaatatccccaactgcatttataaaaagaaaatttactgtttattagtaaacaatgttgtagaatagtaaaatattgctgggctttggagccagataatcaaggttagaatcccagattctaacttactagctggtgtattagtcctttctcatgctgctaataaagacataccccagactgggagactgggtaatttatgaagaaaagaggtttaattgactcacagttcagcatggctggggaggccttaggaaacttacagtcatggtggcagcaaggagaagttccaagcaaagagggaaaagccccttataaaaccatctgatcttatgagaactcactcactatcacgagaacagcatgagggtaactgccctcacgtttaattaccttccaccagttcccccccatgacacatggggattatgaaagctataattcaagatgagatttgggtggagaaatagccaaaccatataattccacccctggcccctctcaaatctcatgtcctcacatttcaaaactcaatcatgccctcccaactgtcccccaaggtcttaactcattccagcattaagtcaaaaatccaagttcaaagtctcatctgagacaaggcaagtcccttctgcctatgagcctataaaatcaaaagcatgttagttacttcctagatacagtgggggtacaggcgttgggtaaatacactgattccaaatgggagaaattgccaaaacaaaagagttacagaccccatgcaagtccaaaacccaatagggcagtcattaacattaaagttccaaaatgatctcctttgacttcatgtctcacatccaggtcacactgatgcaagaggtgggcttccaatggccttgggcagctctgcccctgtggctttgcagggtatagcctgcttcctgtttgctttttcacaggctgacattgagtgtctgtggcttttccatgagtatggtgcaagctgttggtggatttaccattctggggtctgggccaggtgcagtggctcatgcctgtaatcccagcactttgggaggctgaggtgggggatcacaaggtcaggagatcgagaccatcctggctaacacggtaaaacccagtctctgcttaaaaaatacaaaaaattagccaggcgtggtggtgggtgcctgtagtcccagatacttgggaggctgaggcaggagaatggcgtgaacccaggaggtggagcttgcagcgagctgagattgtgccactgcactccagcctgggcgacagagcaagactccatcaaaaaaaaaaacaaaaaaaccattctggggtctggagaatggtagcccttacagcaccaccaggcagtgccccagtggggactctgtgtgggggctctgaccccacatttcccttctgcacggccctagtagaggttctccatgagggttctacccctgcagcaaacttctgcctggacatccaggcatttccatacatcctcggaaatctaagccgcggaggttcccaaacttcaattcttgactcctgtgcacccacaggctcaataccacatgtaagccaccaatgcttggtcagggcttgaaccctctgaagcaatggcctgagctgtacgttgacaccttttagcctagacatctaggacacagggcaccatgacccgaagcttcataaagtgggagggccttgggactagctgaggaaaccatttttccatcctaggcctccaggcctgtgatgggaagggcagccatgaaggtgcctgacatgccctggagacgttttccccattgtcttggtaactaacattcagctccgtgtgcagcaccaacttacttatgcaaatttctgtcactggtttgaatttctccccagaaaacaggatttttcttttctattgcatcatcatgctgcaaattttcaaacttttatgctatgcttcctgttgaagactttgcggcttagaaatttcttcccccagatacccaaaattatctctctcaagttcaaagttccacagatatctaggggacaaaatgttgccagtctctttgcatagcaagagtgacctttactccagttcccaacaagtttctcatctccatatgagaccatctcagcttggacttagttgtccatgttactatcaacattttggtcaaagccattcaacaagtctctatgaagtttcaaacttccccatgttttcctgtcttctaatagccctccaaatttttccaacctctgtctgttacccagttctaaagtcacttctacatttttgggtatctttacagcagtggcactccccatggtactaatttactgtattagtctgttctcatgctgctaataaagacttactcgagactgggtaatttataaagaacagaggttcaactggctcacagttcagcatggctgggaggcctcaggaaacttacaaacatggtggcagcaaagagaagttccaagcaaagagggaaaagccccttataaaaccatcagatcttgtgagaattcactatcatgaaaatagcatgagggtaactgcccccatgattaatttacctcccacagggtccctcccatgacaggtggggattatgggaactacaattcaagatgagatttgggtggggacacagccataccatgccagctagagagccttaagaaagtcacctaatctccacaaataaaaggtttcctatttgttcaacaaaaataatgacaccccttttatgggatttctgtgaggacaaatgataactaacatagccttgcatagtgtctggcacaaaatagctactcaaaaaataatagaaacaacatttaaaaaatgtagactttattttttagagttttatgtacaaagcaaaattgagcagaatgtacagagagtttccgtatagcactccctacccccaagcacagatagcctcccccagtatcagcatcccgcaccagagtggtacatttattataactgatgaatctatattgacgtgtcattttcatccaaaatccatagtttatattagggatgcctcttggtgttgtaccttctatgggttttgacaaatgtataatgacatgtattcaccattacagtatcataaagaatagtttcactgtcctaaaaatctttgatcttcttcctattcatcactccctccccattaatccctgacaactactgctaattttcctgtctccattgttttgtcttttcctgaatgtcatatagtttaaatatacagtatgtaggattttcaaactggtttatttcacttagtaatatgcatttgatgttcttccatatcttttcaaagcttcatagttcaatatttatagaattgaataatattccattgtctggatgtactacagtttatgtattcattcacctatcaaagaacaccttggttgcttccaagtttcaacaatcatgagtaaagctgctataaacatctatgtacatgtttttttgtgaattgaacattttcagcttttttagctccattcctaggagtgcaattgctggattgtatgataagggtatgtttagtgttgtaagaaactgccacgctcttcctaactggatgtactgttttgcattctcaccagcaatgaaagagttcctgttgctccacatactcaccagcatttggtgtcgtcaatgttttgagcaatagcattttgatctaacttttcctaggtattctttttgaaggaaataatatgacagataatagagaaaggatatacgaggacagttctgtcctttatttatagtccatcatttaatgaaggactctgtccacacttggtatttttaactctgatcctcctctcccatgaactctgacaatctcctaaatccctgttgctggcacacatggttgtgtatcaggccccctgtggtctgtctgaagcatggctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttgtatttttagtagaggcggggtttcactgtgttagccaggatggtctcgatctcctgaccttgtgatccgcccgcctctgcctcccaaagtgctgggattacaggcgtgagccaccgcgcccggcctttttttttttttttttttttttttgagatggagtctgtcactctgtcacccaggctggtgcagtgatgcaatcttggctcactacaacctccatctttcaggttcaagtgattctgccacctcagcctcccaagtacctgggattacaggtgcccgccaccacacccagctatttttttgtatttttagtagagacgtagtttcaccatgttggccaggctggtctcattcctgaccttgagtgatccacctgccttggcctcccaaagtgctgggattacaggcatgggtcatcacatgtggcctgaagcatgactgttgctttaatcatatgaaatactgctctgtattgttatctatttgaaatgccacacctcctgagctaaattgcaagcttttatggagcacaaaccatatttatatatattagcatgataccatgacacatatcaaaagctgttatatattgttacgtgaattgattctttctcagttaagaggacctctgtagtagcactttcataccgttaatttttcattttgtgcccagcccctactctgtgaaaaatgaaatgaatcctgttatcatttccctcccaggccttttctccttgtggacaatgtgtggctcaagagaaaattcagtcagtaaatttgttcagtgcacaaactctttatcacctctcactgttctcaagtgagatagaacagaacatccatccagtgtcttacaaattgtctggtatatagtaggcactcaataaatgttttttgaataaatgcatacatgaatcctattcctatatatagtatggtagacagatcattgatacccaaagatgcccaaatgctgatccccagaacttgtgaatatgttacatttcatgtcaaaagggactttgctaatgtgattaaggattcagacccttggattgtaagattatcccggattaaccagggccaatctaatcacatgagaccttaaaaaagcagaaaacatttcccagctgggttagagagagatgagacagagtaaaaaggaaagagattcagggcatgaaaatgactctacccactgttgctggctttgaagatagaggaactaggccacaaaacaaggagtatgagtggccttaagaaataggaaaaagccctcatctgacagccagctagaaagcagtcctctgaccacaagaaattggattctgccaaccactcaaatgagcaaggaaatggattctcccctagaacctccagaaaggaacacagctctgtaatgccttgattttagccaggtgagacctgtttcagacttttgacctatggaaatataagataataaagttttattgtatgctgctaaatttgcggtagtttattactgaagcaatggaaagccaatacagacagaatatacagagagaaagagaatgagttctttcctgataatttgtaaatatttgggtcttcactggacaagcttcacagaggattcactggttccctagcaaaccagcatgtccagtcctgcagcctccctttcttaggcccagcatatgtcagctgtgtgcatagaaaaatcaaagcaggaccctgagtagttggaaagaaaagatggttggaaatgggttgcacttcaagtgaggaaacaagaggtaggagaccggcatctctttctcatatgtcccaggctgactcttgtgagttgttttcccttggaggctatcgatgacagtcacagtaacctgatggaacctggatcatgatgaaagaagtaagtgtcaatggctccgacttccaaggactctgatgtcccacagcactagctaaacaaagccagttggaaatgagcttaaatggggaatttcctgaatatattccctattgttaggaagccaggttggcttccttgcctacaattatgccaagcagtcacactatagagtccctagggacatgatattaagtgattcttttaacacaaacaacttaataatcatttatactaatagcaaaacggccaacggctgatattccacttgaagtagaattggctatccaactggaagagaagacaggaagacgtgatctccagggagccactaaaaggattggcacctgcctctggattccccttttccttatattacctctcagcactggcaggcctttatttcaggatacagtttcacaagtattatgtcacgtctctgagaattatgttggtagatatttgctcctctggccagaaagacctagtttggagtctggagtcatgaaggtgacatacatgtagctagtgacataagtgtagctagtaaaaatagtgagtaatggccctgaaattctattgaatgcccaaagtgctgaccaggaacaagcatgctctagcttatctcacaaggaacttgacaattttcttcaaaaatcctagtagctaagatttcttagtaacaaagccactaaggcacaattatgattaacttgacccttaggtgacttttaaggactattctataaaatattacaactaatagtggatccaagccagcacactctgctatataagattaattgacagtgtccacactggtaaaataagttgtttcataaatacattagaattcatttgcactttctacacagccccaagtccagaactttccccagaataggtctatgttttgcaatctgctactccatacagagatttgagttcacttggcaatttagtgctgcttatatgtgaccagttagtctgttttacttatctatgccttaaacattactatacttactaactccaagatgcctggtctcaacttgacaaaaataccccaagttgggaaatccttatgtgaatatgtagatagtcacaattgctggttgatgatgatctgtcttttcctgtatttgagaaaatggagataaaatggaccaatccaaataatggattaaacatgggaataggtgagagagagagaggaatacatggtggctctcagtgtctggcttaggcagtaaacactttcgttaataaagacggaaaataaaaaaggaataattggtgtctaggggaaaataatgagctcaagttttaacactctgagttcccggatgtgagacatccaggcgcatttatccaagaggcagttggaagcaacgttccggagcttaggagagaggcatgaccaaaagctggtgggactgtgaaaaggtatggccattctggaaaactgtttggcagtttcttagaaaattaaacatgtactaacaacccagcaattgtactcttgagcatttgtcccagataaatgaaaaaaaaaaaaagcattttttttacacaaaaacatatacatgaaagttcatagaagtgttattcataaaaaactggaaaaaactgagatgtctttattgagtgaatgcttaggcaaacggtggtctatccatacaatggaattatgcttagcaataaagagaaaagaactattgatacatgcaataacacagatgaatctcaaaggaattaatgctgagtgggaaaaaaagcacatctcaaaatggtatatactgtactattttatttacttaacattttaaaaatagcaaaatcatagagatggagaacagattaatgggtactgtgttttgggatggggagtgagaaaagggtaaggtgtaaatataaaggggtagcacaaaagagccttgtggttgaaggattctatgtcttggttgtagtcgtgattgcaggaatctacatgtgataaaattgtatgggtctacatacgcatacacacaagagcatataaaactggtgacatgtgaagaagctccgcacattgtgccaacatcagtatcctagtttcaatatcagactacagttatacaaaacattgtcattgagggaaactgggtaaagggaacacaggacatttggcatatatttttgcaatttcctgtgaatccgtaattatttaaaaataacagatatactacatatcaaaaatttaatgtcataaagttgatgagtttacctagtggatagctttgttaatatctgctataagactactgaaaatgacagttatgcaagtataagctcagagaactttcctcccccttcgtaaatgaaatgagcaaaagaaatgaaacaggaaaggcaagcagtactgaaaacagggaagggctcttccccatataactatatctgcgacttcaacagctattcatccagaaacacagcctcttgcgctaagaggaaactttggataacaatatgttttcactctccaagagagaaaatggatagattaatttttaagaaaaaaaaaaaaacctcaccaatttcatgctgtggcttgcacctttaatcccagctacctacaaggctgaggtgagaggcttacttgagcccaggagttcaaggctgcaatgagctatgattgattgtgctatcgcactccaacctggagtactaagctaagagctaagaacacagctgagagcggagaagaaacaaacaaatctgaccaataacccccactcccctcattttactggagtgagctgagactgctggcaaacatggcctttgacctagcctgaactgtagcaaaagtcatcagatatttttccaccaatcaacagacagaagtggggagaaaacaatcgtagttcataactacaacaagcagataaacgaaggccatggtgagggatggaagacattgtgatatatcaaaggcaggctcatttaaaactcaacccaaattccaaacaaaatatataattgaatatgtattaatgccaaaggagcttgagtgagctttagcacaaaccccgccctccagcccccacccaaaaaaatcactctgttctctccccattctttgataggcatacttgctgttttctcacagccaaggtacagaggggacttagaggaactagaactctaatacactgctagcaggaatgtaaaatgaagcatctacttcagaaaaccattttatcagtttctagaaagttaaacatagacccaccatgcagcccagccactctactcctaagtatttacacaagagaaatgaaaacgtgtccccacacagttgtatttaaaggtgatggttagccttgtgtgtcaacttggctaggctataatacccagttactgaatcaaatagtaatctaggtgcatctgtgaaggtattttgtagatgtggttaacagctacaatctgttgacttcaagtaaaggagattgctcttgatagtatgggtgggcttcatccaatcaattgaaggccttaagagcaaaaagtaaggtttcccggagagaaagaaattctgcctcaagactgcagcctcaactcctgcctgagtttccagtcagccagccagcctaaagatttgctaggcattataatcacatcagctaatttcttaaaataaacctctttatatatattgatacaatgaatggttatagcagccttatttgtaatagccacaaactggaaacaacctaaatgtccttcaataagtgaatacataaacaaattgtggtatatccacaatttttacgcagcagtaaaaaggaataaatggttgaataaggaataaacacataacaaggatgaaccttaaaaccgtaaggctgaatggaaaaagtcagacaaaactaatacatactgaataattccatttatattgaagttctagaaaatgaggactaacctatagtaacaaaaagcagaaaaattttgcccactggtgatggagggggcgcaggtattgtagagtatctgagaaaggacaactggataaaagggggcacaagaaaacttttgagggtgattgatatgttcattatcttgtggcatggtttcataggtgcatacatatgtcaaaacatcaagttatacacttttaaaatgttcagtttactgtatatctattatacttcagtagagaggaaggaagaaagtgggcagggtgggggagaggaaaggaaacgagggaggaaaggccctaataggaaggattttggagtttagattttaaaatgataaaggatgtttgacactctaggcatatgacgaatataggattatgagtccacaaaaaccaccaggaagtcatgtatgtttatacttttaagtgaaggatcagtggattatcaactccctaatgctttgcctctctatgactggctgctgtccttctcatcccaatactccttccaaagccccttgcttaaatgtaagccttctttcctcctttcaacacatcctgcattccgtgacaaaataagttttccttaaacagaatgtacagcatattatttgtacaattaaaaatttttggccaggtgtgatgactcatgcctgtaatcccagcaatttgggaggccgagatgtgtggattacctgaggtcaggagttcgagaccagcctggccaacatggtgaaaccctgtctctactaaaaatacaaaaattagctgagtgtagtgtggcaggtacctgtaatcccagctactcaggaagctgaggcaggagaatcgcttgaacctgggaggtggaggttgctgtgagcagagatcagactattgcattctaggctaggagacagagtgagactcggtccccaaaaaaaaacacatttttttttaatgtttcctccttgcctgtaggaaaaaggctctgactccttagcctgggcatcagagctctatctaaatggactttaacctgattttgtggcactaattccattgcagtacttgtccgctcactggcctgtgcctctctgccactatttttggaataatgtcctctctccatcttgtttactcaactatatccaacctctaaggctgtgctcctacaaagcctcccctggctacttcagcccacagagatatttaactgctctgcagttcaggacattcttctgactctttaaatcacatttacttatatatgatcttgtgatattttttgttgacgtgtttactttaattttcttccataacctattcattcaacaaactcaacaattatttattaaatgccaagttagaaaaatattattgattttatatagattatagatatgtttgaaattttatttggcaatctgcaagtagaaaaataattataatgtggtatatctgtgatagaagtattagtgcagagaccatggggaacataatccagcctggaagttcaggagagatacgtggaagaaaggacgtcagagcctttttcctacaggcatggaagaaacattaaaaaaaatttttttttttgagatggagtctcactctgtctcccagcctagactgtggtggtgcgatctctgctcactgcaacctctgtctcccgggttcaagtgattctcctgcctcagcttcccaagtagctgggattacaggtacctgccacacatggatgataaatatgatcatattttcttgttcttttcctcctcagttgtcttccctgaagaaaggaatgccttttatagatgacaaactcccattctcaagaacaaggatttttgaccaatttaatttaatcagatgtctggctttgacctagaaacacagtcacgaaacttggtgattagagaccaattcccaaacatgagcatttcttaggaaacacagtaaagatctgagagacccaagagcagaagggcgagaaaccaaaagccatcagtttgcataggaaacaccttgtttagcctaatctttttatttttattactctattagtcactacaactattttctgattgctatggtgatagatggtttaaaacaagccttcattaagaattgtcacaccatggtctcagtcaaaaacaccaacatttttattggtattgacaattatgggaatatccaattccaagaagacaaggagacctctgaactttctaaatgaagactccaatcttcctgatctgatgggaagcagcttggcaagattaccaaccaccaccacagagagtggactctaagctaagacttaaaagataagtagaaattatccaggtaaagatgtgtacagagaaggaagtacatccaggggaaaagaacaatacgtgcaaaagtacggaaatggtaaaaagtaatactacatagtcaaagccaagcagagttcagaagggatctggtggtgaaaaatacggctagagaaagcagcaaggattggcttctaaaacctatgtagtatcttggaccttaccctaaatgtaatgagaagcttctaaagaatctttcatttattcattcattgaacaaatattttgaggctttctgtgaagaacatcattctaagtagtaaagatacagcagtgaataggacacataaaatcctagatctcacagaattgacattccagagagggaaaggtagacaataaatacataaacaaatcatttaacaagatgatttcagacaatggtacgtactgtgaaaaaaatgaaacaaggtaatggacagcgaaaaggcactggaaggaagcctgcttacctttgcatggttagaaaagatctctctaagaaagagaccacatgtgagctgcgacctgaaggataccgagaagctaggtgtgcaaagatgtggggacagaacttttggactgaatagcaaatacaaatgcccttgggtgcaagctttgcctgttcaaggaccaaaaagaaggccagtgtgcctgcagcatactaagcacagaggaaaacactgttatatgctgagattggaattataagtagagccagataatatagtctcttataggtcataataaggcaaccagattttattccaagaggatttaaaaatcactggaggttttgcactagggtgagaggtgtgatttgtatttttaaaagataattctggagaattaactataatgaggtaggagtaaactaagttaggggctatttcagtggctcagacaagagataatggtagcttagactaggatagtagtcgtagaaataaataaaagtggcactctactttgggggtagagtctataataggtttggtttatggatcatatatgagagtaaaaaaaagaaaataaattaataatggttcctaggtttgtacctgagcaactgaataaatgggtgctgtgaattgagataaaggagattgagaatcacaggctttgttttgcaaattaattttgagaggcttattagacatcccagtggagatttcaggtgagtggagcccattgaaaggtaagggacagggtcaggtgtggtaggtcaggcctgtgatcccaggactttggaaggccaaggcagacagatcagttgagctcaggagtttgagaccagcctgggcaacatgggaaaaccctgtctctacaaaatatgcaaaatattacctgggcatggtggcatatgactgtggtccaagccacttggggggctgagatgggaggatcacttgagtacaggaggcggaggttgcagtgagccaagatctcgccactgcaaaccagcttaggtgacagagtgagaacctgtctcaataaataaataagaaacgtaagggaaaaggaaattaatctgatcattggcaaatgcatagtatttaaagccaggggagtagatgagatactcaaagtaggtgaagataaggaggcaatgaaggcctaggactctggtgtacatttagatggttataagaggaatagaaactggcaaaataagtaacactgagcacccaatgaggtggagaggaaagccaggagatgaagcatcatagaaggcaagagaagaagggtgtcaaagaggcgaggcagtcatcaacttctgggcagtcaaataatataaggacagaaaagtgaccattggatttggaaatatgatgagcactttgagtggagtgttgagacagaagaccaattagagtagattgaggagataacgagaaatgagaaaatgtaacctgcaagcacagacaattcttgagagacttttctgtgaaaggaaacagacacagagtcttagcatgtcttgtctttctatgggaaatgtaaatagtttgagatcagggatagtattttattctgctttttgtacctctacattacctagcatagagctagctaatgtgcacttaagtatgttctcaattcttatcgcctgaatgactggatgggtgaaagaatggatggatggatggatggatggatggaaggatggatggatggatggaagacttctgatttgccaagaagaggatactggtagcagaaataaaaacagcactggagaaagaagagtttagatttttattctttggtgtcagttagacaggaaagtaagacattagaagagtccttagataatttatgtaattgttcacttaggatttttaaatgtgatcactgatattggacatgttcctagtgaagcatttttggtgtttcactggttgaagttaataactgtaaaattatttcccgttcaggacagaaaaacagaaaacttgaagctcctattagaaagttcaagattctctggggttcttaggatttactgttcccaaaactctgtcaagaacaagaaaatgacctgtatacttaactggtctaggcaacagtggaaagacaattctcagagaagatttgttttaagaagacactttccataggaatcaaacaatagctttcagtgactaacatggtaagacacagggtgttagctctttccttccaacctcatggctgttgtaccttacctttcgaccccgtgttcctgaaattgttaaattcataaacttaccaaggactaaccagcctctggggaattgctgtatacttagcaaacttacaatggacatatttataagccataatgataactgactaataggaaataccctcaactgaaaatgagagatcatcatttgcaaatgagttcccttgcccaggcaactactggggaaaatgtcatgcaagcaaaattaatctttgaaatcctccttttccattttttgtgtcttccttttccataggcaccagaaatatcatggtgcctggatctcatctctacagaaaaaaaaagtgatttgataaactgatttatattgtgtccaaatgtgattgtattttcaaagataacctaaggggagaatgctgtctggcccaacagcaggctctcgacttcatttcagacactgtggccaatggctgggaaacaggtatgaacagtaggtttctgagtcccctggaattattccatttatgtagccacctccatgacaggaagcctccctactcttacttcccagtttgttcattcatggcaccaggttgcagattaaaatttgctcagtgaccttttatctaataatgtgttaccttcttctcttaaaaagtacaagggacaaatgctcatggtatacttttaggagattgtggctctctattaacagtatttattcaacaaacatttattgagcatttatatgtgcatcatgctagggactggaacctagtaagtgtagcacatattatttcatttaatcctcacaacaaacccatgaggttggttttatgatcccaatttttcagaagaagaaactgatattcagaaccagttaactaactggttcaaggtcatgcaatttctaagatacagaaccaagagtcaaagacatgattttaaaccaaagctttttctgctactccacattgcttccctaggtgagatctgaggcattccgcgaaaagagaagggtcataaagccaagggaagacaagcttaggaaaaaaaagggaaatgtcctaaataaacagctttcctatttaccagaaaccactagtttaaaaatataatgggaaaaatcctattcactttaacaatgttaaaaaaaaaaaagatagaagaaacatagggataaacttaacacatttgtaggatatgtaaagaaactaaaagatgttaataatggcctaaagaaaaaaaaacttacatgtatggggagatagaccatcttactggattctaatatttaatagtctaggtgttccatttctcaccaaattaatgtatacatttaatacaatgtcaaacgaaatatcttaggaattgcttacaaattgtcagataattacaaagtttacctgggaaatataagcatatatgaagagtgaatgggaccccaccactccccccaaaacaaaaaaggtctgaaaaggacagaaatcaaggagagtcttgcctgccagatacaaaattctattataaaggtgtattgatgaaaacaatttaatactagtgtagcaataggcagcaaagcaatgaaacagcataaaaagaccagaactatacctaattatgatgaagatttaaggtatgataaacatgacataattcaaatcagcagaaattggcatagatagggttaagacaaatagctaatcattagaggggaggaaggaaaggagggaggataaaattaggttcctgccttcatcttacattaaaataaattccagatgtattacatttaaatttttttaaaaaaagaaaccacaaaatacttgaagaaaatataagttgttatatagtcttttgatgggaatttttttttttttcagagacagggtcttgctctgtcacctagcctagagtgcaatggcatgatcatggctcactgcagccttgaactcctgggctcaagtgatcctcccagctcagccccccaggtagcaggaactacaggcatgcgacaccccatccaacttattttttattttttgtagagacaggggtcttgctttgtttcccaggcttatctcgaacttctgccttcaagcacctcagcctcccaaagagctgggctgatgggacattttttaacatagtgccacattaccataaatgaaaagcttgtaaaatactaatttttaaaactaatatatatcagaaatttttataaacaaagttaaaaagcaaacacaaaaaatttgtagcacttatgacaaatatatgtatatatatgaatacaaaaagagcctttacaaaacagtaagaaaacaatgaatactcccaatggagtattcaaaactaaactgctaaaagcaattcaaaacaaaaaacataaactatgcatatatgtatgtgaaaaagtttaaccttatcaaagaagtaaactctcaaagaaataaacatcaaataaggaaatagccttttcccacaaataaccaaaatctgtaagaatactgagctgcgaatgtttcagaaaaaaaaaaaaatcatacacctagttcggcatgtaattaatatagatcagaacactttaaaaatatttataggccaggcacggtggctcatgcctataatcccagcactttgggaggccaaggcgggtggatcacctgaagtcaggagtttgagaccatcctgaccaacatggtgaaaccctgtctctactaaaaatacaaaaactagccaggcatgttggcgtatgctggtaatcctggctactcgggaggctgaggcaggagaattgcttgaacccaggaggtggaggttgcagtgagctgacattgtgccactgtactccagcctgggcaacaagagcaaaactctgtctcaaaaaataataataaataaaaataaaatatttatatactctgacccatcaatttgtccagcataattaggcatgtgtacaagggtttacacacaagaatgcctattgcaatattgcttttaatgctaaaaaaaattggggaaaatgctttaaaaatatagattaagactgtacattgtggtacagtcatataatcaatagtatacagctattatttattttcagccactgtccaaaatatagcctggcctaacaacattctgttaggatacgcaagcaccgtgaggagatcagctataaagtatcagtgtttcacaccactgctcctttgctaataaccttcaatggcttttaaagaagtaaaaaacaaaggcaaaattccttagtcagcccttaagactctctgttacttagctcaaactacccttttcaacaacactgccctaaccaggatgagttttttgcccccctggagtacattcagcctttccttatcaaaccttcctttaaataagtatcttctccaggaccacttcactttcttccccaatttagcattttctatatctccaggcctacctctataaagcctgtcctaaccactcaaaccctagctttttctctgaactgctagaaatatttttctctcattggccatttaggtaaaaaggtttttactgtttattacctactcaataaaaattttctttttttgagacaaggtcttactctgtcgcctagaatggggggaagtggtgtgatcacaactcactgcagcttctacctcccagctcaacagtcctcccacctcagcctagtgagtagctgtgactacaggcatgtgccaccataccccactacttttcattttttattttttgtgagatggaatctcactatgttacccaggctggtctgctgatctcaattgatcctcccactgtggcctcccaaaatgctgggattacaggcatgagccacaatatctggccccagtaagcttttaaggccattaacatgaggaacagtgttctttacactattttatcagctagggctttgcatggagtaggagtttagtaaatgcggttgatgggttaatcaatgtgtgaaaatattcagagccaccaaaaacagatattatgtctattctcatcaacaatcaaaattgagtaaacagccattttctaatacaggaaaccacaaaacattgaatggtgacattaaaaaattcccccagcaggagccaaccaattttttcatcctgatccaagttagcaaactgcaaaagataggaagcactaatgagtggaaatttgagtagaagcatttcttatgaaggctgtcttgactggatcacatttttattgctgttggaggtgccaaatgtgtgtgtttatgctaatcctccacctcaggcaacacacagtcaaggatcctaccaagtgttaccgtcaagtgtctgttggcagctcaaggccccagcgttgttcccttgcactagggaaaagacatattccaggtacaagtactcccactttgatgctacagaggagttgctgaactttgtgtcattaatctctcttcgttagatcccaaccctgtttaaatcccactatctgcctactctgggtcttcaccaatttactagatcatagttggagaaaatctacaaagccttgctccctttagatttaaacaggtctccgtttaaatttagaattgctaacttcaagcgggcccttatgcgacagtatgcctgtcagtcatactacatttcctcaattccattcatgtgactgctccatacccttccctctctcttcatactactattatctcttcccccctccctcatttttaactgatgatcttgtttcctatttctctgagaaaatagaagccatcaaaagagagtttccacaaactcctactgccttatctagccctgtaccatatactttgcatttcctctcattaccatggatgtactgcctatctgtgcttctatctaaggctaacccttccacttcagttttgaatattatcagctcttaccaactcaaggccattgctctagcaattctctcattctctctcattttcttccatcaagttttccttttcttcaattaacagagtagctcctaaagggaaaaaaaagtcttctttttcaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaattagaaataccatttgacccagccatcccattactgggtatatacccaaaggattataaacaatgctgctataaagacacatgcacacgtatgtttattgtggcactactcacaatagcaaagacttggaaccaacccaaacgtccaacaatgatagactggattaagaaaatgtggcacatatacaccatggaatactatgcagccataaaaaatgatgagttcatgtcctttgtagggacatggaggaagctggaaaccatcactctcagcaaactatcacaaggacaaaaaaccaaacactgcatgttctcactcataggtgggaattgaacaatgagaacacttggacacaggaaggggaacatcacccactggggcctgttgtgggatgaggggagtggggagggatagcattaggagatatacctaatgttaaatgatgagttaatgggtgcagcacaccaacatagcacatgtatacatatgtaacaaacctgcacgttgtgcacatgtaccctaaaacttaaagtataataaaaaaatatatatatatatataaaacaactaaaaataaatcttctttttctgcaggatcagtccatcaccacacacacaggctgtgttttatgttgttccccagcttaagagatcgttctccagatcccactgctccttccagttgtcacctcagttctccacttctttttgctgataaactactctaactagttacatatgatttctgtccccaggtcccctccctcagttgttttgaacataatcatttatatcatttatcattttcactctaattgcacaaccaaaaactccctttttttttagatggagtctcactctgtcacctaggctggagtgcagtggcatgatctcggctcactccaacctccgcctcacgggttcaagtgatccccctgccttagcctcctgaatagctgggattatacacatgcaccaccacacctggctaattgctttgtttttgtttgtgtgtgtgtgtgtttttttttttttttggacagagtctcactctgttgcccaggctagactgcagtggcatgatctcagctcactgcaacctccacctcctgggttcaagcgattctcctgcctcagcctcccgagtagctgggactacaggcatgcaccaccatgccaggctaatttttttgtattttcagtagagaccaggtttcaccatgttggtcaggctggtcttgaactcctgacctcaaatgatctgcgcacctggacctcccaaagtgctgggattacagacttgagctactgcgccgggctattttgtgtttttagtaaagacggggtttcaccatgttgtccaggctggtctcaaactcctgacctcaagtgatccgctcgcctcaggccctcaaagtgctgggattacaggagtgagccaccatgcctggccataaaactgccctttgttaatatgactgttggcctgcacattgtcaaatccagtggcattcatcttactcggccaacctacggcatttgacactgtctgtctttccttctgttcctctatctgtttccagtatactggcctggctttctttttacctcttttatatgctcttccagtctcaggctcctttggggatttgaaggtatgttgcattttgctattcaatgaataatgacaagtaatgatcacttaagacattaagtggtcagttcctttactaggataaaaataattttcttcccaacatggggcatattccatttccagtctgactgttctgtgtaatctttgtattccttggcagccccttttatatcagttcatctactgtgcaggaaattggacaaacatttgcactggtataaccaaatacagttgaacttttggcttgactcttagctgaactcaccaaaaataatttctgtaagagactgagacgtctacgagtaggtttttcagaattagtaaacataaatcaaggatacacaggtagatttgaatttcagataaacaacaaatacttttttagtatgtctactgaaatatttgtatcttatctggcaattctacctggtacagaactaatccattctcttgaaagatcttgactctgtaataagttctttggtgatggaagggaggtatttctgtaattagagtcactgtcttcctcccagttttttatcctggcccagatctgcaatgaacacacgacagaatccaggggggatgaagatgggtgctttgcaggaaaaaaaaattaaaaacatctgaaaaagcttttgtactaaaagaatgtgatctaaaaaagaaagcaggagaactttctgtctgcactttacatcagaacaaccttggcgtctagaagctgtgccctgtgggaagtggtggtgcttggtaagagatgccaggaccagtggtacccactgggagcactgccaatacccagcaaggagcatgggtgcacagtaaggcattgcactgtgattcagcataaaataacaataagggaacgtcacggagaaaaggccagacttcctttgtttagaatgtgggaaatgtcttctgaaaaatggtagtaaaaaagcatgcttggatggtccactccaggcaaaactgactaatcgggggtcagggatacaacccctgcatcatatgtttgtttctgttgggctgacatgaggttcactgtgaccactgtggtttaaccccatagtctcctggaaatacagccaggtcaagagagctccacataaaacataatcaaaaaaataaactcaagtttccactgatcagcttttcacaactcttatcctttcactaactttggagcaagatttgagaattggatggctatttgagggctatttctgcgctttagttcaatgttttgttctttctttattagagaactatggttttttattatatttacactttaagttctagggtacatgtgcacaacgtgcagatttgttacacaggtataaatgtgccatgttggtttgctgcacccatcaactcgtcatttacattaggtatttctcctaatgctatccctcccccagtcccccaccccccgacaggccctggtgtgtgatgttccccttcctgtgtccaagtgttctgtttatgtgatagattacgtttattgatttgtgtatgttgaaccagccttgcatcacagtcacttgcttacaagaaacaaacacttcacagatggatcattatgtgtgataagtgaaatccaaggatttatgctcagaggtgggcttaacaggtaggaagagcagtattttccttcaaccatgagtgtatgcaggtttttcttttcttttttgagatggagtctcactcttttacccaggctggcgcgcagtggtgcgatcttggctcactgtaacctctgccacctgggttcaagcaattctcctgcctcagcctcccaagtggctgggattacaggcacctgccactgtctccggctaatttttgtctttttagtagagatggggtttcaccatcttggccagccttgtcttgaactcctgacctcatgaatcatccttctcagcctcccaaagtgctgggattacaggcatgagccactgcgcccagcccacaggtttttcaaagactaaacttaaaaaaaaaaaaaaaatttcccaatgaaatataaaactaaagtgctaaactgtgatagactgttttacaagaatgccagttttcacaagtgtctatagaacatgtaatttagataggtaagatgaaattttgataatatttgatggcaaatttaaacaggtatacaacaaaaataaaattctaagcccctcaaccaactgaatggactccttctctcagccaaaggaataccaaagtaaacctgaaaaactagttttggccaggattgggggtaggtgggggaagcccaacatgactcattattctctcctccctttggaattcaggcacaactgaatgtcagcattgacactaaaacacagatcttaagactgacaagccagactctttgtagcagagagccaggccctggaagaaatcaagttattttatcccaaaaaatatttctttgatatattttcaaatggccctgcaaagctgtctcttgtggggaaaattgacatgctgtacagaatttccttctctttccaagtttttactgatccaggagagatttaactaagaggctagcatgtttttttttttttttttttgaggcggagtcttgctctgttgcccaggctggagtgcagtggcgtgatctcagctcactgcaaccttcgcctcccgggttcaagcgattctcctgcctcagcttcccgagtagctgggattacagatccatgccactatgcccagctaatttttgtattttttgtagagacagggtttcaccatgttggccaggctagtattgaactcctgacctcgtgatccgcccacctcggcctcccaaagtgctggcattacaggcgtgagccaccgtgcccagcacaagacatttaccgtctattctctctgaagctactatctagaggcttcatcaacataataagacccttggtctccacaactccttatcttatcctattagtttctactgattccaggtctttagataataacaactctttcaaccaattgccaatcagaaagtctttgaatccacctatgacttaaaagccccactccttcaagttatcccgcctttctggactgaaccaatgtacaccttatatgtgttgatggatatctgcctgtaacttccattcccctaaaatgtataacatcaagctgtaacccaaccaccttgggcacatgttttcaggaactcatgagactgtgttgcagaccttggtcactcatatttggctcacagtaaacttctttaaatattgtatagagtttggcttttttcattgacacaggaaaaataaagaattggaaggtctttcatcagtcactgagccagcttcatatctgactgaggtcatacagttcagtgatttgtagctttgctacttagattgctatccattatctagaagcatcaggatcacgtgggacctattggaaatgcagactttcctcctagaacccaggaccttggaatattcttggcacatagtaggtgctcaatacatattgaactcctaggtgcaattcattaattcatgaattaatgaattaacacgctctcaaagtttagtgctttttcacagactagtctttctgcctcttaagcactcagctcaccacgcttccagtctcactcccctattagtctgattaaaatctgcttacatgtgagtctgagatcaagtgttatctcttctgagaagtcttccctcactggcccaaaggaatttctcctctattttagcactgtcccagttgacttgtcattattctagtctttttcatattagttgtttttcatatatatgttattaaggaaactagtcatttcccctaatagaacaaaattgctggcctttggggttggcaatggaggggaggctcttcttgaaaagggggaagagtgttctcctaatatttttcttacgagatttatgttgctcatctttagcctttagtcccccattgcctgcctacagttggcagagaccatctgttctctcactgtcaggaactgtctcaattcttgaagttcagagtcaaaaaagaagcaagttttcctagctctttgatcaactttcaaagttttacttccatttgaaaatttactaagtcaccaggagatggtttatactgagaaatatccactcatactcttcctcttcaactttcttccatatacaccctattacagggatatagtcttactctatagctcaaaaggatgaccctatcagaaacctgcacagtatgtaaaacattctcaccagaggttcacttgtgtatttccaccctagaatggaagctctacaaaagcacagaatgtatcattttaactttagattctattttcacacccagtgcttgacacatgatttgaagttaatatttatttatcaagtgattgttttaaaatcatgactcactcaacaaagttataagaataagaatagtgttacagaattggtatacacaagctgaccataatcaacacacctattatcatttttttgcgacaggttctcgctgtctcaccctggctggagtggagtggcatgaccacggttcactgcaggtttgaacttccaggctcaagcaatcctcccacctcagcctcccacatagctgagcccacaggtgtgtgccaccatgtccagctaactttttaattctttgtagagacagggtcaccctatgttgcccaagctggtcttgaactccttggctagagagatcctccctccaaggtcccccaaaatgctgggatctcaggcaagagccaccatgcctggccataatcaatacacttttaagaatgctagaatgttatatcagatgcatacttcagcactatctcaagcaaactggggtgtgggttattctacatataaagttcagcagtgttgttccacagtcccaaactccaactgaggtcaaatgtagggtgcagcaaggtcactggggctgtcatcaagggcctctccttgcactcttgccaaccctgtttcttgattgtctctaccaccatgagtcaccagcaatctcccacagtcacttgtttaaaagttcacaagtattgtgtgaattgcaggcaaccccttgactccctgattgcctggtcttcttccttgggctctaccattttttttccccagcactctttctgctgctctaaattttaattcatgcaattccatatgtgtttctctatcattcttcatctctttcctctcccttccatccaattttgtttgtctgtttgcttgcttgcttgctttaatacatttctctttttctgagaaggcttgagtccaaaactctcagttacctgttgttctgtttcccgttagttaatctccgaaccttcataaattaaatctgacaaagtcccctgactaacaaaggaaatgcacaagtcacagtaaaaggggcacacacagaacacaaatagacccagggtcttttctgttcatcactcagctttttataggagatccaggagaaatgaagtggaaagggaagtgtgttgagttactatacaacacaagagtaaactttcttataagtggtaatttttttttacaggaataattgaaaatggaaattaccttctctactcatagtaagtactcagtgcgttcttgatgggatgagaatgtgtttgagctttagtgtaaggcagaattctgtttagtctgccagtattggagaaaaataaaacacaaagggactgacatgtaggaagtggcacctgggagggtctcaattcttcctattacaaaaatgccccagagaaataaaaagcttgtgtacatgttgagatgggagagttctctggcccccctcgcaggatgtgtgacagtggggtggctctctgctgcgccaccatgagctcaaacccctcataggagggggagcacacaggcaggaaggtgcaggagctgggcgagctctttgggctctggccccgtggtactgtctagaggtgggtgcctgcaactcctgaaagcccaagtgggcatgtgttacagtgcactctttcagctttgctgtctgcagcttaagcgttaaccagctcagtttcttcttggtacccaggtccttgtctggcatccaggaagaatcaggttacacatggacttgaaggatgaatgtgggagttttatggagtggtggaggtggctctcagtgggatggatggggagctggaagggggatggagtgggaagatgatattctcctggagtttggctgtccagcagccgatctcctctccagtcgtccccagcctctcgacgttcagatgctcctcttctctccttctctgccatgctgttctgccgttcatctgcctgtctctctctggagcctggaatttggggtttatatggtacacaataaggggcatggcaggccaaaagggaactttttaggtgcaaaaaacaggaatgcctcttctcacttagggctatagattttcaggcttgaaggtggggcctttaccagcgaacctgtatttccctgtctcctgtgcatatcaatgtaatcaaatactgggctgatccaggatgtttctttagaccaattatgggtaaaataatttacattcaggtttttatatttgcttttgtcatttctttttaagcaatcatgtaaaatatctatacgacagtaatagatgatagcgaacctaattaaaattaccagaaacttaagaatctctaatgatttcaactgtaactaaggttatttctctttatgttgaacaatgttgggagataagacacaagagtttctgaagtatttcagaaacacaaagagggaggttatataaataatatttttttcctactttgggaaaatgaaagctagtcacaaagttaaacgagtggttattttaatatttaaaatacaggcttggatgtatttcctgttaaagaaaataaaatgcagaatattcaaaacgtctgaccacccttctaagaaaatgcatctctgaggtatttttccttagaagttattgtaaaaatcctggagaagcttgaacacagcaaagcaaacaggatgcagagtttaatctgtggaaagcttagggaagaaaagcaaatcattaaaaataggtcttcctctgaagatttttaaaacgcaaagagggtggaatagcaatgataataaaaaagctggcatagagagtggcacaatttgctgtgccactgagctgactggatgtgttctgaatttctaggcattagtgtacctttccacacgcattctccctttaaaaaaaatgcccacacactgaatacttttttcatgcaatttaaaataagcgcaccatctagtttacagaaattcactagaagttatttatcctaaaatagcagagatctagaagaattttgagctctaggacattttagacacacagaaagaagaatctggacaagtcttgaccagacatgacagaatagaaatttcttttcctatttatctctttgaataaaattttcaggatcttacagtggacaagtttgttatctacacattgtgaagcacattgatttctcctctgtagccttaggaagatctgagaggtgactgagctgattgaatgatccgtgaccgctctactgggaccagtagtagaactttactggtggagacctgctggaggtttgagagcagactttgaaaattactagagctacacagatactgtgtggctaactggattatgtttagaggctttcagaactatgctgctgctgctgcagtgtagccaggacgcacagagaacatctaaggctcttgaatggggcgatagggacagatttcagcagccatctgacttcagtgctcattttgatgctttccctgcagggtgcagtgtgcagtgtgcagtgtgcagtggtgggaggctcacacaggaatacttgcttctgtagccctaatttccggttcaaactctgcattcaccttgacagattctttccttggccaaaatttagttaggcttctgggctttctcttatgcccacctgcagactttttggtaaaatccagttttagtaaagagctctgctaagtcagtttagcaagaatccccacctcaaaagtcactatctccctccctggtagtgtctggcttgtcttcagcgagaattctattaggttctgttagattagaatcctccttacccttgatgcttcctcttagtattttttcatccactgactccttgacccaccttgctcctcggctataaattcccacttgcccatactctgcagttaagactattttctccccactactgcaaaatcccattgccatggtccctatactatctcaatggtaatgaataaagtctgccttaccatgctttaacaagtaacattgaaccatttttttctttaacaatctgctgcacaatgagattactaaaactttattccattttgccatgctggatgtcctcaatggaatggctcttgtgagcaccaaatcattgtgagaaggaaaacccatctcttacagccccctgtaacgtgatgtatgttacatgtgatgtatgttacatagttttttttcatgttgatcactttttgcccattttcctatatcttatcagttggaagactgtggaagtttgtagtactaagccacaagatgactaagaagagttgaaagggcaagtggggctaaaaacagattttgtttgacttaccccaccattccccctatcatggggctgaatctgcctggaggaaggagcatctttatctttgtactgtgaaccacacagtctagcagcagcacagccaaggcacttggggtttcatgagactaagtacatgcaattctattgtaaaggcttaaaatatatacaactgacccttgaacaacatgaatttgaattgcatggtcagttatacgcagattttcttccacctctgccacccctgagacagtaagatcaatcaatcctcttcctcctactcctcagtctactcaaagatacttgaagtctacttgaagatgacaagcacaaagacatttatgatgatccacttccacttagtgaatagtaaatatgttttctcttcctcctaattttttaacactttcttctctctagcttaatttattgttaagaatacaatctataatacatatgacatacaaaatatgtcttagttgactgtttatgttatctgtaaggcttcaggtcaagagtatgctattagtggttaagttttcgaggagtcaaaaggtgtatgtggactttcaactgcaggggggtgggcacccctgcccccatgttgttcaagggtcaactttactgccaaaggcaagcctttacatccactttttccatcccatcagtaaatggaaaaagatagctacagtatccctgcgtcaaatctttttttttgcagatcacaaattggccactcaccttgctctgtgaggggtaaaatgccccactttctttagtaatatttaagttagataatatttaagttataaagttgttctttgtaatcgttaattgtaatttttacatagtttctttcaaacagaaatagcatttttgttagataacctcccgtatagatgatgaaactccttttaagggctatctgaattttaattccttgaaaaggcagaaattggatagctagtagtcataaatgtactgtggcttcccccaaccatctgggctatatagaagctgcatccttggactgcagtagaggagtcttacaaagcacagagcaacttctctcctgggttgcgctagttatgatggcaattttaaatgtgtacttttacccaaagaaaatccttattatcaacaatcacaatgccatcataaccatggtataaaaaattcaaaatgtcccagctgaagtggaggcaaagactcaagttcatggagtcagagtttccttgctattcctctttttcaaatgaccatttagtaagcacctgaagaaaatactatggacggcattgaaaagtgaagataggtttaatcttctcgaaaatctaattctccagatgaaacgctgacacttatccaccccacagaccctatagcagatgtgtcactggccatcacatttgacacagagaagtcataactcagtcagcacagagacatttccatgagtttctgaaccatggacagaacgtcgtctgtgggacatgaaaactggaacttagaggacaggcacatctgagaaatgggcagtttaaaggcagaacatagcacatatgtgactgggttttagaagcaaatttacaagacgcactcttcttcatcctaaataatctgcaaccaaagcttccaaaaaagacaatttaggaatgcagaggtgaggagtagggaggggaatgggatgagagagagtggagattaatggtgggcagagcgaggtttagaacttagtggtttcttcaggttctgaactgaaatttgtatactgtaaaggcacaaacaccatttttaacaaaagtgagcaggacttcctatctggttcagaaaataggtgaataaatagtacgaattattaaaaataataatttccacttatacataggaaacttgataggaaccatgataaatgcttaactcttaatcttcaaggaactctgctagggatataatattataaatcttgttttgcagatggagaaattgaattttaacccaagttatcataacccttaaatgattaaatgatactgttacatgagaaagctgcgtatctgtttcctggatttgtagccataatttgtgtctcaagtcccttttgctgccagctatcttgggtaggtgtgttccctttgggctgtttgatacccccacatttatcttttttttttctctttttttgttgagagagtctttccctgttgcctaggctggagggcaatggcgcgatctcggctcactgcaacctccgcctcctgggttcaagtgcttctcacgattctcttgtcccagcctctctaatagctcggattactggcatgcaccaccacgcccacctaattttgtatttttagtagacaaggggtttctccatgttggtcagggtggtctcaaactcctgacctcaggtgatctgcctgccttggcctcccaaagtgctgggattacaggtgtgagccaccatgcctggccccaaatttatctttaatgccccaaattatctagttcccatgactgggcttctgctttgatcctttctgcacttgctggaccctctccctgggaaatgagattgtgtcctgagcccctagttagaggctatgtctctgctgttcctgaatgggcctcctggatgagacctcattaaaagtctaattctcttggagaattgagagatacctatttgtctcaaaatcattgaaaccaattaatgtattatgagcctctatccagtgatttgtacctcaattccccaatccagctgtcaaggccaatttgttctaccttacctagtaggtaagtctggaattgtagctgtggcattttcagtaatggtactctaggttagcagtccccaacctttttggcaccagggaccagttttgtggaagacaatttttccatgaagggctgggcaggggagtggtttcaggatgaaactgttccacctcagatcatcaggcattagattctcacaaggagtgcgcaagctagatccctcacacatgcagttcacaatagggtgtgcactcccatgagaatctaacaccgctgctgatctgacaggagacagagctcaggcagtaatactcatttgcctaccgctcacctcctgccgtgcagctcagttcctaacaggccacggaccagtactggtccacggcgcaggcatcagggacccctgttgctaggtataagcatctggctgctgcatgtcttctgtgtagctacatctgtatgtgtatctgatgagatataaattatttgattataaattactttcttcatattagagttgtgaatgagtatcacatataattatacataaactaggaatatgctttttaataatgtatataagtaagtttccttaactatgactttcatcttagcgtagtaagagggtgctaagaaatatttgtgatgaaaataggcattggtagagttgagaccactgggtgatgaaagagtgtaaagattttaaagccttcagatgctggttcaaggtgagaaatgtgattgggagcaaatcaattaacttcttgaagtcttatagggcagttatgaatacttaatgttaacatatgtaaagctcttctgccctgtatacagtaaatgctagttagctattatgatcactactaaaatggggatgacataaacctcataaggttttaagtattatgcaagatactatacaaagtccagtaaatatcacattcaattgaatccatgatgtccgattattttagctacttccaagagagaaaaaaatgctgtcagttttactgttcttatagagagcaaggcagatcccaattcccaatgtggtaacgtgaaaatttttgcatttgaatcaacaaaacactttctcctttctttcctactatttaacaactggtaagtctatactcccccaaatctggaattctcctttcttattctttttcctcctaccaagaccgcaggatcttttacttggctataaggggtaaacctcaagtagtacaagttctctgtattacttttatactctgtcacagattccctttgtttcctcatctccatgtgaatttagttaaattctcagcattctgatccttactatacaaggtaaatgaatataaaaacaaaacgaaacaaaaacctcttcctatttacataaggccccaacctaatatttagtgatatatattaatgtgaacaaggaactaacgaagactgggaagaaattcacagacttgagagaagaaatggcaggatttcctgggaacaatttcatgtaacgtcaaaggtggtaaaaggtcaaatagaatgaagatggagaataccggattttcttacaaaatgatttcccaggagatctcatcaaatgcacgaggataccttctcagtttcacctagtgagtaaaagactggtaacatagctcacttacaatttggataaacaaaactaaacaaacaacatcaaaatttcagaaaaaataatagcaaaacagaaatcaaacactcaaatttttggtccttctgtttatttcattttggatactcagtgaatgttaattaaccaggaaacttaaaagttatttcaattatgaacctcttcaatccttcatcaattattttgagtattctggtcttaaaaacatctctttcttctacaaacttctgaaagagatgaacacctccacctacaccaaaataatgtgctttgctggccaaaagtacacgtccatttttacttaacagtctaaggaaagtctggtgcaaattactataataatctgggttgtaaatggtttctgaggtgagaatgagatcatattttacaaaaagtttttcactacttagtacaagcttacaaaactcagaccactcaccagaaaaaaatcggcatttatatagttgtgttacttttggtttcctgcatcttttcacatctggctcatttacatcattttcttcatcttccaaagtggagttagctactacattaggtaaggttacttcatcaatcaccatactgttataatcttgaaagtgaatttctttggaccctcccttgaatgcagttatacctagtaaacctgatccacaaccaagatccaagacttttttcccagcaaatttcactttggcctttgtgaaataagccaggaggtcaaaggtacattcccagatttttaagcctccctcataaacacctgtaatcagatcagagtgagaagaaaagctttttgaaactatgttttctccagggaagttctctttcaacaagatggttttcactactgataacttaacatgctggaaacctggtaatgtttctatgactttattttctaacatcttctttaaatctttaggcatagcatgctctttggcagctctcaaggagggctgttttccatgtggctccaagttccttgaactgctggctgcactgagtggactgtctgtgtcttgagagggagctgcattttccattgacttatgttcccacaagtgatcctgaggcaagtcaaattgttctgcagaacattttctgtccctctcttctcctttttgactttctgagactgacagctcttttgaggaatccagggtcaaagctccatctctaatgggtgttaattcattttccagatggtcttctatagtgaaattaaactgaaaggtcatcctcttattaaatgcacacaatctttaaattcagattcttcaacttctggatagaatttgatgatacacacaaatctgcctcaattattcaattagttttgttgggcccaatttctctttagcagcttatacatggtaacaaatatttagagatatttccaaatgactttttagacgtctttggtcctctttccaagcagctctggaaagaaaaaaaaaaaaaaaagaaagaaaatgatgattaaagcaaaatggcacatttcactaaagtgtaatattaaacagccacccccacccctccctgtcccaccatacagctgctttttcttaaaaagttgtggggaagagagagagataagagatttggacactcatacacaccttaagggttccaaagtgggagaagaaaatcaactataaaaacaaacagaagaacaacagcaaccaccaccactaccacctggacaaacataaagtccaagatattcagacaggacagcctagctacttgctgtctttcagctgtcttgatttgtgtccaaccatattcaccccctaagcttccagaataacttcacttctgtcttttacagaagaggtgcagtattttattttggtaagtcagcgtccctttaaaaacatgcataggtatggcctggtgtgtgtaaattcatccaagacttcactccaaacatttagtcgagaacagcagccctaagtgtatagaagtgggggtaatttggcaataattagtaaagactaattcggtggcagagcaaacgcaaactagggcactgcagtagtttggagagacctgtagaaataagaagcaactttattgagaatcttctatctactgcgctagacactataccatctgcctcaattttcacagttctggcaagtgggatctttgttccctttatacaagatttacaatttgggggagaggcgggtcacccagtcccgcggctaggaacgcgcctctttcctctcccatcacgctgcaaggcttggagtcacttccggctgcaggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtgagtcgagtcctccaggggctagagaagcccgactttctttccggccttgagggacccgggctcaccaagaaaccagccgccctcctctctatggttttggagccggcggagagcgcgcaagggttggcgggactgcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctcatatccttccttggttgtcacttctacctagagaagggtgtgggcgggtcgcgaacctttctcttctgtcccttcagacccaccgccaggctgggttatattaccgcggcctgaaccccctcttttctttgtcagtgagtgggatgaaaagtgagggactggaggggaagcgacaaccgtggtagatttaagtaaggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtaaaccatatgtatatgtatctttttcacaacatttgagcccagctttatacaattacactcaaaagaaaaaaagtaaccttcacttgagagaatctcaatactgcacaaatattgtgcagctaaagccctatgtaatcacatagaagtcattcacctaggcattagcaaaatctcagaaggtgccaaagcccccttttttagtttttgtgtaggtacagaactgccgtcttcaaggagtttcaacttgaaaacaaatagccaccctcaaaacattcaaaaacacttaaactgcgtgcataatgtgtgtgagacatggtgttaggctttgggagaacagagacacggaacgtgattcctcttcttccccacaagcttatagagagacttcattaagttgaaagtcaacattcccacctagctttgcacttcaaacgacatattcaaaaaagcccaaacttcctctagttttcttcatctgagtaaatggtttcacaaactgaaaccttgaatcctctctgtctcacacacccgatcagtaagttctattgtttctgattccaaactatgtcttgaatcaatccgtttatctccatcctcattgctaccactctgattccaaacccttatcacctctcacttggagtattaatagtttccttgtttctactcataattcattattccaaaaaagttaagaggggaaaaacatagatctcgtcatttccctttttaaaccactttaccttcaaggttccaggtgatctaagccttgcccttctctcatacctagttaattaactacactctgttcatgaatacattaggctcacctacctcaagatctttttgctcagcctgatttgttctctcagccttttgcatatttcatgtttatgtcttggcccaaatgtcacttccttagaggggctttttcagagccttcaatcttaggcagttcccccaaacgcagtcttacacttgtatcacattggcctgttcagttttctaaaaagcacattaccattaaaagaaatgctcttgtttgctttgtatattttccacttctacacattatgttgcaaagttcataaaggcaggatgttgattttcttcacagcgttaccctcagcacctagaacagtgcctgacacatagtaagcattcattaaagggctaaaaatatttcatgttttaaaaatacttgggagtctaattagacaatactttttttcagcttaatggtagtattttagcttcactattttaacaaatgaaaaatttgcaataaatctacaatgccattaccccccaaaatctttttcatgttttgcattttacgtattattttccaggccttacctgcatgtctgcataatcataactgactaattttggaacagctggtaattatttgagctttactgaaattttttcatgaggccaattctaccctactgaactcaaatttgagttaatgatgacctcattttgattgctgctgtaaaaaataagatttcggaagaggaatgaattcttgtattactgtggtaggactatgggtttttttttgtttgtttgtttgttttgagacggagtctcaccctgtcacccaggctggagtgcagtggtgcgatctcagctcacagcagccaggttcaagtgattctccttcctcagcctcccgagtagctgagattacaggcacgtgccaccatgcccggctaattttttgtatctttagtagagatggtttcaccatgttggccaggctggtctcgaactcctgacctcgtgatccgcctgcctcagcctcccaaagtgctgggactacaggcgtgagccaccgtgcccggccgggttattcatttttcttattaacattctttgatgattcttatggtgttgttacagtaaaacatttctaacaattattctaacaattattcttgatggtgtatatgaagaatttattgtcgtgtatttgtaagctgctatgtgcagaagaatttcagtcaaataaagttggtaagataggtatgtaagtaatatgaaaaaagatagaaggtgatgagtgacttaggtataaattaagtacaatagaaatgttgaggaaagaaaaatttcttgtaatagaaatcggaagtacaaactgggcatggtggtgtgcatctctaatcccagctccttgagaggctggtatgggaggatcactttagcccaggagcttgaggctgcagtgaggtgtgatcatgtcaccgcactccatcctgggtgacagcaagaccgtctctctttttttttttttttgagacggagtctcgcctatgctggagtgcaatggcgcgatcttggctcactgcaacctctgcctcccagtttcaagtgattctcctgcctcagcctcctgagcagctgggattacaggtgtgcgccaccatgcccagctaattattttgtattttaagtagagacgggttctcaccatactggccaggctggtcttcaactcctgacctcttgttcgcccatctaggtctcccaaagtgctgggattacaggtgtgagccaccccacttggccccgagcgagaccctctctctaaaaaaaaataaataaataaatcataaacctgtggattattgtagcattgtttctcatctgtcaaaaatatttcatgactatgcatagtttgaaaaggcaagtttgtccctgggcaattttcaaaatatttctttaatgtgttttcacaatactgtttacctaataaatcttaagtttttaaaagcaaaattaagccagtaatttgagtccaattccaatctcttatgagtcattgcttaaatttcaaaagggttttattttttttttaggtttgttctgagtaatgaataccctattactatgatactagtatcttccttaattatcctactcattgtctcaacattctgacagttggattgagcatattcgtaagtaaaattgttttaactgtatgatgtactttgatgttaaggtccgagtccccacatacctcggtagatgtgttcttacagttttgtattcccttgaaatgtaactgttctctatgttacagcctttataaccttcagttacttgaaatgaacaaattcattcaaattccagcacttaaaagttttaaattacattttggataaataccaaagtgttttgttgatgatgtatgtataaacaaattgtaaatattaaacgttagttgttacgattagacctatataaaacatgatatgcagtctactgaatagctatcagcctctaacatgtttagtgtcatttagaaaatgctttctaaattgccaaaagctgattgtctaggtgataacaaatttaccatttggaggaagttgactttctcattttcatgtcttcatcagtcttacttgatgagattcattcttctagtcagaagagagtttagactgctcagtttactcatattttgagttagcttttctatttagagttcacttggttgtggaatattcatttataatttgaatctacgttgtgtaatgggacctaatttttttttcctttgtttttgttggagtctcgttttgtcacccaggttggagtgcagtggcgtgatctttgctcactgcaacctccaccttccaggttcaggtgattctcctgcctcagtctcccaagtagctgggattacaggcatgcttcaccacgcctggctaatttttgtatttttagtagagatggggtttcaccatgttggccaggctggtctcaaaactcctgagctcaagtgatcctcctgccttggcctccataagtgctgggattacaggcgtgagccgctgagcctggccccagagtttgttttgttttgttttcaagacaagatctcactctattgcccaggctggagagcagtagtgcgatcatagctcactgcagcctgaactcctgggttcaagctattctcctgcctccatcttctaaagtgctgtgattacaggtctgagccatgatgcttggcctgtgtttttgtttgtttgttttgggggacagggtcttgctttgtcaccaaaactggagtgtagtggtgcgaacatagctagctcactgcagcctccatctcccacgctcaagcaatcctctcacctcagccttccaagtagctgagaccgcaggtgcgtgctaccatgcgtggctaattttctatttatatatttattttttggtagacatgaggtcttgtcatgtttcccaggtggtctttaactcctgggctcagacagtcctcccgcctcagccacccaaagtgttgggattacaggcgtgagccaccatgcgtggcataattttttttaagtaaattatttttttatcttgagtatagaagtgattcatgttcattgtggaaaatatgaaacatatagaaaaacagaaaagattacaaaacatctaatctgaaatggttaagattttgatgagaacagtctcatctcatttccgtatattcctgccagcctatccatcattcttcgtacatgtttatctacattaaaattggtgttatattttggaaactttttgtttaactacattgtgaacatttttcatgttttaaaatgtcattttaatgatggcagatcctattcaatagatgtacacacacctatttaactggtccacaattgttggatatgtaggtcgtttcctttctctctttttttttttttttggctactacttaatagtttctctgtatagaatgtggtattttgaaagtgtatcaagctttagattggtagtattcttgcatttaataaagggcagtggcctttgttgactgacatgacaatatttttataaaatttgttatttgctttacagaaattttgaaaattattgtagaaatgtttttacctcatatgaaccacctgacattggaacagactttcttttcacaagtgttaccaaaggtataatactattacctgaaaatacatgttataaggaatctagcctcagtcttagatgatttattattaattatggctctctttttctaatatatcaaatatattcaaaataaaaataaggagtaagtagatctcatgtgagactataatggtgttagtgtgatcattaggcagttaaaaactgttacaggctgggcacggtggctcatgcctgtaatcccagctctctgagaggctgaggtgggcagatcatctgaggtcaggagttcgagaccacccatggtcaacatgatgaaacctcgtctctactaaaagtacaaaaaattagctggacatggtggcaggtgcctgtaatcccagctacttgggagactgagacaggagaattgcttgagcctgggaggcggaggttgcattgagtcaagatcgtgccattgcactccagcctgggcaataagagcgatgctccgtctcaaaaaaaaaaaaaaaaaaaaaagaacttatattttcagattgtgtggttcctttactaactgaatttaaattatttgtagtcaattttaaatgctcttgtattttaaagccactgtactccagcctgggtgacagagtgaaacccttaattcaaaaaaaaaaaaaaaaaaaagaaaagctggaatattggcaaaatcaagtaactaagagaaaacattaaattcacagaatacattattacattttagatatatatggtatatgttttctctgaaaagcacaagcataccttttttgttttaaatggagggaactaaagatactttggtgccaaaatgaaacattatttgtaattaatctcttattgaaatgggtttctaactttagctttgaatcgtaatctttcaaatttcttgtactcatagtcacttgatgattctctatctgaaatatttcttagaatttgttcttgaccaccagaaaaagattcaactgttacatagatgaaaatggatgttgagtgttaacaggcctatgggaaacagtattttctttagctacattgtattgttgactgtgttgctattcttataatgtttaggtcatttaaattgttagaaagatccaagtattaagatctagggtggctaacttttcacagacaaaaagcttgtttgtaaggtcatttactatacccttaattcaggaaggttagcttgaattgggtcaaaaggaaactggttagaaaataagtgagtagtgaataggcgattcagtgcaaattccttccagaaaatacccttgtaaatgactgtatgaatgtggattcttcaagacagtcaaatttattgtgcgaaagtaatacttttattttttgcatctctaaaacatgaactttgagtgattttttaaaaaaattgatgctattaaatagattcaaaccatagaaatggaaaataaatttctgtttggggcttttggggggattatgttgtaaaaataccttttctctgtattttgtgcttaattaggtacaattgttaagctagatgatagcctgtggatgttactagtgcaaaatcaaattatcgtattgtgttttctctgtaaagttttgtcttgtcttttctagtgatttctcttattcctgtttattacttgatttgtttttacagactgtgaaattattcgatgacatgatgtatgaattaaccagtcaagccagaggactgtcaagccaaaatttggaaatccagaccactctaaggaatattttacaagtaagtcaaatgtattagaaagcaggagagagagggagcttaaagaatgtcaaaatttttatactgatactgattagctatgtattcttatgtaatggcctaatgttggaattaaatttatagaattaaagacgtgaatatagaaacatgaattctgaataataaactcttataagaagagaagtcatcaagctagctgaccctacctgtattttcaaggatatgtgtggaacacctgccatgtgttttgaagtttgtgttagtattctaaatggctagacagttgttccagtatttgtagttctgatagactaaagttctgtgaaaagaggaagagactgtgttttgttcattgctgtatttgtagcacccagcatgctgactaataccttttcagtgcacaaaaaatatattctaagtgaaatttccttccttattcacagacaatggtgcagctcttaggagctctcacaggatgtgttcagcatatctgtgccacacaggaatccatcattttggaaaatattcagagtctcccctcctcagtccttcatataattaaaagcacatttgtgcattgtaaggtgagtaaaggtctaattatactttgaatggtatataatcaatgtgcataggggctgagtaaaataatgtttgtataagattttacattttagtctatattattgaaataaacttttccatagaataaagaacatgtaagtaaataattgttgcaaaaaaagtggttttaaggaagtcattaaaagtggctttttggggttttttagttttatcttatttcccctctataaagaaagaagttttaagaatttgtgttgagacagacacagggatcctgaaatagttatgtcatgttgcattgaccaatattcaattaccattatgattagatgtcagaacttccttttataaaggaaagttaatccttatttagtccatctctacatgccagaggtagccttgaggcacaaaagcttgcctagaatttatgggtcacagacagttttaatattgctatttgttgggcgaatgaaaatcactagttaattaatacctctctttgctgataggatgctaaaaatgtcacgcacctggcctaatgttacccttttttagttctgtatttgcaagatcatggaagtcagaaataatattttatacatgcttgcatctcttgaagcacactatatttaatggatgttcactaaacaatgaatgaatatgtgattcagtaaatttatgatctctaatagtatgaattaaagtaaatttggctcttgagctttgatttgttttttctctcatttttatttatccgtaatcagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaataggtgagtgaagaaaactttctgcttagtatatggtgactataaatcatgtatcaattaaaattgtctctaatgattcatgttattttcttactaattatgcattaaaattgatttaaatcttaccaaataaatttttaatcttgaaatttggaatttgtaaaatttattttgggtaccttaacctagatttgcgtatttagttactgtaatttctccacaatgattaacttatataactttataatctctgaggttgtccatattcagagacaataactttcacatttttttaaccataactgatattgagatgcagtttatatttccttccagaatacatataaatacgtgcatatgtgtatgtaaatatgtctattctcatatacatattataatgaaataactcattttacatgtgatgcactttatactagtttatttttattttattttatttttttgagacagagtctcactgtgtagcccaggctggagtgcagtggcacaatctcggctcactgcaacctcgcctcccggactcaagcgattctcctgcctcagcctcatgagtagctgggattataggcgtccgccaccacacctggctaatttttgtatttttagtagagacagggtttcaccgtgttggccaggctggtcttgaactcctgacctcaggtaatccacctgcctcagcctcccaaagtgctgggattacaggcatgagccaccgtgcccagccaatactagtttatttttaaagaattgctggtcgtaacacacttcattgattttatcactcattaatggattatgaacaagagtttgaaaaacaatataaaggcaaagtttgcattcaaaactttggtataaagagagtaagttggttttgtgcagtgtatcaggcacctgttgctctgcaacacaccacctcaaaatctatttattcactatttatttattcatgattctgtgagtctgcagtttagggtgggatgtcctgagacaactttctctgatccacctggggcactagctcacccatgtgacttcagtgacttcattcacatctggctgttggcagaggcagaagtacttgagaaagccatgtgcatcatccagcaggttcaccctatctcagatacctgatgccagtggtttcagggtttctaagagtagcaaaagtgtgagcaggtcgctgtgtgctagcacttttcaagtttctgcttgccttaattttattattgtcccccgggccacagcaggtcatagcgtttagcccagagtcattgtagaaaagtgtggattcacaaagggcagtcattgtggccatttttataaataatctaccacagactgagtaaaagccttgcatgaataccatggatattaatttgaattcttcctttttagattttctttccttagcaatttgttttgtcattttggattagaattatatctgtagaatatttcagttataatagggtacaacttttattccactgaacatctttagttttatttaggtcatctggtaggtataaacttcagaagttaatattcaatatttataaaaaccattaacaagtgtgacacttaaatagtttaaataattcttttgacacaactgtttccaagttgtgttacgtattttaattcaatcaaatgttgaaattgttcagtagatagttttaattataggagaaactcacccccatgacatttggatgtcttaaaagttctgttatctttctttgcagttattcattctttattggatatctgctctgttatttccagtatggaccatgcatttcatgccaatacttggaagtttataattaagtaagtttgtttgttattttttactttttagaaaatgttttccatattccccaatcttaattattcatgattctttagattgcatttaaaacattttgtgtgaatttaatgttcactgacactgctgtctgataatccagatattctacatgtagctctcaagccaaattggacttctttaccctgtggcctctaaaattaaaaaaaatgttcttcctagttagctagtacttcagaaataatgggccatgggccagactagaacttaaccacttttcttctgctactgttgtttaaccagctatcaagtatcctatttctaggattagataaattgataactataattaaaactgaatataatcttttcattaggtacttttaagttgttcacacttaattccatttgtacagtaattttaactttctgaaactgaagcattttaaagggtcaccagggatagtgcctgtagcattcatcagattcttaggggtgagaggagatgtggttgagatgtaaaaatggttaagaatatctactttatacacatacataaaacattaaaggtcagtgtattttcaggtcttaggtacttttcttgtactaccaggacattaagttgccattcagtggttaagagtgttgcctgggagctgtatcacatgtgcttaaatccattcttgaaatcatttactccttctgagcccttgggctatttggttaatttctctgaacgttagtttgctcatctgaaaatggaaataataatagcaacttcttgacagggttatagtgagaattgagttcatcactgtgaaatgcttagaaatgtgcatgacacatagttaatactcaaggaattagccacatcactatcatcatcactgattatcttccactcttaccctcttccagttcattttctgcccagcagaatgatcttttaaaaagtaaatcagatcatgttactctattgcttgaagtctatcccatttgattaagaataacaacctaatcctctgtggatgctgcctccttcaccagcctgtctcatgctgctctccctactcttagttcctcaaacataccaaactctcctgtcccagagtcttttcgtggtttttccatctgcctaggatgcttctctctcctattttgtgtaccttgctaactcctgcttactgtctttcagttctcagcttaagagttatatcttcatgataacattctttgatatccttaccctaagattaagttagattgatatccttaccctaagaataagttagattaggtctctctattgtagcaccttagactctgtcatttgacaaatcacagccctaattaattattcttaaaattatttaacattctctctcatgctagaccacaagtttcatgcaggtaaggcggagattgtgtccatttgtttgacccctttgtctccagggcctggtagaatgcctcatacatagtaagaattcaattaatattttacacagagaaaaaattagcaacttatttaaacaaatataactgcttcagaggtaaactgggcacatcttagttatattatgtgatatatgatgctttttgattgtttttttaaatgttctacaaggtagatattgttagaggtcctaagttacttgatgtgttacttgtggtgattgtattcttttctttttattcatttaggcagagccttaagcaccagtccataataaaaagccagttgaaacacaaagatataattactagcttgtgtgaagacattcttttctccttccattcttgtttacagttagctgagcagatgacacagtcagatgcacaggtaaaatttgggctaatagcattttaaacagcaactcttattttctttggcagttagtaaatctcatttgaatgtctgggtcagtctatttaagaggattttaatttatttcatttgggtgtttttttttgatctgtgggattatttatatcccataattacttttcacccagagcattgtattagattcctaactgctgtcattgcctctggggtctgcctggctccctctttgcttggtaactggttggtcacagcattcttctcagaatcctttcattcttttctgcatgagaacaaaaattcttttgttcatatttgtataagatctgatatagctgcaatcaatcttgcattttttcttcaccaacgcattgcgacctttagggatacaagtatgtttgtgcatgtatatgtatgtatcagtcttttaaatttgatatagtcatacatttgtttttattttgaaaagttagagtgttgaattggtatcccatttatgaaacattatattctaaaaatttgtagtacgattattgggaattataactcattttcctgtaacactgttatacatagtaccttttgctttcagactagccctcaattttatttaactatagtagtcctaaattataagattaatagtactcaggacctaacagttatatgtcatttgttttttttttttttgagatggcgtctcactctgtcacccaagctggagtgcagtggtatgaccttggctcactgcagcctctgcctcacgggttcaagggatcgttctgccttagcctcctgagtagctgggattataggcgcctgccaccacgcctggctaatttttttagtagagacggggtttcgccatgttggccaggctggtctcgaactcctgacctcaggtggtccacccgccttggcctcccaaagtgctgggattacaggtgtgagccaccgcgcccagcctatatgtaataattttaatgggaccatgaattgaatatttcttccttgaatagcaatgacatagccccttctattgtacatctgcaagctgatacagggaattcctttgtacctgcgctcttccctgccagtcagctatgggggtgaaagtgtaggggttcatccaagtcctaaaactggtagcaactcctagggcagggctgatctggaaggacagaccctaggggagggtggaactttaaaaagaagttctgaaggtagtaagaaggaaatgaggagtagtgttaggaaggggctaacttttttcttcttgcttctcttctttatctcacctgcccctccccttgtatcccttcttcctttttccctttccttttttgtcctcacttcattcgtgcatcctttctgattcctcttaccttgctaaaaggagaagtttgtttgggtatcctatatcaatggcaggaaggttgttttcttctttacctttatcctatagattcatattctcaacaccaacctcctcctttttcagtttccttcttgcttctcttgacaccacagagtttgcagctagtacttggagaggaaaattaaacagagatacttggaccaagagtaagatgaagaaagtctaaacaacagtatagtctatagtggcaagagagagtatgggggctgcttagccagggtggctgtacataaagtatatcttcagtttatataaactgcttatagatggaaatcagaaaatttaaattctcttaactgtccaagaaaattctcattttttcaaatttgggactgataaatgtgaccagttctgcttactgtccattgcctgaaatggagctttgaggtggactgtataatttcttcaatcttaactccaaattctgatcagcgacgccctctgctgttcactattaatatttatttaccaatcaaagtaaagtattgaagttttcctggcagttttcactttgtgttttagtccatttaggctgctataacaaaatcccttaaactgggtaagggattataaatattagaaatttatctctcacagttctggaagctgggaagcccaatatcaaggcaccagtagatttggtgtctaacgagggtgtgccgtctgcttcaaaaatggccccttgttgctgcatcctcacttagtgcaaggggcaagacagctcccttcaacctcttttataagggcacttatgtcattcatgagggcagagccctcatgacttaatcacttccccaaaggccccacctcttaatagtatcacattgggtgttaggtgtctgggaggacaccaatcttcaagccatatcatctcacttggaaaaaagtcaaaataaaaccagtagatttaattaatattacactatttatagaagcatgtgatgtatcattccttgtattaatttcctggggttgccgtaacaagttaccacaaactaggtggcttaaaacaatagaattttattctctcacatttctagaggcagaagttcacagtgtgtcaatagggccatgttctctggaaggctttaggggagaatatatttcatatctttctcttagcttctcggtgtcactggcaatccttagcttactttggctttctgtgtcttcacatcatctttttataagaacaccagtgatagtgattaagggcataccttactttaatatgacctcatcttaactaattatgtcttcaataaccctatttccaaataaggccacattctgaagtattgggagttagaacttaaagctttttgggagggacacagttcaacccataacaacccctaaaatcgatatttattctcaattaagtcttgaaattggtttcaaaaagagaatattctattagagtttttaatgtatagttttaacatatagttctttagcccccaattttttttttttttttttttttttttttttttttttgagacggagtctcgctctgtcgcccaggccggactgcggactgcagtggcgcaatctcggctcactgcaagctccgcttcccgggttcacgccattcccctgcctcagcctcccgagtagctgggactacaggcgcctgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgcccccaattatttagtttttctataaacagggaaatttatttgtgtggcccttagaactaatttaatttccactctaattcctacttatgtttatataatgcttttagaaatttgtattattcagaaaataaacatatactattgtatctgttgcctacacttagattttattgcctgctatatttaaattttattagtattttaattgttttattaaagaaagaatgtgcctgtaatctcagcacttttgagaggccaaggcagaaggattgcttgagcccaggagtttgagaccagactgagcaacacagggagacccccatctctacaaaaaataaaaaaattctccaggcctcatggcacatacctgtagttctagttacttgggagactggggtgggaggatgcattgagcccaggagattgaggctgcagtgagccatgatcaggccactgtactccagcttggacaacagagtgagagcttgtctagatagatagatagatagataatctaaatagataatagacagattatctaaatagataatagacagattatctaaatagataatagacagattatctaaatagataatagacagattatctaaatagataatagacagattatctaaatagataatagacagattatctatctaaatagataatagattatctaaatagataatagatagatagattagatagatagatagatagatagagcttggacaacagagtgagagcctgtctagatagatagaaacaaagaaagaaagaaagaatggtgctcatattttaaagcattgaaaaatggtcttccttgcttatattacccacaccttctttgttggcattaagatgcaaactttgttttaaacagttgagtaaatcaaagatgggactgttaagttatttgtgttatttacctgctttttgaaaatgtaaaaataaaactctaggtttaattagtagtatgctatttagtaatgaagtaaagctagaggcttcgaacaaatcttgtgtaatttcctcttgaatgagagagaaaatttaaagtaagcaaacaaataagttgtgtgtcaccactcattcagtcatttaacaagtatttccagagtacttattctgtgccaggaaatgttgtaggtgccctcaacaacttagagtctagcctgagacacaagtaagtaggtaattattatagaatggtatgatctttggaggactgggtattggctggctcatgggagtacaagataggtacccagtgatgaagtcaggaaaggtttcttatggtgatatgatgacgtctatgctgattataaggtcagtgtagaataaactttgtgcttttaaatttgcatagcactgtattagagagttcatcttcaaaataatcgaaaaggctgagtgtggtgacccatggctgtaatcccagcactttgggaggccgaggtgggcagattgcttgagctaggagttcgagaccaggctggccaacatggtgaaaccccgtctctactaaaaatacaaaaattagccaggagtgatggtgcgcacctgtaatgccagctacttgggaggctgaggcaggaggatcacttgaacccaggaggtggaggttgaagtaagccgaggtcatgccactgcactccagcctgggcaacagagtgagactccatctcaaaaaaaaaaaaaatgatcaaagaaaggtgaattttcatctaccctatttctgctgaggaaaatggactattttcaaatatttttaataagggtcaaaatgagggatc

SEQ ID NO: 2481 - DNA, 1310 bp; single-stranded, linear; identical to SEQ ID NO: 2469

SEQ ID NO: 2482 - DNA, 1868 bp; single-stranded, linear; identical to SEQ ID NO: 2470

SEQ ID NO: 2483 - DNA, 752 bp; single-stranded, linear
caccgctcctgtcagccaacaaatatccattgagcgacacctgtgtcccaggtgctgctctgggccctgggagaagtgcatcagtgggcttggtagtagagggtagggatggagtgaagggtaggcaggaagaatgtccccaggctggtaggaggtggggtggggggtttcagtctcaaaactcccatgaaaaccagagagaagtttcagaactccacccaagaggctgggtttctagggcccagagctgccctcccccaccctagaatgggctataaaagtcccttcccagctacgtccagagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccaggtaatagtcccctagacaggcaaggaggagggaggggaaatggaaggggaagcacttgggtcttggagggggtcttgtggcttgctgaaccctgagtccccatctctttgaacagcctcccctggggcagtggagacctcggtcctgcgagactgcatagcagaggccaagttgctggtggatgctgcctacaattggacccagaagaggtggacttgggtctgggggctgcatgggcctgggaggatcagt

SEQ ID NO: 2484 - DNA, 403 bp; single-stranded, linear
taataccttgtggggtcagggagcccatgtcccgtgctgatgttatttccccaccaggtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaaggtacctaccctcagccaatctcccatgcccttgtgtggcctcccccaaaggcaaggtgctgggggtggggatctggaagactggagcaccatccttaaggagctgcctgtggagctagggtatgagacagagacacaag

SEQ ID NO: 2485 - DNA, 482 bp; single-stranded, linear
cactgtctcctcttccatctcagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtcagacagggaggaaggtggtgtcttcccaggaaacagccatccctggggtcccaactgggaagcaatggtgggatgtggtgaaggtacatggtttgggacctcagtattaggcacaccataagcatggatctgtgcac

SEQ ID NO: 2486 - DNA, 325 bp; single-stranded, linear
tgaagagatggaggtccagtgagggccaggagtttggcccaccccgtctctcccatccccagccctgggtctaccctggtagaaagacatttctctgggaaaggctgcagtaaatctgagcttggggttttcaaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccaggtaaggagctctgcatcccagcatccccc

SEQ ID NO: 2487 - DNA, 464 bp; single-stranded, linear
ctttgtatctccacccaccaatagtaaattaatgttgtcacatttgacgtgatgacaataaagaatatgtctgagccaccctttgaaaaggcaagggtatgggtgagtagcctctggggaatgttcctcctgtcttcccttccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaaggtgaccaggttttccagggggcaaatgggggtgagggtggggagcatgccctcccctaggtgg

SEQ ID NO: 2488 - DNA, 410 bp; single-stranded, linear
tccagctgcttcatgtctctccagaactctgtttcctgacaaacgttactaacatacccgactggcttgtccagctctgggctagcttggcatcatgtgataacccaagtagcttcccagaggctggtccaatctgtgctgctcacattccctgccaccagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccaggtgagggggctgtccacctcttctcccagctttgctcgggccaggctgctcaaggggttctgggaagaccctggtacc

SEQ ID NO: 2489 - DNA, 437 bp; single-stranded, linear
cgactgcctggtaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggtaaggggaggccacctccagcaccctgggctggttaagcctcacatccttccctggatggatggctgagtcctcttaggtctctaagcagagaaaacagaacttgtcactaggtactctttccaagtggcttcccaatgtgctagtttctgggctgacagtcaattccaggccctaggactttggggggaaattaggagcatccaacta

SEQ ID NO: 2490 - DNA, 2558 bp; single-stranded, linear
gaattccgtggccaggacccctgccagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcattgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagccgagacggagacaggttctggtggcagaacgaggtgttttcaccaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctcgtgacgcttctgctggctacagctcagagctgggttccccagccaggagtgaaggctgggggctcctatcagcaatggaccttccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgccggaattc

SEQ ID NO: 2491 - DNA, 807 bp; single-stranded, linear
gcattttttcaagttttatgatttatttaacttgtggaacaaaaataaaccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatattttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatac

SEQ ID NO: 2492 - DNA, 294 bp; single-stranded, linear
atgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataa

SEQ ID NO: 2493 - DNA, 2655 bp; single-stranded, linear
ccacatattcccctccttttccaaggcaagatccagatggattaaaaaatgtaccaagtccctcctactagcttgcctctcttctgttctgcttgacttcctaggatctggaatctggtcagcaatcaggaatcccttcatcgtgacccccgcatgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccaggtaagccccccaactccttacaggaaaggtaaggtaaccacctccaggctactaggtcagcaagaatctttacagactcactgcaaattctccatttgaaaaatagggaaacaggttttgtgggtggacaagaaatgcctcaaccgtcacatccagtcactggaagagccagaactagaaagctcccgagtcttttccccacattcaagagggccgctgggtgcatccttacccagctatccttacagtgtttgggaatggggaatggctctgtcttactgtgggcatggtgggcatttttggcagtgggagagaaggaaaatctgttgattagaagctcagtatgttaattcgactccaggacagctttcagagacagtggctaagagaagaacgaggtcccaggggatctcttgaggtgacttattttgacactctttgggaaagttatctaggagatttgttccataactcattttcccatactctggtgacaaatttactgagtgtatcggtcccactgagccagtgcatagcatggtaacaaacagttctaaattatcaatgacttaacagaattaactaaattaacaaaagttactttctcacttgtactaaatatctataatgtatgggctcaggcttctgcattttatactcaggattctagactgatggagaagttgccatgtgggggaacattgatggatactgtgataaagcagaagaaagctctcaggagtcttgcataggcaatgcactgtggctcaaaaatgacacccatcactttgtctccttctttattgatcaaaactaattaatgcctccaaccaaacaaaagtggccaagaaatgcaagtctaccttgtgtctcaaaacagaggatggagaatatttggtgaaaattaccatgaccatcacatggccacgtaggtctttataatgacagagctagcatttgtcacattgaccaagctttgtccatacactctacagtaatgatgagtcctcagtgcacaggggaggatgctgaagacacaggacagcatcctccagacacataagacttcagagcagagggattctccctccacctctcgcaattccttgctttctcctaacttcctttacaaagtcatgcttggaaatgtctatgtatcatcatgtggctcatttttttctctgttcattttttttccccaaaattcagcttctgtcccaaccacctgctgctttaacctggccaataggaagataccccttcagcgactagagagctacaggagaatcaccagtggcaaatgtccccagaaagctgtgatgtaagtaaataaagttcaccctcccctagacaaaaaaataatgtctagggcacagagtcaagaactgtgggagtcatagactctgatagtttgacctctatggtccaattcattaattttcacaagtgagtgttcactcccagctccctgcctgggagattgctgtagtcatatcaatttcttcaagtcaagagcaaagatggttttactgggcctttaagagcagcaactaacccaagagtctcatccttcctcctctccgtagcaaccctttgtccaggggcagatggtccttaaatatttagggtcaaatgggcagaattttcaaaaacaatccttccaattgcatcctgattctccccacagcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatatatatttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaatgttgttttaggaatacataaagtatgtgcatattttattatagtcactagttgtaatttttttgtgggaaatccacactgagctgaggggg

SEQ ID NO: 2494 - DNA, 3756 bp; single-stranded, linear
gcattttttcaagttttatgatttatttaacttgtggaacaaaaataaaccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatattttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaccacatattcccctccttttccaaggcaagatccagatggattaaaaaatgtaccaagtccctcctactagcttgcctctcttctgttctgcttgacttcctaggatctggaatctggtcagcaatcaggaatcccttcatcgtgacccccgcatgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccaggtaagccccccaactccttacaggaaaggtaaggtaaccacctccaggctactaggtcagcaagaatctttacagactcactgcaaattctccatttgaaaaatagggaaacaggttttgtgggtggacaagaaatgcctcaaccgtcacatccagtcactggaagagccagaactagaaagctcccgagtcttttccccacattcaagagggccgctgggtgcatccttacccagctatccttacagtgtttgggaatggggaatggctctgtcttactgtgggcatggtgggcatttttggcagtgggagagaaggaaaatctgttgattagaagctcagtatgttaattcgactccaggacagctttcagagacagtggctaagagaagaacgaggtcccaggggatctcttgaggtgacttattttgacactctttgggaaagttatctaggagatttgttccataactcattttcccatactctggtgacaaatttactgagtgtatcggtcccactgagccagtgcatagcatggtaacaaacagttctaaattatcaatgacttaacagaattaactaaattaacaaaagttactttctcacttgtactaaatatctataatgtatgggctcaggcttctgcattttatactcaggattctagactgatggagaagttgccatgtgggggaacattgatggatactgtgataaagcagaagaaagctctcaggagtcttgcataggcaatgcactgtggctcaaaaatgacacccatcactttgtctccttctttattgatcaaaactaattaatgcctccaaccaaacaaaagtggccaagaaatgcaagtctaccttgtgtctcaaaacagaggatggagaatatttggtgaaaattaccatgaccatcacatggccacgtaggtctttataatgacagagctagcatttgtcacattgaccaagctttgtccatacactctacagtaatgatgagtcctcagtgcacaggggaggatgctgaagacacaggacagcatcctccagacacataagacttcagagcagagggattctccctccacctctcgcaattccttgctttctcctaacttcctttacaaagtcatgcttggaaatgtctatgtatcatcatgtggctcatttttttctctgttcattttttttccccaaaattcagcttctgtcccaaccacctgctgctttaacctggccaataggaagataccccttcagcgactagagagctacaggagaatcaccagtggcaaatgtccccagaaagctgtgatgtaagtaaataaagttcaccctcccctagacaaaaaaataatgtctagggcacagagtcaagaactgtgggagtcatagactctgatagtttgacctctatggtccaattcattaattttcacaagtgagtgttcactcccagctccctgcctgggagattgctgtagtcatatcaatttcttcaagtcaagagcaaagatggttttactgggcctttaagagcagcaactaacccaagagtctcatccttcctcctctccgtagcaaccctttgtccaggggcagatggtccttaaatatttagggtcaaatgggcagaattttcaaaaacaatccttccaattgcatcctgattctccccacagcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatatatatttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaatgttgttttaggaatacataaagtatgtgcatattttattatagtcactagttgtaatttttttgtgggaaatccacactgagctgaggggg

SEQ ID NO: 2495 - DNA, 70 bp; single-stranded, linear
gccaggtcgctgttggtccacgccgcccgtcgcgccgcccgcccgctcagcgtccgccgccgccatggga

SEQ ID NO: 2496 - DNA, 880 bp; single-stranded, linear
ggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgaca

SEQ ID NO: 2497 - DNA, 1532 bp; single-stranded, linear
gaattcgggccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgcccgaattc

SEQ ID NO: 2498 - DNA, 584 bp; single-stranded, linear
gccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccrtggagggatctggtgcctccagacatgtgcacatgartccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattca

SEQ ID NO: 2499 - DNA, 3066 bp; single-stranded, linear
gccaggtcgctgttggtccacgccgcccgtcgcgccgcccgcccgctcagcgtccgccgccgccatgggaggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacagaattcgggccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgcccgaattcgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccrtggagggatctggtgcctccagacatgtgcacatgartccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattca

SEQ ID NO: 2500 - DNA, 693 bp; single-stranded, linear
aacaagaaaagcgttggtagctctggtgaatcccaaaagaatgtggcagttgctagccatgctcctgaatatgtataaacagtacatcatatgactaagagtttgacttaggggttagattttatgtgtttgaaccccaaattagttatttaatagttggcaccccaaaacaagttacttaacctcactaaggttcagttttcctgtttataaaatgtagatagtgatagtatgtactttataggattattgtgaaaaataaatgaaatatcagatttatttaggataacacctggcatatgtttggtattcagaattagttgctgctgttttattctgctctcccttgcatcccacttttctaagttgtaaactaaatagttgtacacagattgacagattaagaaaggcttgtgattgtgctagacctatgcctatgcctctgtctcaccagattccaggtgtatatgtggaggtgggatagggagtggagtaagtgggtaaatattaaattgcccagttgggcaccatcctgaatattatctctaaagaaagaagcaaaaccaggcacagctgatgggttaaccagatatgatacagaaaacatttccttctgctttttggttttaagcctatatttgaagccttagatctctccagcacagtaagcaccaggagtccatgaagaagatg

SEQ ID NO: 2501 - DNA, 7659 bp; single-stranded, linear
gatcttcatgtggaatgactggtttcattcaatagacttaattcagcagtctgtggggaagagcaaggtatgatagaatggttcctcaagtgcttcagatgtgaagtgggtttaaatatactgtccctgtcttcttcagagttttggtaaagataaaataggacactcatttaaaagcaatctttgcaaatgacaagccactatagacattaatagagttttcatttccagtattatcattaatatcagatcctggaagaaggttgagccttgacctagagcaaaaaaacagaagaattagtaaaggaatcctggagaaagcccctgctgtgtatttaaaggagaaagggagatcatgttgggaaattataatattaaaagtaaacaaaagctaggaagtaaaataaaataaattatatggcctagatccccataagtaatggtttaacttctgccttcctgtgttctgagccagattagggcacagtagagaaagaggagtctctgaaaatgtttccaatttcgctggtcagacagcggatcatcagtgaatcagatgaaaatttgtggatttatgcactaactgatcagcaggaaattaaacaagaaaagcgttggtagctctggtgaatcccaaaagaatttggcagttgctagccatgctcctgaatatgtataaacagtacatcatatgactaagagtttgacttaggggttagattttatgtgtttgaaccccaaattagttatttaatagttggcaccccaaaacaagttacttaacctcactaagattcagttttcctgtttataaaatgtagatagtgatagtatgtactttataggattattgtgaaaaataaatgaaatatcagatttatttaggataacacctggcatatgtttggtattcagtaattagttgctgctgttttattctgctctcccttgcatcccacttttctaagttgtaaactaaatagttgtacacagattgacagattaagaaaggcttgtgattgtgctagacctatgcctctctctcaccagattccaggtgtatatgtggaggtgggatagggagtggagtaagtgggtaaatattaaattgcccagttgggcaccatcctgaatattatctctaaagaaagaagcaaaaccaggcacagctgatgggttaaccagatatgatacagaaaacatttccttctgctttttggttttaagcctatatttgaagccttagatctctccagcacagtaagcaccaggagtccatgaagaagatggctcctgccatggaatcccctactctactgtgtgtagccttactgttcttcggtaagtagagattcaattacccctcccagggaggcccaaatgaatttggggagcagctggggtaggaacctttactgtgggtggtgactttttctaggacatgtgcaaactattgggcatttcccagggactctgtagtggagccaagctagaaagcagaggcaagtgggctgagcaacacctaaggaggaagccagactgaaagcttggttccttgcatttgctctggcatcttccagagtgcaaatttcctaccaaggtaatgagggtagaggagagaaagaagctctttcttcccctgattctcattcctgaaaagacggttggtccttaaaattccatggatgtagatcttatccccacacccagattctagtcctctggagataaagaagactgctggacactaatgtatcctctctggacttttgcagctccagatggcgtgttagcaggtgagtcctctgttcttgttcccttggtgtatcaacatgtctgggcattgctttcctctcactattttcttcgtcccatcacttctgctttctaatgagcatgaatctgttccttggccagactactttccctctccaccttgccttgtctttctttttttccctgattcattgcattctctcaagtcattctctcctctgttttagtcaataaccatgtctgttgcacatatacatgtctcattctctctcctagacactttggcatgatctcgctcaataattacattattattattattgccattttataattgaggatgctgaaactcagtgattttctggtggttacatggctaaggaactggatttcaacgtaagttccttggatctaagtccagttctcttctgactatatcacccttttgttatcaccatgtatctacttctttggtctctgttcaaatttgcactacatccccttgttccaggaagccattcaagactgactttcttagtgcctctcactactttctggaactgacatatgtttttcactctgtatatacttacaattaaatagtcataaatattcagagcttggagaaaccttatatttcatccagtccagtaaatttatccatccataattcactcattcattcacataataaatatttaatgtaacaatggttgaacatggcagacagtgtttctacctcaaaagagattgcagtcctcatttacagatactgaattgaaattaacagaagtagagtgagtcagctcaaatcacatagtgaattggtttctttgtttttaaatctcctgcatatgtgtcctgtctttctccctgtgttgggcgttccctggggcaccaatactaatttctccttcccctagaaatcaaaacagggtcttatcaccaacagaataaggacaggttgaccactgattgtcagaatattgcttcgtttgtacttttaagcctagacagttttcaatgactttttttctctctacatgtcttttcatatttttatcttcttgaagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtggtaagttccagggatatggaaatacagatctctcatgtgagggatggctcatctgaagatgggaaaaaacaggttattccaagggttaggacaccagagtgggattcaaggcctctcatttttaagacccctgcattggctgggcacagtggctcacgcctgtaatcccagcactttgggaggctgaggcaggtggatcacgaggtcaggagatcgagaccatccggctaacatggtgaaaccccatctctgctaaaaaatatatatatataaaattagccgggcgtagtggtgggcacctgtagtcccaggtactcgggaggctgaggcaggagaatggtgtgaacccaggaggtggaggttgcagtgagctgagatcacgccactgccctccagcctgggctacagagcaagactccgtctcaaaaaataaataaataaataaaaaagacccctgcatctcttttcttctacccccttcccttttgattacttgtatgccttctttcaatattctagtcatctctcaatattattcctccaccctattttcctctatcttttctgcctagattcaggtatatattatgtggtcaaacagcatgacatatatgtgaacatttcaaagagctgtgtatctggaataggatcaaaaggtttgacttaaagttttgctctgcataatccatatggcaggacctgaatattaggttgtactcttcgttatgaaacatatctgggtacatttccttatgtcctctgttgttacttaagaacacatatttcatgcttgtttcatttttatcactcctactgccaacaaatagcatagcatgcttaggcacatgtggcttaattagcaaatgttgaataaacaaattaatgattttgaatagtgaccaataggtctcttttatactctatatttttctcttgagtgaaaaaaaatgtttcaacctccatatgtaaattccaaacacaaactaaagcaatgtagaatagcttctttattccctggagtaggttctagagaagtcctaaaggattggtcctaaattaattatgcttattatgctagcgatatttcctttcaaaattctcctttaatgaatgctttttaatttttacaaaagcattaaccatagaatgtgattcttgtctttcactgactcattagtgacaaatatttgttgagtacctaccaactcctaagtattgctaccaactcctaaatactgtgttgggcattcagaatagaatgtagaactagacagggtccctgacttcttggagcacagagcagtatgggaagaggacattaaataaagaattacataagtaattaatttaaattatacatgttttgaagaagtttttttttgacaactataattaacactagaactgggaagtttctataaggtaagagaggacaaaatagacactctcctaagctaaaattcccaagaaagactgtttattttcccctaactaactagaactagcaacagaagatctgaaaggaattctggctttcaagtgttccatgtatggactcatcagggaggtccgagaggctttgtggccccagactgacttttcaggaggggaaaggatttatcaatacacaagacaggctctaagcattattttgtgccctttaaaaatccactttatgagccaaaaagtgagttaatgataattcatagtttctgacacatgctctatgcgtggctctcttttctctattcattctctctctcttcatttattgttaaataaataatgtaatgaatgttcttcagactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaaggtgagttggtaaaggaaaggaaaagcatccatagcaggggaaggaagagagaacttctgagcctgagcagttgcagcttgtagaaggggggcacctgtgatacactggaaagcctaccagacttgcaatgaggagacctgggtgatagtatatatctcaatctctgtttcaaagccttgacttgttaaatggtgatagtaatacctgcttgcactatgaaatttttatgaagattaatgtggtaatatttgtgaaatgactttgtaaactgttaagcactacccaagcataacagattgtgattactattttgatctcaaagtcatctgttgctcctgggggaacacttatatttatcaaattgaaaaaaagtttcaaagttgaatgaagaaaggatataaagagcttgaggagcccattccagcttaggagggctgggaaaggaaaccagcaagtcagtaagctgtgtgcctgtgtattgagggaggagggaatggacttgatatggagagggtagggaggtggactgcctctatggcctgtaagaaaaactgctctctccaaactctttataagagagggagcctgtgaagtattcacttttgaaggagaaagttagacttttccttcacacactttgtacataataatgtttaaaaaagcatgaggtcaaaatacataattaagtcctagcagttctctgttaactaatttgagactgaagtgctatgtacttgtctctaggcttccagtatcttcatctgtaaaacagaatatttggtctagattccattagaatcatttgataacttaaaaaatatattgatgctcatgtctcatttcttgagattctgatttaattggtttggggtgcagcctgggtatacgtatttttcataggtctttcacataatggtaatgggtagccaatattgagaatcacttgtctaggtgatctttaaatgatttctggatgtaatattctgaggctctataatttgagactaatcacaaaaatcggtacagtttataaacagactaacagaaccacaaaataatagaattggaaggcaatttaactagtgcaatttcttcattttgcctaacaggcatgtaagaaatgatgattgattgagtaataggcattgatgacccctgtcctcactttgtcccctttccaccccttaattatatgtgaattctggtcttgtcatttcgaataaggggtttatctttcctattgtcttcccctctgggcacggcacactggctactggagttaagaggaaatgcttaggactccctgtggctccagggagcaccaacagagcaactcaacctagtgttaatctgagtgttttctctgtgcttctggatgccacatcacgctaaaaatgaaggacaaagcttggtctttctcttagggaggatgaaactctgaacctcatttttcagttcccaagatgaattatgtttctcattgcatctgtgttccactacagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtattcaaggcttgctagtttgtttgtttgttttctactaaaggcaaggaccatgaagttctagattggaaatgtcctctcttgactattgcaagtgcgatctaggaatgaaaagacataggaggatgccagtgaggtggatcatttttatgcttcttcttcagcttactaaatatgaactttcagttcttggcagaatcagggacagtctcaagacataggactctcaggatgaagtagagtccaggattcctctgtgattgttttgcccctcccaaatttatatcttgaacttatgtcttgtatctttatacagcacctgaaccaagcattttggagaaattccagctaataataataaccaaaaccttcggctctgaaaacagtccaggactgaataagatcttgggcaaaagaactagacagttttggtttattttccctttcattttatgtcttcatcatagtcattggaggctcattcttcttgtcatggagtaaatgggattaaagttc

SEQ ID NO: 2502 - DNA, 1198 bp; single-stranded, linear
tactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtaaaaaaaaaaaaaaaaaaaaaaaaaaa

SEQ ID NO: 2503 - DNA, 894 bp; single-stranded, linear
tctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctgggggtaacacaaattctgactgctatgatatgcctttgttttggaacagttgtctgctctgtacttgatatttcacacattgagggagacattttttcatcatttaaagcaggttatccattctggggagccatatttttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggtttt

SEQ ID NO: 2504 - DNA, 11298 bp; single-stranded, linear
aagcttttcaaaggtgcaattggataacttctgccatgagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttctcaatttttctattcatcacaagtaaaagcctgttgatcttaatcagccaagaaacttatctgtctggcaaatgacttatgtataaagagaatcatcaatgtcatgaggtaacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccaggtaggtacaaggtattatttttttctaccctcagtcacttgtggcaggggaagtcatagtcacggtgcttaggagatgaaactttattgatttaggcatggatccatctagtttaattaatatattgggtatgaggaagctacttgctgtactttccatgtggttctctctccctggagaggaacatttttactcagcttgcaaactggaaatagattttctcacattagaagctcattttctgggtatgagacaggagagttcatactgtgtatgtagatctctggcttctgggtctgacatgtgctgagggacacatatccttcacacatgcttttataaatacttgataaagtaacctgcttcttgattggtctttataatccataagctgtgggatgcttctctgaagatgaaaatagtaatagagtcccatctagctattcaaagccattccttcattgtattctgtgcacatgaagttggggtttgttactgacaaaatatattcagatacatttctatgttaaaaggattgtgagatgcataggtaaatgtgtttattttcagttttacttgtcaacatagatgaatgagaaagaacttgaaagtaacactggattaagaataggaaaatttggcatggattttgctccattttgtcccatctaatcacttggatagtgttcaggtgttcttggtcagttacttggatgctctgagctttagtttcttggtgattacaatgaagatttgaattacaggatggctttgaaaaaataaacaaaactcccctttctgtctgtcgagaatgttgcacagggagttacagaatgttctcatgactgaattgcttttaaatttcacagtgtgcctgcatttgaagtcttggaaatatctccccaggaagtatcttcaggcagactattgaagtcggcctcatccccaccactgcatacatggctgacagttttgaaaaaagagcaggagttcctgggggtgagtgagcctcctccaactttgactagagtaagggttgggtctagaaaagaatattgagttgcatcaactgttttcccacttggattcatgagaggtgttaggtcctttaaaaaacatggtagataaagagttgacactaactgggtccttttgggaagagccagaagcatttcctcataaagactttaaattgctaggacgagaatggccaacaggagtgaaggattcataactttatctttacttagatgtaaagaacaattactgatgttcaacatgactacatacataaaggcgcatggagaaaagtattggccttccatgcattaggtagtgcttgtatcaattcttatagtggctagggtatcctggaaaatcttacgtgtggatcatttctcaggacagtctaggacactaacgcagtttctcatgtttggcttctattattaaaaaatgatacaatctcgggaaaatttttttgattttcatgaaattcatgtgtttttctataggtaacacaaattctgactgctatgatatgcctttgttttggaacagttgtctgctctgtacttgatatttcacacattgagggagacattttttcatcatttaaagcaggttatccattctggggagccatatttgtgagtatatatctataattgtttctgaaataacactgaacataggtttttctctttctcagatctaaccagttgtttattcccagtattaagatgatatttataattcttaattataaatatatgtgagcatatataacatagatatgctcattaacaacaacaaaagattctttttacaattaacggtgggttaaacatttagcccacagttttatcccatgagaaacctgaatctaatacaagttaaatgacttgcctaagggccacttgactaatagtaattgaacctaaactttcagaatccaactccaggaacatacttctagcactattcatcaataaagttatatgataaatacatacaactttatctgtcaactaaaaataacaacagaggctgggcatggtggctcacacccgtaatcccagcactttgggaggctgaggcaggtggatcacctgaggtcaggagtttgagaccagcctgaccaacatggtgaaacctcatctctactaaatataaaaaattagctgagtgtgatagtgcatacctgtaatccagctacttaagaggctgaggcaggaggcttgtttgaacctggaaggcagaggttgcagtgagctgagattgtgccattgcactccagcctgggcaataagtgcgaactctgtctcaaaataataataataataatagaaaataaagttgtcttcatgaaaaatgaggaaagagattgctggggtgagaaacattaagatcaatgggcatatggtgaccttctatgccctagaaactcttttanggtattttctcctggtatctcttttacncatcgttctatctggaaaaataggtggatgagtgagataataacggtatatactttttaaaggtctaattgacatatataaattgcaagtatttcagatgtcaatttgctaaccttgacacacatagacacacatgaaaacatcaccacattaatacaatgtatgtatccatcattccaaaagcttccctgtgtatctttgtaactctttcttcctccctccactccttgtcctctcgttcccaagaaaacattgatctgcttcctgtgaatataaattaacttacattttttagagctttatataagtatgttctctttactgtttgtcttccttcgctgcacagttattttgagattcttcaagttttttctttatatcgatacttcattcacaagaatatattttaattctagactatgtcacattgactttgtcgtctgctaaatccttagtgctcagatgacttgttcaggactctccttgaacctgtacctctgttanattgaaacttgtctctactgtctttttatttcaaacacagcttattaggtgtctctcaacccatcaaacncacaatctgagtctttaggagattgctttgaatttgtgctattgacttatatntatatnaaatntgtaaatgtttggtaaaaatatcatcatgtacnttttcataattacgctatntncacatgatatatgtcagactctggaaatatgcatgccacagacacgtgtttcttgcctaaaggggctgatggaagacncacatacnaatagacgattgcagtagaatgagagtggtggtctaancagtacatgtcctgatgttgctcggacagttactacnccaagagtaccccctgcattgtcagggttagcatctcctggaagcctcatgtaaatgaagaatttcatgctccatccaggacctaatgaataagaatctgcattttagcaagaccctcatatgattcatatacactttttttttttttttttagatggagtctcactcttgtcgcccaggctggagtgcaatggcatgatcttggctcactgcaacctctgcctcccgggttcaagtgattctcctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccgccttattcgtatacncatttaattctgagaagcactctatagaaaataagaataagaaaatattgggctcacaggtgacattaataagtaactttatcgagtaccccaaattttacctatgtttggaagatggggttaaaaggacacattgaaaacaagaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgcaacagaagttggatatatcattagaaacataaattgtaccatttaacatacatgaagtttatgtttaccttgacgttcttctaaaaagtgtcctacaccggcattgtccttgtaggcatattcacatgatcaaataaaataattagttttcaattaaggagaatatttgaggaaagaccgtacgtgttcatgtggttcctgaaggcagtccagtgagaaagtaatatatgcttcattaaacaatgcggacattttcagggtttccctttttaaccaaaatttggaagcaatgtggaatttactggatgcatccagccctgaaatgaagataggtttattgaatgtgccagcaagtgcaggcccaggtctgagtgttcttcattattatcaggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgtgtgtgtgtgtgtgtgtgtgtgtgtgtgtatgtgtcactttaaaaggactggtcagatggtagggagatgaaaacaggagatgctataagaaaataaacttttggggcgaataccaatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacgaattggagctttattccttaaaatatggcctgggttttctgaaacatttcttccagaaaatagtttctccaagttttattactttggtttacaaatctcacatttaaatcacattttataccataagtagcacacatttcataatattcctctgaatgagggttgggataataggactgatatgttagaaatgccttaaagtgtgtggagcatgagagatggatgtacagaaggcttgtgaggaaaccacccaggtatctggccttgttttctgccccagaactagccgcctattcctgtttctgttttattcctttgtttcttgacttttcctttccaacttgctctaaaacctcagttttctttcctttctgattcatgactaccaaatgttttcacttgcctcacccgtccattacacctttgataagaaccaccagaccttgtgctcatgtacttgcccatgtctgatggaagaaacatactctctccatctgtccactttcctgaggcattcaagtctagccaccttttaaaatcactctcctccaggctgggcacggtgtcacgcctgtaatctcagcactttgtgaggctgaggagggcggatcacttgaagtcaggagttcaaaaccagcctggccaaatggcaaaaccaaatcttcttcaattataaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagctgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatactaaggaataacctcaccaacttgtcattgactgacatgatttcttttggcccacttggccagctagtctggtttggttttctggaaatgaaagaaataatcagagtttaatgacagagagcgtgagacccagaaagacaaaagtagatgaggtaagtctcttgagcgagacttctagggatgggaaatttgtggtgattgatatgaaatgatttttcccttatcaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggttttgttaaggggctactggaaaaatttctattctctccacagcctgctggttttacattagatttattcgcctgataagaatattttgtttctgctgcttctgtccaccttaatatgctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaacttttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgacgtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggatgaggcaggagaatcgcttgaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagtctcattttttggctttgattttggggagacaaagggaaatgcagccatagagggcctgatgacatccaatacatgagttctggtaaagataaaatttgatacacggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagcaaattccacacatgagtattgtgcatgagtaaatgaataaaacatttgcaaagacctttagagaaagagaatgggagcatatgtgcgaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtacgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaagataatggggaattaaggcatcaataaaatgatgccaaagaccaagagcagtttctgaagtcctccttttcatcagctctttatcaaacagaacactctataaacaacccatagccagaaaacaggatgtaggaacaatcaccagcacactctataaacaacccatagccagaaaacagaatgtaaggacaatcaccagccatcttttgtcaataattgatggaatagagttgaaaggaactggagcatgagtcatatttgaccagtcagtcctcactcttatttacttgctatgtaaacttgagaaagcttttttctctttgtgaacctcaggttttacatctgaaaatgagaaatttggaacaaaagattcctaactggtctttctgttcccatattctgtgatttttcaatatttaggatttttggtaatcacaattacttagtttgtggttgagatagcaacacgaatcagaactatttggtggacatattttcaaaggagtagctctccactttgggtaaagaagtgatgcnggtcgtggtggctcacgcctgtaatcccagcactttagggaggccaaggcgggtggatcacgaggtcaggagatcgagaccatcctggctaacacggtgaaaccccgtctctactaaaaaatacaaaaaattagccaggcgtggtggcgggcgcctgtagtcccacgtactcgggaggctgaggcaggagaatggcatgaaccagggaggcggagcttgccgtgagccgagatagcgccactgcagtccctcctgggcaaaagagcaagactgcgtctcaaaaaaaaaaaaaaaaaaaaaaaaagaagtgtgtggagtagcaggacacctgcaacaataatatttttctaaatccctctgaaaaatgctaatcaaagggtttttttcctaaaaattgtcttagaaataaaatttcccctttgggagaccgaggctggcagatcacgaggtcaggagatagagaccacggtgaaaccccgtctctactaaaaatactaaaaattagccggggngtggtggtgggtacacctgtagtcccagctacttggaggctgaggctggagaatcacgtgaac

SEQ ID NO: 2505 - DNA, 21742 bp; single-stranded, linear
aacaagaaaagcgttggtagctctggtgaatcccaaaagaatgtggcagttgctagccatgctcctgaatatgtataaacagtacatcatatgactaagagtttgacttaggggttagattttatgtgtttgaaccccaaattagttatttaatagttggcaccccaaaacaagttacttaacctcactaaggttcagttttcctgtttataaaatgtagatagtgatagtatgtactttataggattattgtgaaaaataaatgaaatatcagatttatttaggataacacctggcatatgtttggtattcagaattagttgctgctgttttattctgctctcccttgcatcccacttttctaagttgtaaactaaatagttgtacacagattgacagattaagaaaggcttgtgattgtgctagacctatgcctatgcctctgtctcaccagattccaggtgtatatgtggaggtgggatagggagtggagtaagtgggtaaatattaaattgcccagttgggcaccatcctgaatattatctctaaagaaagaagcaaaaccaggcacagctgatgggttaaccagatatgatacagaaaacatttccttctgctttttggttttaagcctatatttgaagccttagatctctccagcacagtaagcaccaggagtccatgaagaagatggatcttcatgtggaatgactggtttcattcaatagacttaattcagcagtctgtggggaagagcaaggtatgatagaatggttcctcaagtgcttcagatgtgaagtgggtttaaatatactgtccctgtcttcttcagagttttggtaaagataaaataggacactcatttaaaagcaatctttgcaaatgacaagccactatagacattaatagagttttcatttccagtattatcattaatatcagatcctggaagaaggttgagccttgacctagagcaaaaaaacagaagaattagtaaaggaatcctggagaaagcccctgctgtgtatttaaaggagaaagggagatcatgttgggaaattataatattaaaagtaaacaaaagctaggaagtaaaataaaataaattatatggcctagatccccataagtaatggtttaacttctgccttcctgtgttctgagccagattagggcacagtagagaaagaggagtctctgaaaatgtttccaatttcgctggtcagacagcggatcatcagtgaatcagatgaaaatttgtggatttatgcactaactgatcagcaggaaattaaacaagaaaagcgttggtagctctggtgaatcccaaaagaatttggcagttgctagccatgctcctgaatatgtataaacagtacatcatatgactaagagtttgacttaggggttagattttatgtgtttgaaccccaaattagttatttaatagttggcaccccaaaacaagttacttaacctcactaagattcagttttcctgtttataaaatgtagatagtgatagtatgtactttataggattattgtgaaaaataaatgaaatatcagatttatttaggataacacctggcatatgtttggtattcagtaattagttgctgctgttttattctgctctcccttgcatcccacttttctaagttgtaaactaaatagttgtacacagattgacagattaagaaaggcttgtgattgtgctagacctatgcctctctctcaccagattccaggtgtatatgtggaggtgggatagggagtggagtaagtgggtaaatattaaattgcccagttgggcaccatcctgaatattatctctaaagaaagaagcaaaaccaggcacagctgatgggttaaccagatatgatacagaaaacatttccttctgctttttggttttaagcctatatttgaagccttagatctctccagcacagtaagcaccaggagtccatgaagaagatggctcctgccatggaatcccctactctactgtgtgtagccttactgttcttcggtaagtagagattcaattacccctcccagggaggcccaaatgaatttggggagcagctggggtaggaacctttactgtgggtggtgactttttctaggacatgtgcaaactattgggcatttcccagggactctgtagtggagccaagctagaaagcagaggcaagtgggctgagcaacacctaaggaggaagccagactgaaagcttggttccttgcatttgctctggcatcttccagagtgcaaatttcctaccaaggtaatgagggtagaggagagaaagaagctctttcttcccctgattctcattcctgaaaagacggttggtccttaaaattccatggatgtagatcttatccccacacccagattctagtcctctggagataaagaagactgctggacactaatgtatcctctctggacttttgcagctccagatggcgtgttagcaggtgagtcctctgttcttgttcccttggtgtatcaacatgtctgggcattgctttcctctcactattttcttcgtcccatcacttctgctttctaatgagcatgaatctgttccttggccagactactttccctctccaccttgccttgtctttctttttttccctgattcattgcattctctcaagtcattctctcctctgttttagtcaataaccatgtctgttgcacatatacatgtctcattctctctcctagacactttggcatgatctcgctcaataattacattattattattattgccattttataattgaggatgctgaaactcagtgattttctggtggttacatggctaaggaactggatttcaacgtaagttccttggatctaagtccagttctcttctgactatatcacccttttgttatcaccatgtatctacttctttggtctctgttcaaatttgcactacatccccttgttccaggaagccattcaagactgactttcttagtgcctctcactactttctggaactgacatatgtttttcactctgtatatacttacaattaaatagtcataaatattcagagcttggagaaaccttatatttcatccagtccagtaaatttatccatccataattcactcattcattcacataataaatatttaatgtaacaatggttgaacatggcagacagtgtttctacctcaaaagagattgcagtcctcatttacagatactgaattgaaattaacagaagtagagtgagtcagctcaaatcacatagtgaattggtttctttgtttttaaatctcctgcatatgtgtcctgtctttctccctgtgttgggcgttccctggggcaccaatactaatttctccttcccctagaaatcaaaacagggtcttatcaccaacagaataaggacaggttgaccactgattgtcagaatattgcttcgtttgtacttttaagcctagacagttttcaatgactttttttctctctacatgtcttttcatatttttatcttcttgaagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtggtaagttccagggatatggaaatacagatctctcatgtgagggatggctcatctgaagatgggaaaaaacaggttattccaagggttaggacaccagagtgggattcaaggcctctcatttttaagacccctgcattggctgggcacagtggctcacgcctgtaatcccagcactttgggaggctgaggcaggtggatcacgaggtcaggagatcgagaccatccggctaacatggtgaaaccccatctctgctaaaaaatatatatatataaaattagccgggcgtagtggtgggcacctgtagtcccaggtactcgggaggctgaggcaggagaatggtgtgaacccaggaggtggaggttgcagtgagctgagatcacgccactgccctccagcctgggctacagagcaagactccgtctcaaaaaataaataaataaataaaaaagacccctgcatctcttttcttctacccccttcccttttgattacttgtatgccttctttcaatattctagtcatctctcaatattattcctccaccctattttcctctatcttttctgcctagattcaggtatatattatgtggtcaaacagcatgacatatatgtgaacatttcaaagagctgtgtatctggaataggatcaaaaggtttgacttaaagttttgctctgcataatccatatggcaggacctgaatattaggttgtactcttcgttatgaaacatatctgggtacatttccttatgtcctctgttgttacttaagaacacatatttcatgcttgtttcatttttatcactcctactgccaacaaatagcatagcatgcttaggcacatgtggcttaattagcaaatgttgaataaacaaattaatgattttgaatagtgaccaataggtctcttttatactctatatttttctcttgagtgaaaaaaaatgtttcaacctccatatgtaaattccaaacacaaactaaagcaatgtagaatagcttctttattccctggagtaggttctagagaagtcctaaaggattggtcctaaattaattatgcttattatgctagcgatatttcctttcaaaattctcctttaatgaatgctttttaatttttacaaaagcattaaccatagaatgtgattcttgtctttcactgactcattagtgacaaatatttgttgagtacctaccaactcctaagtattgctaccaactcctaaatactgtgttgggcattcagaatagaatgtagaactagacagggtccctgacttcttggagcacagagcagtatgggaagaggacattaaataaagaattacataagtaattaatttaaattatacatgttttgaagaagtttttttttgacaactataattaacactagaactgggaagtttctataaggtaagagaggacaaaatagacactctcctaagctaaaattcccaagaaagactgtttattttcccctaactaactagaactagcaacagaagatctgaaaggaattctggctttcaagtgttccatgtatggactcatcagggaggtccgagaggctttgtggccccagactgacttttcaggaggggaaaggatttatcaatacacaagacaggctctaagcattattttgtgccctttaaaaatccactttatgagccaaaaagtgagttaatgataattcatagtttctgacacatgctctatgcgtggctctcttttctctattcattctctctctcttcatttattgttaaataaataatgtaatgaatgttcttcagactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaaggtgagttggtaaaggaaaggaaaagcatccatagcaggggaaggaagagagaacttctgagcctgagcagttgcagcttgtagaaggggggcacctgtgatacactggaaagcctaccagacttgcaatgaggagacctgggtgatagtatatatctcaatctctgtttcaaagccttgacttgttaaatggtgatagtaatacctgcttgcactatgaaatttttatgaagattaatgtggtaatatttgtgaaatgactttgtaaactgttaagcactacccaagcataacagattgtgattactattttgatctcaaagtcatctgttgctcctgggggaacacttatatttatcaaattgaaaaaaagtttcaaagttgaatgaagaaaggatataaagagcttgaggagcccattccagcttaggagggctgggaaaggaaaccagcaagtcagtaagctgtgtgcctgtgtattgagggaggagggaatggacttgatatggagagggtagggaggtggactgcctctatggcctgtaagaaaaactgctctctccaaactctttataagagagggagcctgtgaagtattcacttttgaaggagaaagttagacttttccttcacacactttgtacataataatgtttaaaaaagcatgaggtcaaaatacataattaagtcctagcagttctctgttaactaatttgagactgaagtgctatgtacttgtctctaggcttccagtatcttcatctgtaaaacagaatatttggtctagattccattagaatcatttgataacttaaaaaatatattgatgctcatgtctcatttcttgagattctgatttaattggtttggggtgcagcctgggtatacgtatttttcataggtctttcacataatggtaatgggtagccaatattgagaatcacttgtctaggtgatctttaaatgatttctggatgtaatattctgaggctctataatttgagactaatcacaaaaatcggtacagtttataaacagactaacagaaccacaaaataatagaattggaaggcaatttaactagtgcaatttcttcattttgcctaacaggcatgtaagaaatgatgattgattgagtaataggcattgatgacccctgtcctcactttgtcccctttccaccccttaattatatgtgaattctggtcttgtcatttcgaataaggggtttatctttcctattgtcttcccctctgggcacggcacactggctactggagttaagaggaaatgcttaggactccctgtggctccagggagcaccaacagagcaactcaacctagtgttaatctgagtgttttctctgtgcttctggatgccacatcacgctaaaaatgaaggacaaagcttggtctttctcttagggaggatgaaactctgaacctcatttttcagttcccaagatgaattatgtttctcattgcatctgtgttccactacagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtattcaaggcttgctagtttgtttgtttgttttctactaaaggcaaggaccatgaagttctagattggaaatgtcctctcttgactattgcaagtgcgatctaggaatgaaaagacataggaggatgccagtgaggtggatcatttttatgcttcttcttcagcttactaaatatgaactttcagttcttggcagaatcagggacagtctcaagacataggactctcaggatgaagtagagtccaggattcctctgtgattgttttgcccctcccaaatttatatcttgaacttatgtcttgtatctttatacagcacctgaaccaagcattttggagaaattccagctaataataataaccaaaaccttcggctctgaaaacagtccaggactgaataagatcttgggcaaaagaactagacagttttggtttattttccctttcattttatgtcttcatcatagtcattggaggctcattcttcttgtcatggagtaaatgggattaaagttctactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtaaaaaaaaaaaaaaaaaaaaaaaaaaatctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctgggggtaacacaaattctgactgctatgatatgcctttgttttggaacagttgtctgctctgtacttgatatttcacacattgagggagacattttttcatcatttaaagcaggttatccattctggggagccatatttttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttaagcttttcaaaggtgcaattggataacttctgccatgagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttctcaatttttctattcatcacaagtaaaagcctgttgatcttaatcagccaagaaacttatctgtctggcaaatgacttatgtataaagagaatcatcaatgtcatgaggtaacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccaggtaggtacaaggtattatttttttctaccctcagtcacttgtggcaggggaagtcatagtcacggtgcttaggagatgaaactttattgatttaggcatggatccatctagtttaattaatatattgggtatgaggaagctacttgctgtactttccatgtggttctctctccctggagaggaacatttttactcagcttgcaaactggaaatagattttctcacattagaagctcattttctgggtatgagacaggagagttcatactgtgtatgtagatctctggcttctgggtctgacatgtgctgagggacacatatccttcacacatgcttttataaatacttgataaagtaacctgcttcttgattggtctttataatccataagctgtgggatgcttctctgaagatgaaaatagtaatagagtcccatctagctattcaaagccattccttcattgtattctgtgcacatgaagttggggtttgttactgacaaaatatattcagatacatttctatgttaaaaggattgtgagatgcataggtaaatgtgtttattttcagttttacttgtcaacatagatgaatgagaaagaacttgaaagtaacactggattaagaataggaaaatttggcatggattttgctccattttgtcccatctaatcacttggatagtgttcaggtgttcttggtcagttacttggatgctctgagctttagtttcttggtgattacaatgaagatttgaattacaggatggctttgaaaaaataaacaaaactcccctttctgtctgtcgagaatgttgcacagggagttacagaatgttctcatgactgaattgcttttaaatttcacagtgtgcctgcatttgaagtcttggaaatatctccccaggaagtatcttcaggcagactattgaagtcggcctcatccccaccactgcatacatggctgacagttttgaaaaaagagcaggagttcctgggggtgagtgagcctcctccaactttgactagagtaagggttgggtctagaaaagaatattgagttgcatcaactgttttcccacttggattcatgagaggtgttaggtcctttaaaaaacatggtagataaagagttgacactaactgggtccttttgggaagagccagaagcatttcctcataaagactttaaattgctaggacgagaatggccaacaggagtgaaggattcataactttatctttacttagatgtaaagaacaattactgatgttcaacatgactacatacataaaggcgcatggagaaaagtattggccttccatgcattaggtagtgcttgtatcaattcttatagtggctagggtatcctggaaaatcttacgtgtggatcatttctcaggacagtctaggacactaacgcagtttctcatgtttggcttctattattaaaaaatgatacaatctcgggaaaatttttttgattttcatgaaattcatgtgtttttctataggtaacacaaattctgactgctatgatatgcctttgttttggaacagttgtctgctctgtacttgatatttcacacattgagggagacattttttcatcatttaaagcaggttatccattctggggagccatatttgtgagtatatatctataattgtttctgaaataacactgaacataggtttttctctttctcagatctaaccagttgtttattcccagtattaagatgatatttataattcttaattataaatatatgtgagcatatataacatagatatgctcattaacaacaacaaaagattctttttacaattaacggtgggttaaacatttagcccacagttttatcccatgagaaacctgaatctaatacaagttaaatgacttgcctaagggccacttgactaatagtaattgaacctaaactttcagaatccaactccaggaacatacttctagcactattcatcaataaagttatatgataaatacatacaactttatctgtcaactaaaaataacaacagaggctgggcatggtggctcacacccgtaatcccagcactttgggaggctgaggcaggtggatcacctgaggtcaggagtttgagaccagcctgaccaacatggtgaaacctcatctctactaaatataaaaaattagctgagtgtgatagtgcatacctgtaatccagctacttaagaggctgaggcaggaggcttgtttgaacctggaaggcagaggttgcagtgagctgagattgtgccattgcactccagcctgggcaataagtgcgaactctgtctcaaaataataataataataatagaaaataaagttgtcttcatgaaaaatgaggaaagagattgctggggtgagaaacattaagatcaatgggcatatggtgaccttctatgccctagaaactcttttanggtattttctcctggtatctcttttacncatcgttctatctggaaaaataggtggatgagtgagataataacggtatatactttttaaaggtctaattgacatatataaattgcaagtatttcagatgtcaatttgctaaccttgacacacatagacacacatgaaaacatcaccacattaatacaatgtatgtatccatcattccaaaagcttccctgtgtatctttgtaactctttcttcctccctccactccttgtcctctcgttcccaagaaaacattgatctgcttcctgtgaatataaattaacttacattttttagagctttatataagtatgttctctttactgtttgtcttccttcgctgcacagttattttgagattcttcaagttttttctttatatcgatacttcattcacaagaatatattttaattctagactatgtcacattgactttgtcgtctgctaaatccttagtgctcagatgacttgttcaggactctccttgaacctgtacctctgttanattgaaacttgtctctactgtctttttatttcaaacacagcttattaggtgtctctcaacccatcaaacncacaatctgagtctttaggagattgctttgaatttgtgctattgacttatatntatatnaaatntgtaaatgtttggtaaaaatatcatcatgtacnttttcataattacgctatntncacatgatatatgtcagactctggaaatatgcatgccacagacacgtgtttcttgcctaaaggggctgatggaagacncacatacnaatagacgattgcagtagaatgagagtggtggtctaancagtacatgtcctgatgttgctcggacagttactacnccaagagtaccccctgcattgtcagggttagcatctcctggaagcctcatgtaaatgaagaatttcatgctccatccaggacctaatgaataagaatctgcattttagcaagaccctcatatgattcatatacactttttttttttttttttagatggagtctcactcttgtcgcccaggctggagtgcaatggcatgatcttggctcactgcaacctctgcctcccgggttcaagtgattctcctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccgccttattcgtatacncatttaattctgagaagcactctatagaaaataagaataagaaaatattgggctcacaggtgacattaataagtaactttatcgagtaccccaaattttacctatgtttggaagatggggttaaaaggacacattgaaaacaagaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgcaacagaagttggatatatcattagaaacataaattgtaccatttaacatacatgaagtttatgtttaccttgacgttcttctaaaaagtgtcctacaccggcattgtccttgtaggcatattcacatgatcaaataaaataattagttttcaattaaggagaatatttgaggaaagaccgtacgtgttcatgtggttcctgaaggcagtccagtgagaaagtaatatatgcttcattaaacaatgcggacattttcagggtttccctttttaaccaaaatttggaagcaatgtggaatttactggatgcatccagccctgaaatgaagataggtttattgaatgtgccagcaagtgcaggcccaggtctgagtgttcttcattattatcaggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgtgtgtgtgtgtgtgtgtgtgtgtgtgtgtatgtgtcactttaaaaggactggtcagatggtagggagatgaaaacaggagatgctataagaaaataaacttttggggcgaataccaatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacgaattggagctttattccttaaaatatggcctgggttttctgaaacatttcttccagaaaatagtttctccaagttttattactttggtttacaaatctcacatttaaatcacattttataccataagtagcacacatttcataatattcctctgaatgagggttgggataataggactgatatgttagaaatgccttaaagtgtgtggagcatgagagatggatgtacagaaggcttgtgaggaaaccacccaggtatctggccttgttttctgccccagaactagccgcctattcctgtttctgttttattcctttgtttcttgacttttcctttccaacttgctctaaaacctcagttttctttcctttctgattcatgactaccaaatgttttcacttgcctcacccgtccattacacctttgataagaaccaccagaccttgtgctcatgtacttgcccatgtctgatggaagaaacatactctctccatctgtccactttcctgaggcattcaagtctagccaccttttaaaatcactctcctccaggctgggcacggtgtcacgcctgtaatctcagcactttgtgaggctgaggagggcggatcacttgaagtcaggagttcaaaaccagcctggccaaatggcaaaaccaaatcttcttcaattataaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagctgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatactaaggaataacctcaccaacttgtcattgactgacatgatttcttttggcccacttggccagctagtctggtttggttttctggaaatgaaagaaataatcagagtttaatgacagagagcgtgagacccagaaagacaaaagtagatgaggtaagtctcttgagcgagacttctagggatgggaaatttgtggtgattgatatgaaatgatttttcccttatcaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggttttgttaaggggctactggaaaaatttctattctctccacagcctgctggttttacattagatttattcgcctgataagaatattttgtttctgctgcttctgtccaccttaatatgctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaacttttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgacgtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggatgaggcaggagaatcgcttgaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagtctcattttttggctttgattttggggagacaaagggaaatgcagccatagagggcctgatgacatccaatacatgagttctggtaaagataaaatttgatacacggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagcaaattccacacatgagtattgtgcatgagtaaatgaataaaacatttgcaaagacctttagagaaagagaatgggagcatatgtgcgaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtacgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaagataatggggaattaaggcatcaataaaatgatgccaaagaccaagagcagtttctgaagtcctccttttcatcagctctttatcaaacagaacactctataaacaacccatagccagaaaacaggatgtaggaacaatcaccagcacactctataaacaacccatagccagaaaacagaatgtaaggacaatcaccagccatcttttgtcaataattgatggaatagagttgaaaggaactggagcatgagtcatatttgaccagtcagtcctcactcttatttacttgctatgtaaacttgagaaagcttttttctctttgtgaacctcaggttttacatctgaaaatgagaaatttggaacaaaagattcctaactggtctttctgttcccatattctgtgatttttcaatatttaggatttttggtaatcacaattacttagtttgtggttgagatagcaacacgaatcagaactatttggtggacatattttcaaaggagtagctctccactttgggtaaagaagtgatgcnggtcgtggtggctcacgcctgtaatcccagcactttagggaggccaaggcgggtggatcacgaggtcaggagatcgagaccatcctggctaacacggtgaaaccccgtctctactaaaaaatacaaaaaattagccaggcgtggtggcgggcgcctgtagtcccacgtactcgggaggctgaggcaggagaatggcatgaaccagggaggcggagcttgccgtgagccgagatagcgccactgcagtccctcctgggcaaaagagcaagactgcgtctcaaaaaaaaaaaaaaaaaaaaaaaaagaagtgtgtggagtagcaggacacctgcaacaataatatttttctaaatccctctgaaaaatgctaatcaaagggtttttttcctaaaaattgtcttagaaataaaatttcccctttgggagaccgaggctggcagatcacgaggtcaggagatagagaccacggtgaaaccccgtctctactaaaaatactaaaaattagccggggngtggtggtgggtacacctgtagtcccagctacttggaggctgaggctggagaatcacgtgaac

SEQ ID NO: 2506 - DNA, 1291 bp; single-stranded, linear
catatgtatgggaatactgtatttcaggcattataaggaatgaaattataggccgggcattgtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctgtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgcc

SEQ ID NO: 2507 - DNA, 4145 bp; single-stranded, linear
ctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgatccatagttttcagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggacctggatgagagtggcagctactgggtcagtgacaagaggctgcccccctgctcactcagccaggccctcacctactccccggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacaccggagatggccagggtcccctgcaccacggtgtctgcagcacatggctcaacagcctgaagccccaagacccagtgccctgctttgtgcggaatgccagcgccttccacctccccgaggatccctcccatccttgcatcctcatcgggcctggcacaggcatcgtgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatcttcggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcgagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatc

SEQ ID NO: 2508 - DNA, 4077 bp; single-stranded, linear
gaattcccactctgctgcctgctccagcagacggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccataagggactgtgccagatgttaggagaactactaaagtgcctaccccagctc

SEQ ID NO: 2509 - DNA, 9513 bp; single-stranded, linear
catatgtatgggaatactgtatttcaggcattataaggaatgaaattataggccgggcattgtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctgtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgatccatagttttcagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggacctggatgagagtggcagctactgggtcagtgacaagaggctgcccccctgctcactcagccaggccctcacctactccccggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacaccggagatggccagggtcccctgcaccacggtgtctgcagcacatggctcaacagcctgaagccccaagacccagtgccctgctttgtgcggaatgccagcgccttccacctccccgaggatccctcccatccttgcatcctcatcgggcctggcacaggcatcgtgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatcttcggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcgagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcgaattcccactctgctgcctgctccagcagacggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccataagggactgtgccagatgttaggagaactactaaagtgcctaccccagctc

SEQ ID NO: 2510 - DNA, 11970 bp; single-stranded, linear
aagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgttttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacatcattgaaggctcatatgtaaaaatccatgccttcctttctcccaatctccattcccaaacttagccactggttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaaggtattgtcctcacatctctggctattaaagtattttctgttgttgtttttctctttggctgttttctctcacattgccttctctaaagctacagtctctcctttcttttcttgtccctccctggtttggtatgtgacctagaattacagtcagatttcagaaaatgattctctcattttgctgataaggactgattcgttttactgagggacggcagaactagtttcctatgagggcatgggtgaatacaactgaggcttctcatgggagggaatctctactatccaaaattattaggagaaaattgaaaatttccaactctgtctctctcttacctctgtgtaaggcaaataccttattcttgtggtgtttttgtaacctcttcaaactttcattgattgaatgcctgttctggcaatacattaggttgggcacataaggaataccaacataaataaaacattctaaaagaagtttacgatctaataaaggagacaggtacatagcaaactaattcaaaggagctagaagatggagaaaatgctgaatgtggactaagtcattcaacaaagttttcaggaagcacaaagaggaggggctcccctcacagatatctggattagaggctggctgagctgatggtggctggtgttctctgttgcagaagtcaagatggccaaagttccagacatgtttgaagacctgaagaactgttacaggtaaggaataagatttatctcttgtgatttaatgagggtttcaaggctcaccagaatccagctaggcataacagtggccagcatgggggcaggccggcagaggttgtagagatgtgtactagtcctgaagtcagagcaggttcagagaagacccagaaaaactaagcattcagcatgttaaactgagattacattggcagggagaccgccattttagaaaaattatttttgaggtctgctgagccctacatgaatatcagcatcaacttagacacagcctctgttgagatcacatgccctgatataagaatgggttttactggtccattctcaggaaaacttgatctcattcaggaacaggaaatggctccacagcaagctgggcatgtgaactcacatatgcaggcaaatctcactcagatgtagaagaaaggtaaatgaacacaaagataaaattacggaacatattaaactaacatgatgtttccattatctgtagtaaatactaacacaaactaggctgtcaaaattttgcctggatattttactaagtataaattatgaaatctgttttagtgaatacatgaaagtaatgtgtaacatataatctatttggttaaaataaaaaggaagtgcttcaaaacctttcttttctctaaaggagcttaacattcttccctgaacttcaattaaagctcttcaatttgttagccaagtccaatttttacagataaagcacaggtaaagctcaaagcctgtcttgatgactactaattccagattagtaagatatgaattactctacctatgtgtatgtgtagaagtccttaaatttcaaagatgacagtaatggccatgtgtatgtgtgtgacccacaactatcatggtcattaaagtacattggccagagaccacatgaaataacaacaattacattctcatcatcttattttgacagtgaaaatgaagaagacagttcctccattgatcatctgtctctgaatcaggtaagcaaatgactgtaattctcatgggactgctattcttacacagtggtttcttcatccaaagagaacagcaatgacttgaatcttaaatacttttgttttaccctcactagagatccagagacctgtctttcattataagtgagaccagctgcctctctaaactaatagttgatgtgcattggcttctcccagaacagagcagaactatcccaaatccctgagaactggagtctcctggggcaggcttcatcaggatgttagttatgccatcctgagaaagccccgcaggccgcttcaccaggtgtctgtctcctaacgtgatgtgttgtggttgtcttctctgacaccagcatcagaggttagagaaagtctccaaacatgaagctgagagagaggaagcaagccagctgaaagtgagaagtctacagccactcatcaatctgtgttattgtgtttggagaccacaaatagacactataagtactgcctagtatgtcttcagtactggctttaaaagctgtccccaaaggagtatttctaaaatattttgagcattgttaagcagatttttaacctcctgagagggaactaattggaaagctaccactcactacaatcattgttaacctatttagttacaacatctcatttttgagcatgcaaataaatgaaaaagtcttcctaaaaaaatcatctttttatcctggaaggaggaaggaaggtgagacaaaagggagagagggagggaagcctaatgaaacaccagttacctaagaccagaatggagatcctcctcactacctctgttgaatacagcacctactgaaagaactttcattccctgaccatgaacagcctctcagcttctgttttccttcctcacagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaaggtaaggggtcaagcacaataatatctttcttttacagttttaagcaagtagggacagtagaatttaggggaaaattaaacgtggagtcagaataacaagaagacaaccaagcattagtctggtaactatacagaggaaaattaatttttatccttctccaggagggagaaatgagcagtggcctgaatcgagaatacttgctcacagccattatttcttagccatattgtaaaggtcgtgtgacttttagcctttcaggagaaagcagtaataagaccacttacgagctatgttcctctcatactaactatgcctccttggtcatgttacataatcttttcgtgattcagtttcctctactgtaaaatggagataatcagaatcccccactcattggattgttgtaaagattaagagtctcaggctttacagactgagctagctgggccctcctgactgttataaagattaaatgagtcaacatcccctaacttctggactagaataatgtctggtacaaagtaagcacccaataaatgttagctattactatcattattattattattttattttttttttttgagatggagtctggctctgtcacccaggctggagtgcagtggcacaatctcggctcactgcaagctctgcctcctgggttcatgccattctcctgcctcagcctcccgagtaagctgggaatacaggcacccgccactgttcccggctaattttttgtatttttagtagagacggagtttcaccgtggtctccatctcctcgtgatccacccaccttggcctcccaaagtgccgggattacaggcgtgagccaccgcgcccggcctattattattattattactactactactacctatatgaatactaccagcaatactaatttattaatgactggattatgtctaaacctcacaagaatcctaccttctcattttacataaaaggaaactaagctcattgagataggtaaactgcccaatggcatacatctgtaagtgggagagcctcaaatctaattcagttctacctgagtaaaaaaatcatggtttctcctccatccctttactgtacaagcctccacatgaactataaacccaatattcctgtttttaagataatacctaagcaataacgcatgttcacctagaaggttttaaaatgtaacaaaatataagaaaataaaaatcactcatatcgtcagtgagagtttactactgccagcactatggtatgtttccttaaaatctttgctatacacatacctacatgtgaacaaatatgtctaacatcaagaccacactatttacaactttatatccagcttttcttacttagcaatgtattgaggacattttagagtgcccgtttttcaccattataagcaatgcaacaatgaacatctgtataaataaatattcatttctctcaccctttatttccttagaatatattcctagaagtagaatttcccagagccatgaggatttgtgacgctattgatatgtgccactttgcactctctgtgacatatataattatttttaatgcattcatttttttctcagagtgcattcgtttgaaaacatagacgggaaatactggtagtcttccttgtcagttagaaacacccaaacaatgaaaaatgaaaaagttgcacaaatagtctctaaaaacaatgaaactattgcctgaggaattgaagtttaaaaagaagcacataagcaacaacaaggataatcctagaaaaccagttctgctgactgggtgatttcacttctctttgcttcctcatctggattggaatattcctaataccccctccagaactattttccctgtttgtactagactgtgtatatcatctgtgtttgtacatagacattaatctgcacttgtgatcatggttttagaaatcatcaagcctaggtcatcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcaggtacattaaaatggcaccagacatttctgtcatcctcccctcctttcatttacttatttatttatttcaatctttctgcttgcaaaaaacatacctcttcagagttctgggttgcacaattcttccagaatagcttgaagcacagcacccccataaaaatcccaagccagggcagaaggttcaactaaatctggaagttccacaagagagaagtttcctatctttgagagtaaagggttgtgcacaaagctagctgatgtactacctctttggttctttcagacattcttaccctcaattttaaaactgaggaaactgtcagacatattaaatgatttactcagatttacccagaagccaatgaagaacaatcactctcctttaaaaagtctgttgatcaaactcacaagtaacaccaaaccaggaagatctttattatctctgataacatatttgtgaggcaaaacctccaataagctacaaatatggcttaaaggatgaagtttagtgtccaaaaacttttatcacacacatccaattttcatggcggacatgttttagtttcaacagtatacatattttcaaaggtccagagaggcaattttgcaataaacaagcaagactttttctgattggatgcacttcagctaacatgctttcaactctacatttacaaattattttgtgttctatttttctacttaatattatttctgcaattttcccaatattgacatcgtgtatgtatttgccatttttaatatcactagacaattcaatcaggttgctacgttggtcccttgggtttactctaaatagcttgattgcaaatatctttgtatatattattgttttttctcctatcttgtaatttctttgagcacatcccaaagaggaatgcctagatcaatgggcacaaataatttgacagctcttattaaacattattctgtaagtaaaaactgaactacttttcagtatcactagcaacatatgagtgtatcagcttcctaaacccctccatgttaggtcattatgaacttatgatctaacaaattacagggtcttatcccactaatgaaattataagagattcaacacttattcagccccgaaggattcattcaacgtagaaaattctaagaacattaaccaagtatttacctgcctagtgagtgtggaagacattgtgaaggacacaaagatgtatagaattccattcctgacttccaggtatttacaccataggtggggacctaactacacacacacacacacacacacacacacacacacacaccatgcacacacaatctacatcaacacttgattttatacaaatacaatgaatttactttctttttggttcttctcttcaccagtgaaatttgacatgggtgcttataagtcatcaaaggatgatgctaaaattaccgtgattctaagaatctcaaaaactcaattgtatgtgactgcccaagatgaagaccaaccagtgctgctgaaggtcagttgtcctttgtctccaacttaccttcatttacatctcatatgtttgtaaataagcccaataggcagacacctctaacaaggtgacactgtcctctttccttcctaccacagcccccacctacccaccccactcccattgattccagaggcgtgcctaggcaggatctatgagaaaatataacagagagtaagaggaaaattaccttctttctttttcctttccctgcctgaccttattcacctcccatcccagagcatccatttattccattgatctttactgacatctattatctgacctacacaatactagacattaggacaatgtggcctgcctccaagaaactcaaataagccaactgagatcagagaggattaatcacctgccaatgggcacaaagcaacaagctgggagccaagtcccaaaatggggcctgctgcttccagttcccctctctctgcattgatgtcagcattatccttcgtcccagtcctgtctccactaccactttccccctcaaacacacacacacacaacagccttagatgttttctccactgataagtaggtgactcaatttgtaagtatataatccaagaccttctattcccaagtagaatttatgtgcctgcctgtgcttttctacctggatcaagtgatgtctacagagtagggcagtagcttcattcatgaactcattcaacaagcattattcactgagagccttgtatttttcaggcatagtgccaacagcagtgtggacagtggtgcatcaaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggcgggtcatggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggacattcagaggagtctgaatgcacccaggcctacaacttcaagatggtaaaggacagctccaaggatcagaagaagcattcttggaactggggcattttgagaaggaggaaaaatatgcagagactagtgcttgcagagcttgcatttggatttcatttgaggtacaatgaaaacccattaatgggtttcacacagtgcaatggcctgacctcacttatatttcctaaaatagaaaacagatcagaaggaaggcaatagagaagcagaaagtccaatgaggaggtttcacagcagtcatgggggtggggtaaggaaaagaagtggaaagaaacagacagaattgggttatattttggagatagaaccaacagaaggaagaggagaaacaacatttactgagaagggaaaaagtaggagaggaataggtttgggaaataaatcctgctgacattggaaaccccaaggaagcctcaaaagtatatttacttgctttagatttaaaagaataggaaagaagcatctcaacttggaatttgaaatctatttttccataaaagtattgttaaattctactcatactcacaagaaaagtacattctaaagagtatattgaaagagtttactgatatacttaggaattttgtgtgtatgtgtgtgtgtgtatgtgtgtgtgtgtgtttaaccttcaattgttgacttaaatactgagataaatgtcatctaaatgctaaattgatttcccaaaggtatgatttgttcacttggagatcaaaatgtttagggggcttagaatcactgtagtgctcagatttgatgcaaaatgtcttaggcctatgttgaaggcaggacagaaacaatgtttccctcctacctgcctggatacagtaagatactagtgtcactgacaatcttcataactaatttagatctctctccaatcaactaaggaaatcaactcttattaatagactgggccacacatctactaggcatgtaataaatgcttgctgaatgaacaaatgaatgaagagcctatagcatcatgttacagccatagtcctaaagtggtgtttctcatgaaggccaaatgctaagggattgagcttcagtcctttttctaacatcttgttctctaacagaattctcttcttttcttcataggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacacatagttattcattgccttaatcattattttactgcatggtaattagggacaaatggtaaatgtttacataaataattgtatttagtgttactttataaaatcaaaccaagattttatatttttttctcctctttgttagctgccagtatgcataaatggcattaagaatgataatatttccgggttcacttaaagctcatattacacatacacaaaacatgtgttcccatctttatacaaactcacacatacagagctacattaaaaacaactaataggccaggcacggtggctcagacctgtaatcccagcactttgggagg

SEQ ID NO: 2511 - DNA, 1497 bp; single-stranded, linear
accaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaag

SEQ ID NO: 2512 - DNA, 9721 bp; single-stranded, linear
agaaagaaagagagagagaaagaaaagaaagaggaaggaaggaaggaaggaagaaagacaggctctgaggaaggtggcagttcctacaacgggagaaccagtggttaatttgcaaagtggatcctgtggaggcanncagaggagtcccctaggccacccagacagggcttttagctatctgcaggccagacaccaaatttcaggagggctcagtgttaggaatggattatggcttatcaaattcacaggaaactaacatgttgaacagcttttagatttcctgtggaaaatataacttactaaagatggagttcttgtgactgactcctgatatcaagatactgggagccaaattaaaaatcagaaggctgcttggagagcaagtccatgaaatgctctttttcccacagtagaacctatttccctcgtgtctcaaatacttgcacagaggctcactcccttggataatgcagagcgagcacgatacctggcacatactaatttgaataaaatgctgtcaaattcccattcacccattcaagcagcaaactctatctcacctgaatgtacatgccaggcactgtgctagacttggctcaaaaagatttcagtttcctggaggaaccaggagggcaaggtttcaactcagtgctataagaagtgttacaggctggacacggtggctcacgcctgtaatcccaacatttgggaggccgaggcgggcagatcacaaggtcaggagatcgagaccatcctggctaacatggtgaaaccctgtctctactaaaaatacaaaaaattagccgggcgttggcggcaggtgcctgtagtcccagctgctggggaggctgaggcaggagaatggtgtgaacccgggaggcggaacttgcagggggccgagatcgtgccactgcactccagcctgggcgacagagtgagactctgtctcaaaaaaaaaaaaaaagtgttatgatgcagacctgtcaaagaggcaaaggagggtgttcctacactccaggcactgttcataacctggactctcattcattctacaaatggagggctcccctgggcagatccctggagcaggcactttgctggtgtctcggttaaagagaaactgataactcttggtattaccaagagatagagtctcagatggatattcttacagaaacaatattcccacttttcagagttcaccaaaaaatcattttaggcagagctcatctggcattgatctggttcatccatgagattggctagggtaacagcacctggtcttgcagggttgtgtgagcttatctccagggttgccccaactccgtcaggagcctgaaccctgcataccgtatgttctctgccccagccaagaaaggtcaattttctcctcagaggctcctgcaattgacagagagctcccgaggcagagaacagcacccaaggtagagacccacaccctcaatacagacagggagggctattggcccttcattgtacccatttatccatctgtaagtgggaagattcctaaacttaagtacaaagaagtgaatgaagaaaagtatgtgcatgtataaatctgtgtgtcttccactttgtcccacatatactaaatttaaacattcttctaacgtgggaaaatccagtattttaatgtggacatcaactgcacaacgattgtcaggaaaacaatgcatatttgcatggtgatacatttgcaaaatgtgtcatagtttgctactccttgcccttccatgaaccagagaattatctcagtttattagtcccctcccctaagaagcttccaccaatactcttttcccctttcctttaacttgattgtgaaatcaggtattcaacagagaaatttctcagcctcctacttctgcttttgaaagctataaaaacagcgagggagaaactggcagataccaaacctcttcgaggcacaaggcacaacaggctgctctgggattctcttcagccaatcttcattgctcaagtatgactttaatcttccttacaactaggtgctaagggagtctctctgtctctctgcctctttgtgtgtatgcatattctctctctctctctctttctttctctgtctctcctctccttcctctctgcctcctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacaggtcagtggagacgctgagaccagtaacatgagcaggtctcctctttcaagagtagagtgttatctgtgcttggagaccagatttttcccctaaattgcctctttcagtggcaaacagggtgccaagtaaatctgatttaaagactactttcccattacaagtccctccagccttgggacctggaggctatccagatgtgttgttgcaagggcttcctgcagaggcaaatggggagaaaagattccaagcccacaatacaaggaatccctttgcaaagtgtggcttggagggagagggagagctcagattttagctgactctgctgggctagaggttaggcctcaagatccaacagggagcaccagggtgcccacctgccaggcctagaatctgccttctggactgttctgcgcatatcactgtgaaacttgccaggtgtttcaggcagctttgagaggcaggctgtttgcagtttcttatgaacagtcaagtcttgtacacagggaaggaaaaataaacctgtttagaagacataattgagacatgtccctgtttttattacagtggcaatgaggatgacttgttctttgaagctgatggccctaaacagatgaaggtaagactatgggtttaactcccaacccaaggaagggctctaacacagggaaagctcaaagaagggagttctgggccactttgatgccatggtattttgttttagaaagactttaacctcttccagtgagacacaggctgcaccacttgctgacctggccacttggtcatcatatcaccacagtcactcactaacgttggtggtggtggccacacttggtggtgacaggggaggagtagtgataatgttcccatttcatagtaggaagacaaccaagtcttcaacataaatttgattatccttttaagagatggattcagcctatgccaatcacttgagttaaactctgaaaccaagagatgatcttgagaactaacatatgtctaccccttttgagtagaatagttttttgctacctggggtgaagcttataacaacaagacatagatgatataaacaaaaagatgaattgagacttgaaagaaaaccattcacttgctgtttgaccttgacaagtcattttacccgctttggacctcatctgaaaaataaagggctgagctggatgatctctgagattccagcatcctgcaacctccagttctgaaatattttcagttgtagctaagggcatttgggcagcaaatggtcatttttcagactcatccttacaaagagccatgttatattcctgctgtcccttctgttttatatgatgctcagtagccttcctaggtgcccagccatcagcctagctaggtcagttgtgcaggttggaggcagccacttttctctggctttattttattccagtttgtgatagcctcccctagcctcataatccagtcctcaatcttgttaaaaacatatttctttagaagttttaagactggcataacttcttggctgcagctgtgggaggagcccattggcttgtctgcctggcctttgccccccattgcctcttccagcagcttggctctgctccaggcaggaaattctctcctgctcaactttcttttgtgcacttacaggtctctttaactgtctttcaagcctttgaaccattatcagccttaaggcaacctcagtgaagccttaatacggagcttctctgaataagaggaaagtggtaacatttcacaaaaagtactctcacaggatttgcagaatgcctatgagacagtgttatgaaaaaggaaaaaaaagaacagtgtagaaaaattgaatacttgctgagtgagcataggtgaatggaaaatgttatggtcatctgcatgaaaaagcaaatcatagtgtgacagcattagggatacaaaaagatatagagaaggtatacatgtatggtgtaggtggggcatgtacaaaaagatgacaagtagaatcgggatttattctaaagaatagcctgtaaggtgtccagaagccacattctagtcttgagtctgcctctacctgctgtgtgcccttgagtacacccttaacctccttgagcttcagagagggataatctttttattttattttattttattttgttttgttttgttttgttttgttttatgagacagagtctcactctgttgcccaggctggagtgcagtggtacaatcttggcttactgcatcctccacctcctgagttcaagcgattctccttcctcagtctcctgaatagctaggattacaggtgcaccccaccacacccagctaatttttgtatttttagtagagaaggggtttcgccatgttggccaggctggttttgaagtcctgacctaaatgattcatccacctcggcttcccaaagtgctgggattacaggcatgagccaccacgcctggcccagagagggatgatctttagaagctcgggattctttcaagccctttcctcctctctgagctttctactctctgatgtcaaagcatggttcctggcaggaccacctcaccaggctccctccctcgctctctccgcagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccactcccagcttcatccctactggtgttgtcatcagactttgaccgtatatgctcaggtgtcctccaagaaatcaaattttgccacctcgcctcacgaggcctgcccttctgattttatacctaaacaacatgtgctccacatttcagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaaggtaaatggaaacatcctggtttccctgcctggcctcctggcagcttgctaattctccatgttttaaacaaagtagaaagttaatttaaggcaaatgatcaacacaagtgaaaaaaaatattaaaaaggaatatacaaactttggtcctagaaatggcacatttgattgcactggccagtgcatttgttaacaggagtgtgaccctgagaaattagacggctcaagcactcccaggaccatgtccacccaagtctcttgggcatagtgcagtgtcaattcttccacaatatggggtcatttgatggacatggcctaactgcctgtgggttctctcttcctgttgttgaggctgaaacaagagtgctggagcgataatgtgtccatccccctccccagtcttccccccttgccccaacatccgtcccacccaatgccaggtggttccttgtagggaaattttaccgcccagcaggaacttatatctctccgctgtaacgggcaaaagtttcaagtgcggtgaacccatcattagctgtggtgatctgcctggcatcgtgccacagtagccaaagcctctgcacaggagtgtgggcaactaaggctgctgactttgaaggacagcctcactcagggggaagctatttgctctcagccaggccaagaaaatcctgtttctttggaatcgggtagtaagagtgatcccagggcctccaattgacactgctgtgactgaggaagatcaaaatgagtgtctctctttggagccactttcccagctcagcctctcctctcccagtttcttcccatgggctactctctgttcctgaaacagttctggtgcctgatttctggcagaagtacagcttcacctctttcctttccttccacattgatcaagttgttccgctcctgtggatgggcacattgccagccagtgacacaatggcttccttccttccttccttcagcatttaaaatgtagaccctctttcattctccgttcctactgctatgaggctctgagaaaccctcaggcctttgaggggaaaccctaaatcaacaaaatgaccctgctattgtctgtgagaagtcaagttatcctgtgtcttaggccaaggaacctcactgtgggttcccacagaggctaccaattacatgtatcctactctcggggctaggggttggggtgaccctgcatgctgtgtccctaaccacaagacccccttctttcttcagtggtgttctccatgtcctttgtacaaggagaagaaagtaatgacaaaatacctgtggccttgggcctcaaggaaaagaatctgtacctgtcctgcgtgttgaaagatgataagcccactctacagctggaggtaagtgaatgctatggaatgaagcccttctcagcctcctgctaccacttattcccagacaattcaccttctccccgcccccatccctaggaaaagctgggaacaggtctatttgacaagttttgcattaatgtaaataaatttaacataatttttaactgcgtgcaaccttcaatcctgctgcagaaaattaaatcattttgccgatgttattatgtcctaccatagttacaaccccaacagattatatattgttagggctgctctcatttgatagacaccttgggaaatagatgacttaaagggtcccattatcacgtccactccactcccaaaatcaccaccactatcacctccagctttctcagcaaaagcttcatttccaagttgatgtcattctaggaccataaggaaaaatacaataaaaagcccctggaaactaggtacttcaagaagctctagcttaattttcacccccccaaaaaaaaaaaattctcacctacattatgctcctcagcatttggcactaagttttagaaaagaagaagggctcttttaataatcacacagaaagttgggggcccagttacaactcaggagtctggctcctgatcatgtgacctgctcgtcagtttcctttctggccaacccaaagaacatctttcccataggcatctttgtcccttgccccacaaaaattcttctttctctttcgctgcagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaaaagggtctctcctgatcattgactgtctggattgacactgacagtaagcaaacaggctgtgagagttcttgggactaagcccactcctcattgctgagtgctgcaagtacctagaaatatccttggccaccgaagactatcctcctcacccatcccctttatttcgttgttcaacagaaggatattcagtgcacatctggaacaggatcagctgaagcactgcagggagtcaggactggtagtaacagctaccatgatttatctatcaatgcaccaaacatctgttgagcaagcgctatgtactaggagctgggagtacagagatgagaacagtcacaagtccctcctcagataggagaggcagctagttataagcagaacaaggtaacatgacaagtagagtaagatagaagaacgaagaggagtagccaggaaggagggaggagaacgacataagaatcaagcctaaagggataaacagaagatttccacacatgggctgggccaattgggtgtcggttacgcctgtaatcccagcactttgggtggcaggggcagaaagatcgcttgagcccaggagttcaagaccagcctgggcaacatagtgagactcccatctctacaaaaaataaataaataaataaaacaatcagccaggcatgctggcatgcacctgtagtcctagctacttgggaagctgacactggaggattgcttgagcccagaagttcaagactgcagtgagcttatccgttgacctgcaggtcgac

SEQ ID NO: 2513 - DNA, 1496 bp; single-stranded, linear
acaaaccttttcgaggcaaaaggcaaaaaaggctgctctgggattctcttcagccaatcttcaatgctcaagtgtctgaagcagccatggcagaagtacctaagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatcccagcccttttgttgagccaggcctctctcacctctcctactcacttaaagcccgcctgacagaaaccaggccacattttggttctaagaaaccctcctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctcaaataaacttcact

SEQ ID NO: 2514 - DNA, 720 bp; single-stranded, linear
ctggcaggagtagcagctgccccttggcgcgactgctggagccgcgaactagagaaacacagacacgcctcatagagcaacggcgtctctcggagcgtggagcccgccaagctcgagctgagctttcgcttgccgtccaccactgcccacactgtcgtttgctgccatcgcagacctgctgctgacttccatccctctggatccggcaagggcctgcgattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgccatttttaatgtgaacaacagcgacaataaggaccaggaaccagaagaaaaaaagaaaaagaaaaaagaaaagaagagcaagtcagatgataaaaacgaaaataaaaacgacccaaagaagaagatggaaaagcga

SEQ ID NO: 2515 - DNA, 2002 bp; single-stranded, linear
atggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaagtgagggagtcatttcattggcgtttgagtcagcaaagaagtcaag

SEQ ID NO: 2516 - DNA, 2027 bp; single-stranded, linear
agctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcatcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagtcgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctg

SEQ ID NO: 2517 - DNA, 29433 bp; single-stranded, linear
aagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgttttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacatcattgaaggctcatatgtaaaaatccatgccttcctttctcccaatctccattcccaaacttagccactggttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaaggtattgtcctcacatctctggctattaaagtattttctgttgttgtttttctctttggctgttttctctcacattgccttctctaaagctacagtctctcctttcttttcttgtccctccctggtttggtatgtgacctagaattacagtcagatttcagaaaatgattctctcattttgctgataaggactgattcgttttactgagggacggcagaactagtttcctatgagggcatgggtgaatacaactgaggcttctcatgggagggaatctctactatccaaaattattaggagaaaattgaaaatttccaactctgtctctctcttacctctgtgtaaggcaaataccttattcttgtggtgtttttgtaacctcttcaaactttcattgattgaatgcctgttctggcaatacattaggttgggcacataaggaataccaacataaataaaacattctaaaagaagtttacgatctaataaaggagacaggtacatagcaaactaattcaaaggagctagaagatggagaaaatgctgaatgtggactaagtcattcaacaaagttttcaggaagcacaaagaggaggggctcccctcacagatatctggattagaggctggctgagctgatggtggctggtgttctctgttgcagaagtcaagatggccaaagttccagacatgtttgaagacctgaagaactgttacaggtaaggaataagatttatctcttgtgatttaatgagggtttcaaggctcaccagaatccagctaggcataacagtggccagcatgggggcaggccggcagaggttgtagagatgtgtactagtcctgaagtcagagcaggttcagagaagacccagaaaaactaagcattcagcatgttaaactgagattacattggcagggagaccgccattttagaaaaattatttttgaggtctgctgagccctacatgaatatcagcatcaacttagacacagcctctgttgagatcacatgccctgatataagaatgggttttactggtccattctcaggaaaacttgatctcattcaggaacaggaaatggctccacagcaagctgggcatgtgaactcacatatgcaggcaaatctcactcagatgtagaagaaaggtaaatgaacacaaagataaaattacggaacatattaaactaacatgatgtttccattatctgtagtaaatactaacacaaactaggctgtcaaaattttgcctggatattttactaagtataaattatgaaatctgttttagtgaatacatgaaagtaatgtgtaacatataatctatttggttaaaataaaaaggaagtgcttcaaaacctttcttttctctaaaggagcttaacattcttccctgaacttcaattaaagctcttcaatttgttagccaagtccaatttttacagataaagcacaggtaaagctcaaagcctgtcttgatgactactaattccagattagtaagatatgaattactctacctatgtgtatgtgtagaagtccttaaatttcaaagatgacagtaatggccatgtgtatgtgtgtgacccacaactatcatggtcattaaagtacattggccagagaccacatgaaataacaacaattacattctcatcatcttattttgacagtgaaaatgaagaagacagttcctccattgatcatctgtctctgaatcaggtaagcaaatgactgtaattctcatgggactgctattcttacacagtggtttcttcatccaaagagaacagcaatgacttgaatcttaaatacttttgttttaccctcactagagatccagagacctgtctttcattataagtgagaccagctgcctctctaaactaatagttgatgtgcattggcttctcccagaacagagcagaactatcccaaatccctgagaactggagtctcctggggcaggcttcatcaggatgttagttatgccatcctgagaaagccccgcaggccgcttcaccaggtgtctgtctcctaacgtgatgtgttgtggttgtcttctctgacaccagcatcagaggttagagaaagtctccaaacatgaagctgagagagaggaagcaagccagctgaaagtgagaagtctacagccactcatcaatctgtgttattgtgtttggagaccacaaatagacactataagtactgcctagtatgtcttcagtactggctttaaaagctgtccccaaaggagtatttctaaaatattttgagcattgttaagcagatttttaacctcctgagagggaactaattggaaagctaccactcactacaatcattgttaacctatttagttacaacatctcatttttgagcatgcaaataaatgaaaaagtcttcctaaaaaaatcatctttttatcctggaaggaggaaggaaggtgagacaaaagggagagagggagggaagcctaatgaaacaccagttacctaagaccagaatggagatcctcctcactacctctgttgaatacagcacctactgaaagaactttcattccctgaccatgaacagcctctcagcttctgttttccttcctcacagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaaggtaaggggtcaagcacaataatatctttcttttacagttttaagcaagtagggacagtagaatttaggggaaaattaaacgtggagtcagaataacaagaagacaaccaagcattagtctggtaactatacagaggaaaattaatttttatccttctccaggagggagaaatgagcagtggcctgaatcgagaatacttgctcacagccattatttcttagccatattgtaaaggtcgtgtgacttttagcctttcaggagaaagcagtaataagaccacttacgagctatgttcctctcatactaactatgcctccttggtcatgttacataatcttttcgtgattcagtttcctctactgtaaaatggagataatcagaatcccccactcattggattgttgtaaagattaagagtctcaggctttacagactgagctagctgggccctcctgactgttataaagattaaatgagtcaacatcccctaacttctggactagaataatgtctggtacaaagtaagcacccaataaatgttagctattactatcattattattattattttattttttttttttgagatggagtctggctctgtcacccaggctggagtgcagtggcacaatctcggctcactgcaagctctgcctcctgggttcatgccattctcctgcctcagcctcccgagtaagctgggaatacaggcacccgccactgttcccggctaattttttgtatttttagtagagacggagtttcaccgtggtctccatctcctcgtgatccacccaccttggcctcccaaagtgccgggattacaggcgtgagccaccgcgcccggcctattattattattattactactactactacctatatgaatactaccagcaatactaatttattaatgactggattatgtctaaacctcacaagaatcctaccttctcattttacataaaaggaaactaagctcattgagataggtaaactgcccaatggcatacatctgtaagtgggagagcctcaaatctaattcagttctacctgagtaaaaaaatcatggtttctcctccatccctttactgtacaagcctccacatgaactataaacccaatattcctgtttttaagataatacctaagcaataacgcatgttcacctagaaggttttaaaatgtaacaaaatataagaaaataaaaatcactcatatcgtcagtgagagtttactactgccagcactatggtatgtttccttaaaatctttgctatacacatacctacatgtgaacaaatatgtctaacatcaagaccacactatttacaactttatatccagcttttcttacttagcaatgtattgaggacattttagagtgcccgtttttcaccattataagcaatgcaacaatgaacatctgtataaataaatattcatttctctcaccctttatttccttagaatatattcctagaagtagaatttcccagagccatgaggatttgtgacgctattgatatgtgccactttgcactctctgtgacatatataattatttttaatgcattcatttttttctcagagtgcattcgtttgaaaacatagacgggaaatactggtagtcttccttgtcagttagaaacacccaaacaatgaaaaatgaaaaagttgcacaaatagtctctaaaaacaatgaaactattgcctgaggaattgaagtttaaaaagaagcacataagcaacaacaaggataatcctagaaaaccagttctgctgactgggtgatttcacttctctttgcttcctcatctggattggaatattcctaataccccctccagaactattttccctgtttgtactagactgtgtatatcatctgtgtttgtacatagacattaatctgcacttgtgatcatggttttagaaatcatcaagcctaggtcatcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcaggtacattaaaatggcaccagacatttctgtcatcctcccctcctttcatttacttatttatttatttcaatctttctgcttgcaaaaaacatacctcttcagagttctgggttgcacaattcttccagaatagcttgaagcacagcacccccataaaaatcccaagccagggcagaaggttcaactaaatctggaagttccacaagagagaagtttcctatctttgagagtaaagggttgtgcacaaagctagctgatgtactacctctttggttctttcagacattcttaccctcaattttaaaactgaggaaactgtcagacatattaaatgatttactcagatttacccagaagccaatgaagaacaatcactctcctttaaaaagtctgttgatcaaactcacaagtaacaccaaaccaggaagatctttattatctctgataacatatttgtgaggcaaaacctccaataagctacaaatatggcttaaaggatgaagtttagtgtccaaaaacttttatcacacacatccaattttcatggcggacatgttttagtttcaacagtatacatattttcaaaggtccagagaggcaattttgcaataaacaagcaagactttttctgattggatgcacttcagctaacatgctttcaactctacatttacaaattattttgtgttctatttttctacttaatattatttctgcaattttcccaatattgacatcgtgtatgtatttgccatttttaatatcactagacaattcaatcaggttgctacgttggtcccttgggtttactctaaatagcttgattgcaaatatctttgtatatattattgttttttctcctatcttgtaatttctttgagcacatcccaaagaggaatgcctagatcaatgggcacaaataatttgacagctcttattaaacattattctgtaagtaaaaactgaactacttttcagtatcactagcaacatatgagtgtatcagcttcctaaacccctccatgttaggtcattatgaacttatgatctaacaaattacagggtcttatcccactaatgaaattataagagattcaacacttattcagccccgaaggattcattcaacgtagaaaattctaagaacattaaccaagtatttacctgcctagtgagtgtggaagacattgtgaaggacacaaagatgtatagaattccattcctgacttccaggtatttacaccataggtggggacctaactacacacacacacacacacacacacacacacacacacaccatgcacacacaatctacatcaacacttgattttatacaaatacaatgaatttactttctttttggttcttctcttcaccagtgaaatttgacatgggtgcttataagtcatcaaaggatgatgctaaaattaccgtgattctaagaatctcaaaaactcaattgtatgtgactgcccaagatgaagaccaaccagtgctgctgaaggtcagttgtcctttgtctccaacttaccttcatttacatctcatatgtttgtaaataagcccaataggcagacacctctaacaaggtgacactgtcctctttccttcctaccacagcccccacctacccaccccactcccattgattccagaggcgtgcctaggcaggatctatgagaaaatataacagagagtaagaggaaaattaccttctttctttttcctttccctgcctgaccttattcacctcccatcccagagcatccatttattccattgatctttactgacatctattatctgacctacacaatactagacattaggacaatgtggcctgcctccaagaaactcaaataagccaactgagatcagagaggattaatcacctgccaatgggcacaaagcaacaagctgggagccaagtcccaaaatggggcctgctgcttccagttcccctctctctgcattgatgtcagcattatccttcgtcccagtcctgtctccactaccactttccccctcaaacacacacacacacaacagccttagatgttttctccactgataagtaggtgactcaatttgtaagtatataatccaagaccttctattcccaagtagaatttatgtgcctgcctgtgcttttctacctggatcaagtgatgtctacagagtagggcagtagcttcattcatgaactcattcaacaagcattattcactgagagccttgtatttttcaggcatagtgccaacagcagtgtggacagtggtgcatcaaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggcgggtcatggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggacattcagaggagtctgaatgcacccaggcctacaacttcaagatggtaaaggacagctccaaggatcagaagaagcattcttggaactggggcattttgagaaggaggaaaaatatgcagagactagtgcttgcagagcttgcatttggatttcatttgaggtacaatgaaaacccattaatgggtttcacacagtgcaatggcctgacctcacttatatttcctaaaatagaaaacagatcagaaggaaggcaatagagaagcagaaagtccaatgaggaggtttcacagcagtcatgggggtggggtaaggaaaagaagtggaaagaaacagacagaattgggttatattttggagatagaaccaacagaaggaagaggagaaacaacatttactgagaagggaaaaagtaggagaggaataggtttgggaaataaatcctgctgacattggaaaccccaaggaagcctcaaaagtatatttacttgctttagatttaaaagaataggaaagaagcatctcaacttggaatttgaaatctatttttccataaaagtattgttaaattctactcatactcacaagaaaagtacattctaaagagtatattgaaagagtttactgatatacttaggaattttgtgtgtatgtgtgtgtgtgtatgtgtgtgtgtgtgtttaaccttcaattgttgacttaaatactgagataaatgtcatctaaatgctaaattgatttcccaaaggtatgatttgttcacttggagatcaaaatgtttagggggcttagaatcactgtagtgctcagatttgatgcaaaatgtcttaggcctatgttgaaggcaggacagaaacaatgtttccctcctacctgcctggatacagtaagatactagtgtcactgacaatcttcataactaatttagatctctctccaatcaactaaggaaatcaactcttattaatagactgggccacacatctactaggcatgtaataaatgcttgctgaatgaacaaatgaatgaagagcctatagcatcatgttacagccatagtcctaaagtggtgtttctcatgaaggccaaatgctaagggattgagcttcagtcctttttctaacatcttgttctctaacagaattctcttcttttcttcataggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacacatagttattcattgccttaatcattattttactgcatggtaattagggacaaatggtaaatgtttacataaataattgtatttagtgttactttataaaatcaaaccaagattttatatttttttctcctctttgttagctgccagtatgcataaatggcattaagaatgataatatttccgggttcacttaaagctcatattacacatacacaaaacatgtgttcccatctttatacaaactcacacatacagagctacattaaaaacaactaataggccaggcacggtggctcagacctgtaatcccagcactttgggaggaccaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaagagaaagaaagagagagagaaagaaaagaaagaggaaggaaggaaggaaggaagaaagacaggctctgaggaaggtggcagttcctacaacgggagaaccagtggttaatttgcaaagtggatcctgtggaggcanncagaggagtcccctaggccacccagacagggcttttagctatctgcaggccagacaccaaatttcaggagggctcagtgttaggaatggattatggcttatcaaattcacaggaaactaacatgttgaacagcttttagatttcctgtggaaaatataacttactaaagatggagttcttgtgactgactcctgatatcaagatactgggagccaaattaaaaatcagaaggctgcttggagagcaagtccatgaaatgctctttttcccacagtagaacctatttccctcgtgtctcaaatacttgcacagaggctcactcccttggataatgcagagcgagcacgatacctggcacatactaatttgaataaaatgctgtcaaattcccattcacccattcaagcagcaaactctatctcacctgaatgtacatgccaggcactgtgctagacttggctcaaaaagatttcagtttcctggaggaaccaggagggcaaggtttcaactcagtgctataagaagtgttacaggctggacacggtggctcacgcctgtaatcccaacatttgggaggccgaggcgggcagatcacaaggtcaggagatcgagaccatcctggctaacatggtgaaaccctgtctctactaaaaatacaaaaaattagccgggcgttggcggcaggtgcctgtagtcccagctgctggggaggctgaggcaggagaatggtgtgaacccgggaggcggaacttgcagggggccgagatcgtgccactgcactccagcctgggcgacagagtgagactctgtctcaaaaaaaaaaaaaaagtgttatgatgcagacctgtcaaagaggcaaaggagggtgttcctacactccaggcactgttcataacctggactctcattcattctacaaatggagggctcccctgggcagatccctggagcaggcactttgctggtgtctcggttaaagagaaactgataactcttggtattaccaagagatagagtctcagatggatattcttacagaaacaatattcccacttttcagagttcaccaaaaaatcattttaggcagagctcatctggcattgatctggttcatccatgagattggctagggtaacagcacctggtcttgcagggttgtgtgagcttatctccagggttgccccaactccgtcaggagcctgaaccctgcataccgtatgttctctgccccagccaagaaaggtcaattttctcctcagaggctcctgcaattgacagagagctcccgaggcagagaacagcacccaaggtagagacccacaccctcaatacagacagggagggctattggcccttcattgtacccatttatccatctgtaagtgggaagattcctaaacttaagtacaaagaagtgaatgaagaaaagtatgtgcatgtataaatctgtgtgtcttccactttgtcccacatatactaaatttaaacattcttctaacgtgggaaaatccagtattttaatgtggacatcaactgcacaacgattgtcaggaaaacaatgcatatttgcatggtgatacatttgcaaaatgtgtcatagtttgctactccttgcccttccatgaaccagagaattatctcagtttattagtcccctcccctaagaagcttccaccaatactcttttcccctttcctttaacttgattgtgaaatcaggtattcaacagagaaatttctcagcctcctacttctgcttttgaaagctataaaaacagcgagggagaaactggcagataccaaacctcttcgaggcacaaggcacaacaggctgctctgggattctcttcagccaatcttcattgctcaagtatgactttaatcttccttacaactaggtgctaagggagtctctctgtctctctgcctctttgtgtgtatgcatattctctctctctctctctttctttctctgtctctcctctccttcctctctgcctcctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacaggtcagtggagacgctgagaccagtaacatgagcaggtctcctctttcaagagtagagtgttatctgtgcttggagaccagatttttcccctaaattgcctctttcagtggcaaacagggtgccaagtaaatctgatttaaagactactttcccattacaagtccctccagccttgggacctggaggctatccagatgtgttgttgcaagggcttcctgcagaggcaaatggggagaaaagattccaagcccacaatacaaggaatccctttgcaaagtgtggcttggagggagagggagagctcagattttagctgactctgctgggctagaggttaggcctcaagatccaacagggagcaccagggtgcccacctgccaggcctagaatctgccttctggactgttctgcgcatatcactgtgaaacttgccaggtgtttcaggcagctttgagaggcaggctgtttgcagtttcttatgaacagtcaagtcttgtacacagggaaggaaaaataaacctgtttagaagacataattgagacatgtccctgtttttattacagtggcaatgaggatgacttgttctttgaagctgatggccctaaacagatgaaggtaagactatgggtttaactcccaacccaaggaagggctctaacacagggaaagctcaaagaagggagttctgggccactttgatgccatggtattttgttttagaaagactttaacctcttccagtgagacacaggctgcaccacttgctgacctggccacttggtcatcatatcaccacagtcactcactaacgttggtggtggtggccacacttggtggtgacaggggaggagtagtgataatgttcccatttcatagtaggaagacaaccaagtcttcaacataaatttgattatccttttaagagatggattcagcctatgccaatcacttgagttaaactctgaaaccaagagatgatcttgagaactaacatatgtctaccccttttgagtagaatagttttttgctacctggggtgaagcttataacaacaagacatagatgatataaacaaaaagatgaattgagacttgaaagaaaaccattcacttgctgtttgaccttgacaagtcattttacccgctttggacctcatctgaaaaataaagggctgagctggatgatctctgagattccagcatcctgcaacctccagttctgaaatattttcagttgtagctaagggcatttgggcagcaaatggtcatttttcagactcatccttacaaagagccatgttatattcctgctgtcccttctgttttatatgatgctcagtagccttcctaggtgcccagccatcagcctagctaggtcagttgtgcaggttggaggcagccacttttctctggctttattttattccagtttgtgatagcctcccctagcctcataatccagtcctcaatcttgttaaaaacatatttctttagaagttttaagactggcataacttcttggctgcagctgtgggaggagcccattggcttgtctgcctggcctttgccccccattgcctcttccagcagcttggctctgctccaggcaggaaattctctcctgctcaactttcttttgtgcacttacaggtctctttaactgtctttcaagcctttgaaccattatcagccttaaggcaacctcagtgaagccttaatacggagcttctctgaataagaggaaagtggtaacatttcacaaaaagtactctcacaggatttgcagaatgcctatgagacagtgttatgaaaaaggaaaaaaaagaacagtgtagaaaaattgaatacttgctgagtgagcataggtgaatggaaaatgttatggtcatctgcatgaaaaagcaaatcatagtgtgacagcattagggatacaaaaagatatagagaaggtatacatgtatggtgtaggtggggcatgtacaaaaagatgacaagtagaatcgggatttattctaaagaatagcctgtaaggtgtccagaagccacattctagtcttgagtctgcctctacctgctgtgtgcccttgagtacacccttaacctccttgagcttcagagagggataatctttttattttattttattttattttgttttgttttgttttgttttgttttatgagacagagtctcactctgttgcccaggctggagtgcagtggtacaatcttggcttactgcatcctccacctcctgagttcaagcgattctccttcctcagtctcctgaatagctaggattacaggtgcaccccaccacacccagctaatttttgtatttttagtagagaaggggtttcgccatgttggccaggctggttttgaagtcctgacctaaatgattcatccacctcggcttcccaaagtgctgggattacaggcatgagccaccacgcctggcccagagagggatgatctttagaagctcgggattctttcaagccctttcctcctctctgagctttctactctctgatgtcaaagcatggttcctggcaggaccacctcaccaggctccctccctcgctctctccgcagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccactcccagcttcatccctactggtgttgtcatcagactttgaccgtatatgctcaggtgtcctccaagaaatcaaattttgccacctcgcctcacgaggcctgcccttctgattttatacctaaacaacatgtgctccacatttcagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaaggtaaatggaaacatcctggtttccctgcctggcctcctggcagcttgctaattctccatgttttaaacaaagtagaaagttaatttaaggcaaatgatcaacacaagtgaaaaaaaatattaaaaaggaatatacaaactttggtcctagaaatggcacatttgattgcactggccagtgcatttgttaacaggagtgtgaccctgagaaattagacggctcaagcactcccaggaccatgtccacccaagtctcttgggcatagtgcagtgtcaattcttccacaatatggggtcatttgatggacatggcctaactgcctgtgggttctctcttcctgttgttgaggctgaaacaagagtgctggagcgataatgtgtccatccccctccccagtcttccccccttgccccaacatccgtcccacccaatgccaggtggttccttgtagggaaattttaccgcccagcaggaacttatatctctccgctgtaacgggcaaaagtttcaagtgcggtgaacccatcattagctgtggtgatctgcctggcatcgtgccacagtagccaaagcctctgcacaggagtgtgggcaactaaggctgctgactttgaaggacagcctcactcagggggaagctatttgctctcagccaggccaagaaaatcctgtttctttggaatcgggtagtaagagtgatcccagggcctccaattgacactgctgtgactgaggaagatcaaaatgagtgtctctctttggagccactttcccagctcagcctctcctctcccagtttcttcccatgggctactctctgttcctgaaacagttctggtgcctgatttctggcagaagtacagcttcacctctttcctttccttccacattgatcaagttgttccgctcctgtggatgggcacattgccagccagtgacacaatggcttccttccttccttccttcagcatttaaaatgtagaccctctttcattctccgttcctactgctatgaggctctgagaaaccctcaggcctttgaggggaaaccctaaatcaacaaaatgaccctgctattgtctgtgagaagtcaagttatcctgtgtcttaggccaaggaacctcactgtgggttcccacagaggctaccaattacatgtatcctactctcggggctaggggttggggtgaccctgcatgctgtgtccctaaccacaagacccccttctttcttcagtggtgttctccatgtcctttgtacaaggagaagaaagtaatgacaaaatacctgtggccttgggcctcaaggaaaagaatctgtacctgtcctgcgtgttgaaagatgataagcccactctacagctggaggtaagtgaatgctatggaatgaagcccttctcagcctcctgctaccacttattcccagacaattcaccttctccccgcccccatccctaggaaaagctgggaacaggtctatttgacaagttttgcattaatgtaaataaatttaacataatttttaactgcgtgcaaccttcaatcctgctgcagaaaattaaatcattttgccgatgttattatgtcctaccatagttacaaccccaacagattatatattgttagggctgctctcatttgatagacaccttgggaaatagatgacttaaagggtcccattatcacgtccactccactcccaaaatcaccaccactatcacctccagctttctcagcaaaagcttcatttccaagttgatgtcattctaggaccataaggaaaaatacaataaaaagcccctggaaactaggtacttcaagaagctctagcttaattttcacccccccaaaaaaaaaaaattctcacctacattatgctcctcagcatttggcactaagttttagaaaagaagaagggctcttttaataatcacacagaaagttgggggcccagttacaactcaggagtctggctcctgatcatgtgacctgctcgtcagtttcctttctggccaacccaaagaacatctttcccataggcatctttgtcccttgccccacaaaaattcttctttctctttcgctgcagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaaaagggtctctcctgatcattgactgtctggattgacactgacagtaagcaaacaggctgtgagagttcttgggactaagcccactcctcattgctgagtgctgcaagtacctagaaatatccttggccaccgaagactatcctcctcacccatcccctttatttcgttgttcaacagaaggatattcagtgcacatctggaacaggatcagctgaagcactgcagggagtcaggactggtagtaacagctaccatgatttatctatcaatgcaccaaacatctgttgagcaagcgctatgtactaggagctgggagtacagagatgagaacagtcacaagtccctcctcagataggagaggcagctagttataagcagaacaaggtaacatgacaagtagagtaagatagaagaacgaagaggagtagccaggaaggagggaggagaacgacataagaatcaagcctaaagggataaacagaagatttccacacatgggctgggccaattgggtgtcggttacgcctgtaatcccagcactttgggtggcaggggcagaaagatcgcttgagcccaggagttcaagaccagcctgggcaacatagtgagactcccatctctacaaaaaataaataaataaataaaacaatcagccaggcatgctggcatgcacctgtagtcctagctacttgggaagctgacactggaggattgcttgagcccagaagttcaagactgcagtgagcttatccgttgacctgcaggtcgacacaaaccttttcgaggcaaaaggcaaaaaaggctgctctgggattctcttcagccaatcttcaatgctcaagtgtctgaagcagccatggcagaagtacctaagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatcccagcccttttgttgagccaggcctctctcacctctcctactcacttaaagcccgcctgacagaaaccaggccacattttggttctaagaaaccctcctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctcaaataaacttcactctggcaggagtagcagctgccccttggcgcgactgctggagccgcgaactagagaaacacagacacgcctcatagagcaacggcgtctctcggagcgtggagcccgccaagctcgagctgagctttcgcttgccgtccaccactgcccacactgtcgtttgctgccatcgcagacctgctgctgacttccatccctctggatccggcaagggcctgcgattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgccatttttaatgtgaacaacagcgacaataaggaccaggaaccagaagaaaaaaagaaaaagaaaaaagaaaagaagagcaagtcagatgataaaaacgaaaataaaaacgacccaaagaagaagatggaaaagcgaatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaagtgagggagtcatttcattggcgtttgagtcagcaaagaagtcaagagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcatcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagtcgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctg

SEQ ID NO: 2518 - DNA, 1308 bp; single-stranded, linear
gccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaa

SEQ ID NO: 2519 - DNA, 2156 bp; single-stranded, linear
gccggagccgactcggagcgcgcggcgcggccgggaggagccgagcgcgccgggcgcggcgtgggggcgccggctgccccgcgcgcccagggagcggcaggaatgtgacaatcgcgcgcccgcaccgtagcactcctcgctcggctcctagggctctcgccctctgagctgagccgggttccgcccgggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcaccaggaatcagg

SEQ ID NO: 2520 - DNA, 3464 bp; single-stranded, linear
gccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaagccggagccgactcggagcgcgcggcgcggccgggaggagccgagcgcgccgggcgcggcgtgggggcgccggctgccccgcgcgcccagggagcggcaggaatgtgacaatcgcgcgcccgcaccgtagcactcctcgctcggctcctagggctctcgccctctgagctgagccgggttccgcccgggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcaccaggaatcagg

SEQ ID NO: 2521 - DNA, 1185 bp; single-stranded, linear
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctgggggacatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatcc

SEQ ID NO: 2522 - DNA, 6870 bp; single-stranded, linear
cagctgcggcatcctctgtctcagagtcttggtgtctctgttcctttcccctcggggtctccctgggtctccccaagtccctcctgctgtcttcctcccgctctctgatctctgactcccagaacctctccctctgtctccagggctgcccctctgatcctctttgcttctctggtgtgtctctctggctgcctccatctctgtggatctccgtctccctgtctctgtctcagtctgtccttcactctgtgtgtgtgtgtgtctctctctctctctctccttcccttccactccctcttcctcctgcctccacctctccaggcccctgtcttgtccctccgtccggcctttctctgcctttccgtcctcctgcctccccatctctctctgctagtcctgtccagccggacccccacccacagtcgggccccagcgcttgagcctgagtgtctgctccggcccgtggaggtggagggaggggacgccaatgacctcaccagcccctctccgaccacccccccctttcccttttcaacttttccaacttttccttccgtgccctcctccgagcgcggcggcgtgagccctgcaaggcagccgctccgtctgaatggaaaaggcaggcagggagggtgagtcaggatgtgtcaggccggccctcccctgccgcctgccccccgcccgcccgccccaggccccctatataaccccccaggcgtccacactccctcactgccgcgggccctgctgctcagggcacatgcctcccctccccagccgcgggcccagctgaccctcggggctcccccggcagcggacagggaagggttaaaggcccccggctccctgccccctgccctggggaacccctggccctgtggggacatgaactgtaagttggttcatggggagggtggaggggacagggaggcagggaggagagggacccacggcgggggtgggagcagaccccgctgagtcgcacagagagggacccggagacaggcagccggggaggagagcagcttcggagacaggaggcggcggaggagatgggcagagagagacacagacaggagcggatggaggcagccaatcagaggcgccgcaggagggacgggccagacagggcccgagaggagcgagacgcgagaccgagcaggggcagggacgcagggactggtgccgggagggaggtgacccccatcgacccaggccccagggagcccgcggggaccgggagactccctgggattccggcagagaggctccggagggaaactgaggcagggtccgcggagagcggagcaagccagggagtagcgaccccagccggggggaggagagagactgggcgccgggggaaagcggggagagccgggcagatgcggccgacggaggcgcggacagaccgacggctggcgggcccggggggcgggctgggggtgtgcgaggcgcgggcggccggggagcgctgattggctggcgggtggccgggtgggcggggcggccggggtgggctgcggggagcgagctccggacccccgcgcccccggcgccccccgcgccccccgccgccagctctcccgctcccggcgcccggccgggccatggctctgcccctctccgcccaggtgcgctgcggcccgggcttctgccgcccacccggcgggctcctgggagggcgtctaaggggtctcccgtgggagaggtccgtgtctcccggactccgtcctgggcttttggctccttcccctgctcccagccagctcgggctcccgcggcccggggagggggcaggttctggcctgtgcctcccccaccatccgcgccccggggcccagattccggcgtccgggggcggacgggagacgcccgggccgcgtctgctccgacgggcggggcagccagagccagggagggagagggaagcccgcctggccctgcgacctgcccgcgggcgttccaccctgggacttaagacctccagctccatcctccctaaggccgggagtccaggccccagaccctcctccccgagacccaggagtccagaccccaggccttcctccctcagacctaggagtccaggcccccagcctctcctccctcagacccaggaggagtccagaccccagttcctcctccctcagacccgggagtccagcccaggccctcctctctcagacccggagtccagcctgagctctctgccttatcctgcccccaggtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctggtaggagagactgggctggggccagcacaggagtgagaggcagagaggaacggagaggagtctgcgggcagccacttggaggggttctgggctctcaggtggcagagtgagggaggggaagagttgggggcctggcgtgggggatggagggagccccgaggctgggcaggggccacctcacagcttttttccctgccagagggacaaattcccagctgacggggaccacaacctggattccctgcccaccctggccatgagtgcaggggcactgggagctctacaggtaagggcaagggagtgggctggggacaaggtgggaggcaggcagtgaagggggcggggaggatgaggggcactggtcgggtgttctctgatgtcccggctctatccccagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctggtatgtcctggccccaagacctgacaccccagacccccacccctggccccaaaatcctgtggcctgagtccttgaagcctgagaccccagacccgagtgcaacagccccgctctgagaccctgacaccctaacagcccgctctgagaccctgacaccgtaacagccccgctctgagaccctgaccctaacagtcctgctctgagaccctgaccctgcagtcccaagatcctgtggccctgagaccctgaggccctagacccccaaatcctgcccagaaacttcaaattctcacccaagaccctgagactccatcatccatgacctcaaagtccccagatcccagcccctaagacccaagaccccatcctgaagcccaaagccttgagaattcaaatcctcacctcaagacttggagaccctggccccatgacattgaaaaccatggacctggccaggcgtggtggctcacgcctgtaatcccagcactttgggaggccgaggcaagtggatcacctgaggtcgggagttcaagaccagccagaccaacatggtgaaaccctgtctctactaaaaatacaaaattagccaggcgtggtggtgcatgcctgtaatcccagctacttgggaggctgaggcaggagaatcgcttgaacctgggaggcggaggttgcagtgagccgagatcgcaccattacactccagcctgggcaacaagagcaaaactccctctctctcaaaaaaaaaaaaaaaaaaaaaaaagaaggaaaagaaaaccatggacctccagaccctgagaccccaggccccagccctgagatcctgacatcttaaagatcccaggccctaagatacaagaccttgacccaaagccagccttgggaccctggctgtacaaacccaagacctccaggacctagaccccgagccctgaggccctatgtctcactcccaacatcgaaaaccctgacacctcagatcctgagcctgcgcctgtacgactccaagaccctcacttccaaagccaggcccaaagccctgagaccagaagacttcaaaccctggttcttgggcctaactccaaagaccctggatctcaaattccaacttctagctctgagactccagccctcacccatgagttcctgaacttgaacccagagaccccatctctaagacttcagccttgagatccagggcctgaccctagactcgagcccacagacctcagatactgtctgtaaaaccccagctctggtggggagcagtggctcactcctgtaatcccaaggcaggggaggccaaggcagaaggacctcttgaggccatgagtttgagacagcctgggcagcatagcaagactctgtttcttaattattattattattattattttttggagacagagtctcgcgctctgttgcccaggctagagtgcaatggtgccatttcggcttgctggaacctccgcctcctgggctcaagcgattctcctgcctcagcctcctgagtagctgggacttcaggtgcacactgccacacccggataatttttttgtattttagtagacacagggtttcaccgtgttgcccaggctggtcacaaactcctgagctcaggccatccgcccgcctcggcctcccaaagcgctgggataacaggcgtgacgccgcgcctggcttcttaattgttctaacagcagcgacaacaacaaaaacccagctctgagattccagccccggcgactctaacagtcccaggcccgatccctcacctagaaccgagatgccagccctgactccacagacttcacccccaacccccacactcagctctggaagcccgtcctgactccagcctccattttcggaaccccacagcctgaagagctcccggcctaaacacttcaccccacgcgccacagtccccctgtgaatatgcagccccgattcagctgcagctccacagcacccctgccctgcacccccgctgcaccccctacctgtgactcacctctctcctctccccacagatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccgtttgtttgttttttgagatggagtctcgctctgttgcctaggctggagtgcagtgaggcaatctaaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagtttgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaatatcagcctcctcctctccaaaaataagccctcaggaggggacaaagttgaccgctgattgagcctgtcagggctgtgcac

SEQ ID NO: 2523 - DNA, 8055 bp; single-stranded, linear
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctgggggacatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatcccagctgcggcatcctctgtctcagagtcttggtgtctctgttcctttcccctcggggtctccctgggtctccccaagtccctcctgctgtcttcctcccgctctctgatctctgactcccagaacctctccctctgtctccagggctgcccctctgatcctctttgcttctctggtgtgtctctctggctgcctccatctctgtggatctccgtctccctgtctctgtctcagtctgtccttcactctgtgtgtgtgtgtgtctctctctctctctctccttcccttccactccctcttcctcctgcctccacctctccaggcccctgtcttgtccctccgtccggcctttctctgcctttccgtcctcctgcctccccatctctctctgctagtcctgtccagccggacccccacccacagtcgggccccagcgcttgagcctgagtgtctgctccggcccgtggaggtggagggaggggacgccaatgacctcaccagcccctctccgaccacccccccctttcccttttcaacttttccaacttttccttccgtgccctcctccgagcgcggcggcgtgagccctgcaaggcagccgctccgtctgaatggaaaaggcaggcagggagggtgagtcaggatgtgtcaggccggccctcccctgccgcctgccccccgcccgcccgccccaggccccctatataaccccccaggcgtccacactccctcactgccgcgggccctgctgctcagggcacatgcctcccctccccagccgcgggcccagctgaccctcggggctcccccggcagcggacagggaagggttaaaggcccccggctccctgccccctgccctggggaacccctggccctgtggggacatgaactgtaagttggttcatggggagggtggaggggacagggaggcagggaggagagggacccacggcgggggtgggagcagaccccgctgagtcgcacagagagggacccggagacaggcagccggggaggagagcagcttcggagacaggaggcggcggaggagatgggcagagagagacacagacaggagcggatggaggcagccaatcagaggcgccgcaggagggacgggccagacagggcccgagaggagcgagacgcgagaccgagcaggggcagggacgcagggactggtgccgggagggaggtgacccccatcgacccaggccccagggagcccgcggggaccgggagactccctgggattccggcagagaggctccggagggaaactgaggcagggtccgcggagagcggagcaagccagggagtagcgaccccagccggggggaggagagagactgggcgccgggggaaagcggggagagccgggcagatgcggccgacggaggcgcggacagaccgacggctggcgggcccggggggcgggctgggggtgtgcgaggcgcgggcggccggggagcgctgattggctggcgggtggccgggtgggcggggcggccggggtgggctgcggggagcgagctccggacccccgcgcccccggcgccccccgcgccccccgccgccagctctcccgctcccggcgcccggccgggccatggctctgcccctctccgcccaggtgcgctgcggcccgggcttctgccgcccacccggcgggctcctgggagggcgtctaaggggtctcccgtgggagaggtccgtgtctcccggactccgtcctgggcttttggctccttcccctgctcccagccagctcgggctcccgcggcccggggagggggcaggttctggcctgtgcctcccccaccatccgcgccccggggcccagattccggcgtccgggggcggacgggagacgcccgggccgcgtctgctccgacgggcggggcagccagagccagggagggagagggaagcccgcctggccctgcgacctgcccgcgggcgttccaccctgggacttaagacctccagctccatcctccctaaggccgggagtccaggccccagaccctcctccccgagacccaggagtccagaccccaggccttcctccctcagacctaggagtccaggcccccagcctctcctccctcagacccaggaggagtccagaccccagttcctcctccctcagacccgggagtccagcccaggccctcctctctcagacccggagtccagcctgagctctctgccttatcctgcccccaggtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctggtaggagagactgggctggggccagcacaggagtgagaggcagagaggaacggagaggagtctgcgggcagccacttggaggggttctgggctctcaggtggcagagtgagggaggggaagagttgggggcctggcgtgggggatggagggagccccgaggctgggcaggggccacctcacagcttttttccctgccagagggacaaattcccagctgacggggaccacaacctggattccctgcccaccctggccatgagtgcaggggcactgggagctctacaggtaagggcaagggagtgggctggggacaaggtgggaggcaggcagtgaagggggcggggaggatgaggggcactggtcgggtgttctctgatgtcccggctctatccccagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctggtatgtcctggccccaagacctgacaccccagacccccacccctggccccaaaatcctgtggcctgagtccttgaagcctgagaccccagacccgagtgcaacagccccgctctgagaccctgacaccctaacagcccgctctgagaccctgacaccgtaacagccccgctctgagaccctgaccctaacagtcctgctctgagaccctgaccctgcagtcccaagatcctgtggccctgagaccctgaggccctagacccccaaatcctgcccagaaacttcaaattctcacccaagaccctgagactccatcatccatgacctcaaagtccccagatcccagcccctaagacccaagaccccatcctgaagcccaaagccttgagaattcaaatcctcacctcaagacttggagaccctggccccatgacattgaaaaccatggacctggccaggcgtggtggctcacgcctgtaatcccagcactttgggaggccgaggcaagtggatcacctgaggtcgggagttcaagaccagccagaccaacatggtgaaaccctgtctctactaaaaatacaaaattagccaggcgtggtggtgcatgcctgtaatcccagctacttgggaggctgaggcaggagaatcgcttgaacctgggaggcggaggttgcagtgagccgagatcgcaccattacactccagcctgggcaacaagagcaaaactccctctctctcaaaaaaaaaaaaaaaaaaaaaaaagaaggaaaagaaaaccatggacctccagaccctgagaccccaggccccagccctgagatcctgacatcttaaagatcccaggccctaagatacaagaccttgacccaaagccagccttgggaccctggctgtacaaacccaagacctccaggacctagaccccgagccctgaggccctatgtctcactcccaacatcgaaaaccctgacacctcagatcctgagcctgcgcctgtacgactccaagaccctcacttccaaagccaggcccaaagccctgagaccagaagacttcaaaccctggttcttgggcctaactccaaagaccctggatctcaaattccaacttctagctctgagactccagccctcacccatgagttcctgaacttgaacccagagaccccatctctaagacttcagccttgagatccagggcctgaccctagactcgagcccacagacctcagatactgtctgtaaaaccccagctctggtggggagcagtggctcactcctgtaatcccaaggcaggggaggccaaggcagaaggacctcttgaggccatgagtttgagacagcctgggcagcatagcaagactctgtttcttaattattattattattattattttttggagacagagtctcgcgctctgttgcccaggctagagtgcaatggtgccatttcggcttgctggaacctccgcctcctgggctcaagcgattctcctgcctcagcctcctgagtagctgggacttcaggtgcacactgccacacccggataatttttttgtattttagtagacacagggtttcaccgtgttgcccaggctggtcacaaactcctgagctcaggccatccgcccgcctcggcctcccaaagcgctgggataacaggcgtgacgccgcgcctggcttcttaattgttctaacagcagcgacaacaacaaaaacccagctctgagattccagccccggcgactctaacagtcccaggcccgatccctcacctagaaccgagatgccagccctgactccacagacttcacccccaacccccacactcagctctggaagcccgtcctgactccagcctccattttcggaaccccacagcctgaagagctcccggcctaaacacttcaccccacgcgccacagtccccctgtgaatatgcagccccgattcagctgcagctccacagcacccctgccctgcacccccgctgcaccccctacctgtgactcacctctctcctctccccacagatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccgtttgtttgttttttgagatggagtctcgctctgttgcctaggctggagtgcagtgaggcaatctaaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagtttgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaatatcagcctcctcctctccaaaaataagccctcaggaggggacaaagttgaccgctgattgagcctgtcagggctgtgcac

SEQ ID NO: 2524 - DNA, 1696 bp; single-stranded, linear
gctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccagggaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaaggccagggaacatgtattcctctgcatgcatgtatgtaggtgcctgggagtgtgtgtggtccttgctctggccctttcccttgcagggttgtgcaggtgtgaataaa

SEQ ID NO: 2525 - DNA, 1682 bp; single-stranded, linear
ggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttctacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccttgcaggggttgtgcaggtgtgaataaagagaataaggaagttcttggagattatactcagaaaaaaaaa

SEQ ID NO: 2526 - DNA, 413 bp; single-stranded, linear
tctgtggagcaggtagctgtgctggcgtctttgggaatcctttctttcctgggactggtggctggggccctggcactggggctctggtaagtgactgccattggtccctcagcctctgatcctcacacatgctctgatgcccatagaccacattcatctccacccttcatgactgcctgctgaacctgtctgattctggaactacctccccatacctccatcccctatgccccacttgattttaactgattcctctcctgaccctttactaataaaccctttggcggagactgagataacccacattgttggagagacagctgcctttctatgccccaggctgaggctgagacggggtgggaaggatggatccccaaagcctgggttcttggcctcagtgattccagtggaca

SEQ ID NO: 2527 - DNA, 3791 bp; single-stranded, linear
gctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccagggaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaaggccagggaacatgtattcctctgcatgcatgtatgtaggtgcctgggagtgtgtgtggtccttgctctggccctttcccttgcagggttgtgcaggtgtgaataaaggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttctacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccttgcaggggttgtgcaggtgtgaataaagagaataaggaagttcttggagattatactcagaaaaaaaaatctgtggagcaggtagctgtgctggcgtctttgggaatcctttctttcctgggactggtggctggggccctggcactggggctctggtaagtgactgccattggtccctcagcctctgatcctcacacatgctctgatgcccatagaccacattcatctccacccttcatgactgcctgctgaacctgtctgattctggaactacctccccatacctccatcccctatgccccacttgattttaactgattcctctcctgaccctttactaataaaccctttggcggagactgagataacccacattgttggagagacagctgcctttctatgccccaggctgaggctgagacggggtgggaaggatggatccccaaagcctgggttcttggcctcagtgattccagtggaca

SEQ ID NO: 2528 - DNA, 940 bp; single-stranded, linear
cttcaactcaataagcattttaagtattctaatcttagtatttctctagctgacatgtaagaagcaatctatcttattgtatgcaattagctcattgtgtggataaaaaggtaaaaccattctgaaacaggaaaccaatacacttcctgtttaatcaacaaatctaaacatttattcttttcatctgtttactcttgctcttgtccaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttacttctggatttacagatgattttgaatggaattaatgtaagtatatttcctttcttactaaaattattacatttagtaatctagctggagatcatttcttataacaatgcattatactttcttagaattacaagaatcccaaactcaccaggatgctcacatttaagttttacatgcccaagaaggtaagtacaatatttt

SEQ ID NO: 2529 - DNA, 9339 bp; single-stranded, linear
gaattcccttttcctagtcaaagaaaggggtgacagacagcacctggaaaatcgtgtcactcccaccctaatactgcgcttttccaatggtcttagcaaacagcacaccaagagattatatccagcacctggctcagagggtcctatgcccacggagcctcactcactgctagcacagcagtctgagatcaaactgcaaggtggcagtgaggctgggagaggggtgtgcaccattgccgaggcttgagtaggtaaacaaagcagctgggaagctcgaactgggtggagcccactgcagctcaaggaggcctgcctgcctctgtagactccacctccgggggcagggcatagccaaacaaaaggcagcagaaacctctgcagacttaaatgtccctgtctgacagcttggaagagagtagtggttctcccagcatgcagcttgagatctgagaatggacagactgcctcctcaagtgggtccctgacccccgagtaacctaactgggaggcaccccaagtaggggcagactgacacctcacatggctgggtactcctctgagaaaaaacttccagaggaacgatcaggcagcaacatttgctgttcaccaatatccactgttctgcagcctcctgtgctaatacccaggcaaatgggtctggagaggacctccagcaagctccaacagacctacagctgagggtcctgactgttagaaggaaaactaacaaacagaaaggacatccacaccaaaaccctatctgtacggcaccatcatcaaagaccaaaggtagataaaaccacaaagatggggaaaaaaacacagcagaaaaactggtaactctaaaaattagagcgcttctcctcctccaaaggaacgcagctcctcaccagcaatggaaccaagctggacagagaatgactttgacgagttgagagaagaaggcttcagatgatcaaactactctgagctaaaggaggaagttcgaacccacggcaaagaagttaaaaaccttgaaaaaaattagatgaatggctaactagaataaccaatgcagagaagtccttaaaggacctgatggagctgaaaaccatggcacaagaactacatgacaaatgcacaagcctcagtagctgattcgatcaactggaagaaagggtatcagtgatggaagatcaaatgaatgaaatgaagcaagaagagaagtttagagaaaaaagaaaaaaaagaaatgaacaaagcctccaagaaatatgggactatgtgaaaagaccaaatctacgtctgattggtgtacctgaaagtgatggggagaatggaaccaagctggaaaacactctgcaggatattatccaagagaacttccccaatctagcaaggcaggctgacattcaaattcaggaaatacagagaacgccacaaatataatcctcgagaagagcaactccaagacacataattgttagattcactaaagttgaaatgaaggaaaaaatgttaagggcagccagagagaaaggtcagcttacccacaaaggaaagcccatcagattaacagctgatctctcggcagaaactctacaagccagaagagagtgggggccaatattcaacattcttaaagaaaagaattttcaacccagaatttcatatccagccaaactatgcttcataagtgaaggagaaataaaatatagacaagtgaacgatgaaagattttgtcaccaccaggcctgccctacaagagctcctgaaggaagcactaaacatggaaaggaacaaccggtaccagccactgcaaaaacatgccaaattgtaaacaccattgaggccaggaagaaactgcatcaactaacgagcaaaataaccagctaacatcatcatgacaggatcaaattcacacataacaatattaaccttaaatgtaaataggctaaatgctccaattaaaagacacagactggcaaactggataaagagtcaagacccatcagtgtgctgtattcaggaaacccatctcacgtgcagagacacacataggctcaaaataaagggatggaggaagatctaccaaacaaacggaaaacaaaaaaaggcaggggttgcaatcctagtctctgataaaacagactttaaaccaacaaagatcaaaagagacacagaaggccattacataatggtaaagggatcaattcaacaagaagagttaactatcctaaatatatatgcacccaatacaggagcacctagattcataaagcaagtccttagagacctacaaagagacttagactcccacacaataataatgggagactttaacaccccactgtcaacattagacagatcaatgagacagaaaattaacaaggatatccaggaattgaactcaactctgcaccaagcggacctaatagacatctacagaactctccaccccaaatcaacagaatatacattcttttcggcaccacaccacaccgattccaaaattgaacacatagttggaagtaaagcactcctcagcaaatgtaaaagaacagaaagtacaacaaactgtctctcagaccacagtgcaatcaaactaaaactcaggattaagaaactcactcaaaaccgctcaactacatggaaactgaacaacctgctcctgaatgactactgggtacataacgaaatgaaggcagaagtaaagatgttctttgaaaccaacgagaacaaagacacaacataccagaatctctgggacacattcaaagcagtgtgtagaggaaaatttatagcactaaatgcccacaagagaaagcaggaaagatctaaaattgacagcctaacatcacaattaaaagaactagagaaacaagagcaaacacattcaaaagctagcagaaggcaagaaataactacaatcagagcagaactgaaggagatagagacatacaaaaaacccttcaaaaaatcaatgaatccaggagctggttttttgaaaagatcaacaaaattgatagaccactagcaaaactaatacagaagagagaagaatcaaatagacacaataaaaaatgataaacgggatatcaccactgatcccacagaaatacaaactaccatcaaagaatactataaacacctctatgcaaataaactagaaaatctagaagaaatggataaattcctcgacacatacaccctcccaagactaaaccaggaagaagctgaatctctgaatagaccaataacaggctctgaaattgaggcaacaattaacaccttaccaaccaataaaagtccaggaccagatggattcacagccaaattctaccagaggtacaaggaggagctggtacgattccttctgaaactattccaatcaatagaaaaagagggaatcctccctaactcattttatgaggccagcatcatcctgataccaaagcctggcagagacacaacaaaaaaagagaatttcagaccaatatccctgatgaacatcgatgcaaaaatttttaataaaatactggcaaactgaatccagcagcacatcacaaagcttatccaccatgatcaagctggcttcattcctgggatgcaaggctggttcaacatacggaaaatcaataaatgtaatccagcatataaacagaaccaacaacacacaacacatgattatctcaacagatgcagaaaaggcctttgacaaaattcaacagcccttcatgctaaaaactctcaataaattaggtactgatgggacgtatctcaaaataataagcgctatctatgaccaacccacagccaatatcatactggatgggcaaaaactggaagcattccctttgaaaactggcacaagacagggatgccctctctcaccactcctattcaacacagtgttcgaagttctggcagggcaatcaggcaggagaaagaaataaagggtattcaattaggaaaagaggaggtcaaattgtccctgtttgcagatgacatgattgtatatatagaaaaccccattgtctcagcccaaaatctccttaagctgataagcaacttcagcaaagtctcaggatcaaaatcaatgtgcaaaaatcacaagcattcttatacaccaataacagacaaacagagagccaaatcatgagtgaactcccattcacaattgcttcaaagagaataaaatacctaggaatccaactcacaagggatgtgagagacctcttcaaggagaactataaaccactgctcaatgaaatgagaggatacagataaatggaagaacattccatgctcatgggtaggaagaatcaatatcgtgaaaatggccatactgcccaaggtaattttatagattcaatgccatccccatcaagctaccaatgactttcttcacagaattggaaaaaactactttaaagttcatatggaaccaaaaaagagcccgcattgccaagtcaatcctaagccaaaagaacaaagctagaggcatcacactacctgacttcaaactatactacaaggctacagtaaccaaaacagcatggtactggtaccaaagcagagatatagaccaatggaacaaaacagtgccctcagaaataatactgcatatctacaaccatctgatctttgacaaacctgacaaaaacaagcaatggggaaaggattccctatttaataaatggtgctgggaaaactggctagccatatgtagaaagctgaaattggatcccttccttacaccttgtacaaaaattaattcaagatggattacagacttaaatgttagacctaaaaccataaaaaccctagaagaaaacctaggcaataccattcaggacataggcatgggcaagaacttcatgtctagaacaccaaaagtaatggcaacaaaagccaaaattgacaaatgggtctaattaaactaaagagcttctgcacagcaaaagaaactaccatcagagtgaagaggcaacctacagaatgggagaaaatttttgcaatctgacaaaagggctaatttttgcatctgacaaagggctaatatccagaatctacaatgaactcaaacaaatttacaagaaaaaaacaaatttacaagaaaaaaacaaaatttacaagaaaaaaacaaatttacaagaaaaaaacaaacaaccccatcaaaaagtgggcaaaggataagaacagtcacttctcaaaagaagacatttatgcagccaaaagacacatgaaaaaattctcatcatcactggccatcagagaaatgcaaatcaaaaccacaatgagataccatctcacaccagttagaatggcgatcattaaaaagtcaagaaacaacaggtgctggagaggatgtggagaaataggaacacttttacactgttagtgggactgtaaactagttcaacattgtggaaatcagtatggcgattcctcagggatctagaactagaaataccatttgacccagccatcccattactgggtatatacccaaaggattataaatcatgctgctataaagacacttgcacacatatgtttattgtggtactattcacaatagcaaagacttggaattaacccaaatgtccaacaatgatagactagattaagaaaatgtggcacatatacactatggaatactttgcagccataaaaaaggatgagttcatgtcctttgtagggacatggatgaagctggaaaccatcattctcggcaaactatcgcaaggtcaaaaaaccaaacaccgcatgttctcactcataggtggtaactgaacaatgagaacacatggtcacaggaaggggaacatcacgcactggggcctgttgtggggtggggggagtgggcagggatagcattaggagacatacctaatgttaaatgacgatttaatgggtgcagcacaccaacatggcacatgtatacatatgtaacaaacccacacgttgtgcacatgtactctaaaacttaaagtataattaaaataaataaataaagtaaaaaagaaatcctaaggatactcaaattgttgtttaggtgaagatggatgatgccttccttgaatcatcagctaccaccgacagagtgaagtgagatggaatagtgggcacaatctcattcatcctactctatgtagcctaatgggtccagaatttatcatcactattttacactggaaaaaagatgagattatgaggggtcagggaggctttgagtttttgctctaacttcaccactaattaagaatgtgatcttgggtaagccactttaacctctgtaaatgtcaaatttcttatcagtaaaatgtgactatacaagacaataaatttgaaaatactttgcaaaattgaaagtaccatggaaataattcttcaatcccaaaaggttatgaacattattaaaatttgccacatggaagagcacacaccacagagacataactgtgatcataaacagatttacaaaagtggtgtttcattatggagggccatagggctgataaagacaaatgcatcaccaagctatgtccgagctcattcagatttttacaggaaacacagagcttctagctgaattatctctggatggtgtggaaattgtccaacacgttcctaatttcaaagaaacagaactgaatcttgaaaacccaagaggcctttacagaaactgacaagagatgaattaatataggtatcaagctacagaccaaattaaagttttacaaaactttgaaagagggtcagaaagaagaaacttatgggaagcagagtcctggaaagtcagctttgatggagtgacaatatgtgcaacacagtgagcaatctcttaggtaggcagcttcagggatgggggttgccctttgaaaggacttgggccactcttgagtctaagaggctaagtcacaaacaatgctaagcaactaaaaatagcttcttgtttaatagtaaaattctgcatagtaaaaggagaagcagggggtatgacacacgtggtagttagcagtctactagtgactttactgccacaaccagaaaagccagctgatgtgtcagacgtgagaaagcgaaagtatgtcacagcgaatgtagcttttccacacgtatttcaagaaagaaatgaaaaaggccaacttctataatggtgcctactgtgcattaacagagataaactaggggtctaagaactcagttttctacagggtcccagaagtatagccatatattgccccattctctaatggaaatagccagagaaatagaaatatcaagactggagaacatcaaatacctcattggaaaagcccccacataggaaaatgtgtgggcttgaattcttccattctggaagggtaaaggcctgagtgatgatgctgggattagacactgaaactctttagagaagcaaaacaagtataataaagctgtactttattatattaaataaataacacacagactaccaaatagcctgccccttataacagcgttaatgtgattttgatctgaaatgtatagagacattttgcattttttcggtataaaaagttcatgagatttggccctaatctggaccttttcttcatttttttttctacttgagggactataatctttatttttaaatttgttttatattctccgaacattacctaacgcatagaaaactcttcttgaaccatttttctctgttctttgtaaaatattacatttgactgttccttagactgctttaatcattcctgcctatgcaccctcctcaaaatccagtttaaattaattgttccttattcaagattccttatatccacctcccttggggcagcaatcacctatcacccaggactacacttgtgtatgtacatatcttccctattacaaatcaggttctttgaaaaaatacaaatggtaagagagtggatttttggagtcagtacattctcttttcaaatccttcttctgccccttactggcaataagggctgagtgacctagagcaaattacttaacttctctgagcctcagttttctaatctgcaaaataggagccatcacttcacaagtctgtaagacttatattagactaagtgcctgcctgtacactgttctcttttctctctttctatatacctgaaggcattataggtgctagatgtctgtttaaagaccagacaatattgtcttaaaaaaacaaacaaaaacacagacaataccatctttaaaaaaaaaaaaaagtccaggtaagaaataaataaggccatagaatggaagctttacaaggactctctgtgagacaggatctcctcaagtgtccccaggttaaattagaagtatatatccgtacaattgttcagccagtttgtgcactgtactgaggatgaatgaacacctatcctaaatatcctagtcttctgactaaaaacaagatcatatttcataacgattattgttacattcatagtgtcccaggtgatttagaggataaataaaaatccattaaagaggtaaagacataaaaacgagaaacatggactggtttacacataacacatacaaagtctattataaaactagcatcagtatccttgaatgcaaacctttttctgagtatttaacaatcgcaccctttaaaaaatgtacaatagacattaagagacttaaacagatatataatcattttaaattaaaatagcgttaaacagtacctcaagctcaataagcattttaagtattctaatcttagtatttctctagctgacatgtaagaagcaatctatcttattgtatgcaattagctcattgtgtggataaaaaggtaaaaccattctgaaacaggaaaccaatacacttcctgtttaatcaacaaatctaaacatttattcttttcatctgtttactcttgctgttgtccaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtac

SEQ ID NO: 2530 - DNA, 5737 bp; single-stranded, linear
ttaatcaacaaatctaaacatttattcttttcatctgtttactcttgctcttgttcaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaatgtaagtatatttcctttcttactaaaattattacatttagtaatctagctggagatcatttcttaataacaatgcattatactttcttagaattacaagaatcccaaactcaccaggatgctcacatttaagttttacatgcccaagaaggtaagtacaatattttatgttcaatttctgttttaataaaattcaaagtaatatgaaaatttgcacagatgggactaatagcagctcatctgaggtaaagagtaactttaatttgtttttttgaaaacccaagtttgataatgaagcctctattaaaacagttttacctatatttttaatatatatttgtgtgttggtgggggtgggaagaaaacataaaaataatattctcacctttatcgataagacaattctaaacaaaaatgttcatttatggtttcatttaaaaatgtaaaactctaaaatatttgattatgtcattttagtatgtaaaataccaaaatctatttccaaggagcccacttttaaaaatcttttcttgttttaggaaaggtttctaagtgagaggcagcataacactaatagcacagagtctggggccagatatctgaagtgaaatctcagctctgccatgtcctagctttcatgatctttggcaaattacctactctgtttgtgattcagtttcatgtctacttaaatgaataactgtatatacttaatatggctttgtgagaattagtaagttaaatgtaaagcactcagaaccgtgtctggcataaggtaaataccatacaagcattagctattattagtagtattaaagataaaattttcactgagaaatacaaagtaaaattttggactttatctttttaccaatagaacttgagatttataatgctatatgacttattttccaagattaaaagcttcattaggttgtttttggattcagatagagcataagcataatcatccaagctcctaggctacattaggtgtgtaaagctacctagtagttgtgccagttaagagagaatgaacaaaatctggtgccagaaagagcttgtgccagggtgaatccaagcccagaaaataataggatttaaggggacacagatgcaatcccattgactcaaattctattaattcaagagaaatctgcttctaactacccttctgaaagatgtaaaggagacagcttacagatgttactctagtttaatcagagccacataatgcaactccagcaacataaagatactagatgctgttttctgaagaaaatttctccacattgttcatgccaaaaacttaaacccgaatttgtagaatttgtagtggtgaattgaaagcgcaatagatggacatatcaggggattggtattgtcttgacctacctttcccactaaagagtgttagaaagatgagattatgtgcataatttagggggtggtagaattcatggaaatctaagtttgaaaccaaaagtaatgataaactctattcatttgttcatttaaccctcattgcacatttacaaaagattttagaaactaataaaaatatttgattccaaggatgctatgttaatgctataatgagaaagaaatgaaatctaattctggctctacctacttatgtggtcaaattctgagatttagtgtgcttatttataaagtggagatgatacttcactgcctacttcaaaagatgactgtgagaagtaaatgggcctattttggagaaaattcttttaaattgtaatataccatagaaatatgaaatattatatataatatagaatcaagaggcctgtccaaaagtcctcccaaagtattataatcttttatttcactgggacaaacatttttaaaatgcatcttaatgtagtgattgtagaaaagtaaaatttaagacatatttaaaaatgtgtcttgctcaaggctatattgagagccactactacatgattattgttacctagtgtaaaatgttgggattgtgatagatggcattcaagagttccttctctctcaacattctgtgattcttaactcttagactatcaaatattataatcatagaatgtgatttttatgcttccacattctaactcatctggttctaatgattttctatgcagattggaaaagtaatcagcctgcatctgtgataggcacttacgatgcagaaagtctaacattttgcaaagccaaattaagctaaaaccagtgagtcaactatcacttaacgctagtcataggtacttgagccctagtttttccagttttataatgtaaactctactggtccattctttacagtgacattgagaacagagagaatggtaaaaactacatactgctactccaaataaaataaattggaaattaatttctgattctgacctctatgtaaactgagctgatgataattattattctaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaaggtaaggcattactttatttgctctcctggaaataaaaaaaaaaaagtcagggggaaaagtaccacattttaaagtgacataacatttttggtatttgtaaagtacccatgcatgtaattagcctacattttaagtacactgtgaacatgaatcatttctaatgttaaatgattaactggggagtataagctactgagtttgcacctaccatctactaatggacaagcctcatcccaaactccatcacctttcatattaacacaaaactgggagtgagagaaggtactgagttgagtttcacagaaagcaggcagattttattatatatttttcgattcttcagatcatttactgaaatagccaatactgattacctgaaaggcttttcaaatggtgtttccttatcatttgatggaaggactacccataagagatttgtcttaaaaaaaaaaactggagccattaaaatggccagtggactaaacaaacaacaatctttttagaggcaatccccactttcagaatcttaagtatttttaaatgcacaggaagcataaaatatgcaagggactcaggtgatgtaaaagagattcacttttgtctttttatatcccgtctcctaaggtataaaattcatgagttaataggtatcctaaataagcagcataagtatagtagtaaaagacattcctaaaagtaactccagttgtgtccaaatgaatcacttattagtggactgtttcagttgaattaaaaaaatacattgagatcaatgtcatctagacattgacagattcagttccttatctatggcaagagttttactctaaaataattaacatcagaaaactcattcttaactcttgatacaaatttaagacaaaaccatgcaaaaatctgaaaactgtgtttcaaaagccaaacactttttaaaataaaaaatcccaagatatgacaatatttaaacaattatgcttaagaggatacagaacactgcaacagttttttaaaagagaatacttatttaaagggaacactctatctcacctgcttttgttcccagggtaggaatcacttcaaatttgaaaagctctcttttaaatctcactatatatcaaaatatttcctccttagcttatcaactagaggaagcgtttaaatagctcctttcagcagagaagcctaatttctaaaaagccagtccacagaacaaaatttctaatgtttaaacttttaaaagttggcaaattcacctgcattgatactatgatggggtagggataggtgtaagtatttagaagatgttcttcacacaaatttatcccaaacggaagcatgtcctagcttactctagtgtagttctgttctgctttggggaaaatataaggagattcacttaagtagaaaaataggagactctaatcaagatttagaaaagaagaaagtataatgtgcatatcaattcatacatttaacttacacaaatataggtgtacattcagaggaaaagcgatcaagtttatttcacatccagcatttaatatttgtctagatctatttttatttaaatctttatttgcacccaatttagggaaaaaatttttgtgttcattgactgaattaacaaatgaggaaaatctcagcttctgtgttactatcatttggtatcataacaaaatatgtaattttggcattcattttgatcatttcaagaaaatgcgaataattaatatgtttggtaagcttgaaaataaaggcaacaggcctataagacttcaattgggaataactgtatataaggtaaactactctgtactttaaaaaattaacatttttcttttatagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtgccctaggggctctaaaatggtttcacttatttatcccaaaatatttattattatgttgaatgttaaatatagtgctatgtagattggttagtaaaactatttaataaatttgataaatataaacaagcctggatatttgttattttggaaacagcacagagtaagcatttaaatatttcttagttacttgtgtgaactgtaggatggttaaaatgcttacaaaagtcactctttctctgaagaaatatgtagaacagagatgtagacttctcaaaagcccttgctttgtcctttcaagggctgatcagacccttagttctggcatctcttagcagattatattttccttcttcttaaaatgccaaacacaaacactcttgaaactcttcatagatttggtgtggctatgaattc

SEQ ID NO: 2531 - DNA, 5561 bp; single-stranded, linear
cgaattcccctatcacctaagtgtgggctaatgtaacaaagagggatttcacctacatccattcagtcagtctttgggggtttaaagaaattccaaagagtcatcagaagaggaaaaatgaaggtaatgttttttcagactggtaaagtctttgaaaatatgtgtaatatgtaaaacattttgacacccccataatatttttccagaattaacagtataaattgcatctcttgttcaagagttccctatcactctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaatgtaagtatatttcctttcttactaaaattattacatttagtaatctagctggagatcatttcttaataacaatgcattatactttcttagaattacaagaatcccaaactcaccaggatgctcacatttaagttttacatgcccaagaaggtaagtacaatattttatgttcaatttctgttttaataaaattcaaagtaatatgaaaatttgcacagatgggactaatagcagctcatctgaggtaaagagtaactttaatttgtttttttgaaaacccaagtttgataatgaagcctctattaaaacagttttacctatatttttaatatatatttgtgtgttggtgggggtgggagaaaacataaaaataatattctctcactttatcgataagacaattctaaacaaaaatgttcatttatggtttcatttaaaaatgtaaaactctaaaatatttgattatgtcattttagtatgtaaaataccaaaatctatttccaaggagcccacttttaaaaatcttttcttgttttaggaaaggtttctaagtgagaggcagcataacactaatagcacagagtctggggccagatatctgaagtgaaatctcagctctgccatgtcctagctttcatgatctttggcaaattacctactctgtttgtgattcagtttcatgtctacttaaatgaataactgtatatacttaatatggctttgtgagaattagtaagtaaatgtaaagcactcagaaccgtgtctggcataaggtaaataccatacaagcattagctattattagtagtattaaagataaaattttcactgagaaatacaaagtaaaattttggactttatctttttaccaatagaacttgagatttataatgctatatgacttattttccaagattaaaagcttcattaggttgtttttggattcagatagagcataagcataatcatccaagctcctaggctacattaggtgtgtaaagctacctagtagctgtgccagttaagagagaatgaacaaaatctggtgccagaaagagcttgtgccagggtgaatccaagcccagaaaataataggatttaaggggacacagatgcaatcccattgactcaaattctattaattcaagagaaatctgcttctaactacccttctgaaagatgtaaaggagacagcttacagatgttactctagtttaatcagagccacataatgcaactccagcaacataaagatactagatgctgttttctgaagaaaatttctccacattgttcatgccaaaaacttaaacccgaatttgtagaatttgtagtggtgaattgaaagcgcaatagatggacatatcaggggattggtattgtcttgacctacctttcccactaaagagtgttagaaagatgagattatgtgcataatttaggggtggtagaattcatggaaatctaagtttgaaaccaaaagtaatgataaactctattcatttgttcatttaaccctcattgcacatttacaaaagattttagaaactaataaaaatatttgattccaaggatgctatgttaatgctataatgagaaagaaatgaaatctaattctggctctacctacttatgtggtcaaattctgagatttagtgtgcttatttataaagtggagatgatacttcactgcctacttcaaaagatgactgtgagaagtaaatgggcctattttggagaaaattcttttaaattgtaatataccatagaaatatgaaatattatatataatatagaatcaagaggcctgtccaaaagtcctcccaaagtattataatcttttatttcactgggacaaacatttttaaaatgcatcttaatgtagtgattgtagaaaagtaaaaatttaagacatatttaaaaatgtgtcttgctcaaggctatattgagagccactactacatgattattgttacctagtgtaaaatgttgggattgtgatagatggcatccaagagttccttctctctcaacattctgtgattcttaactcttagactatcaaatattataatcatagaatgtgatttttatgccttccacattctaatctcatctggttctaatgattttctatgcagattggaaaagtaatcagcctacatctgtaataggcatttagatgcagaaagtctaacattttgcaaagccaaattaagctaaaaccagtgagtcaactatcacttaacgctagtcataggtacttgagccctagtttttccagttttataatgtaaactctactggtccatctttacagtgacattgagaacagagagaatggtaaaaactacatactgctactccaaataaaataaattggaaattaatttctgattctgacctctatgtaaactgagctgatgataattattattctaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaaggtaaggcattactttatttgctctcctggaaataaaaaaaaaaaagtagggggaaaagtaccacattttaaagtgacataacatttttggtatttgtaaagtacccatgcatgtaattagcctacattttaagtacactgtgaacatgaatcatttctaatgttaaatgattaactggggagtataagctactgagtttgcacctaccatctactaatggacaagcctcatcccaaactccatcacctttcatattaacacaaaactgggagtgagagagaagtgactgagttgagtttcacagaaacgcaggcaagattttattatatatttttcaagttccttcacagatcatttactggaatagccaatactgagttacctgaaaggcttttcaaatggtgtttccttatcatttgatggaaggactacccataagagatttgtcttaaaaaaaaaaactggagccattaaaatggccagtggactaaacaaacaacaatctttttagaggcaatcccactttcagaatcttaagtatttttaaatgcacaggaagcataaaatatgcaagggactcaggtgatgtaaaagagattcacttttgtctttttatatcccgtctcctaaggtataaaattcatgagttaataggtatcctaaataagcagcataagtatagtagtaaaagacattcctaaaagtaactccagttgtgtccaaatgaatcacttattagtggactgtttcagttgaattaaaaaaatacattgagatcaatgtcatctagacattgacagattcagttccttatctatggcaagagttttactctaaaataattaacatcagaaaactcattcttaactcttgatacaaatttaagacaaaaccatgcaaaaatctgaaaactgtgtttcaaaagccaaacactttttaaaataaaaaaatcccaagatatgacaatatttaaacaattatgcttaagaggatacagaacactgcaacagttttttaaaagagaatacttatttaaagggaacactctatctcacctgcttttgttcccagggtaggaatcacttcaaatttgaaaagctctcttttaaatctcactatatatcaaaatagttgcctccttagcttatcaactagaggaagcgtttaaatagctcctttcagcagagaagcctaatttctaaaaagccagtccacagaacaaaatttctaatgtttaaagcttttaaaagttggcaaattcacctgcattgatactatgatggggtagggataggtgtaagtatttatgaagatgttcattcacacaaatttacccaaacaggaagcatgtcctacctagcttactctagtgtagctcgtttcgtctttggggaaaatataaggagattcacttaagtagaaaaataggagactctaatcaagatttagaaaagaagaaagtataatgtgcatatcaattcatacatttaacttacacaaatataggtgtacattcagaggaaaagcgatcaagtttatttcacatccagcatttaatatttgtctagatctatttttatttaaatctttatttgcacccaatttagggaaaaaatttttgtgttcattgactgaattaacaaatgaggaaaatctcagcttctgtgttactatcatttggtatcataacaaaatacgcaattttggcattcattttgatcatttcaagaaaatgtgaataattaatatgtttggtaagcttgaaaataaaggcaacaggcctataagacttcaattgggaataactgtatataaggtaaactactctgtactttaaaaaattaacatttttcttttatagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaacaagcctggatatttgttattttggaaacagcacagagtaagcatttaaatatttcttagttacttgtgtgaactgtaggatggttaaaatgcttacaaaagtcactctttctctgaagaaatatgtagaacagagatgtagacttctcaaaagcccttgctttgtcctttcaagggctgatcagacccttagttctggcatctcttagcagattatattttccttcttcttaaaatgccaaacacaaacactcttgaaactcttcatagatttggtgtggc

SEQ ID NO: 2532 - DNA, 844 bp; single-stranded, linear
ccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataa

SEQ ID NO: 2533 - DNA, 22421 bp; single-stranded, linear
cttcaactcaataagcattttaagtattctaatcttagtatttctctagctgacatgtaagaagcaatctatcttattgtatgcaattagctcattgtgtggataaaaaggtaaaaccattctgaaacaggaaaccaatacacttcctgtttaatcaacaaatctaaacatttattcttttcatctgtttactcttgctcttgtccaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttacttctggatttacagatgattttgaatggaattaatgtaagtatatttcctttcttactaaaattattacatttagtaatctagctggagatcatttcttataacaatgcattatactttcttagaattacaagaatcccaaactcaccaggatgctcacatttaagttttacatgcccaagaaggtaagtacaatattttgaattcccttttcctagtcaaagaaaggggtgacagacagcacctggaaaatcgtgtcactcccaccctaatactgcgcttttccaatggtcttagcaaacagcacaccaagagattatatccagcacctggctcagagggtcctatgcccacggagcctcactcactgctagcacagcagtctgagatcaaactgcaaggtggcagtgaggctgggagaggggtgtgcaccattgccgaggcttgagtaggtaaacaaagcagctgggaagctcgaactgggtggagcccactgcagctcaaggaggcctgcctgcctctgtagactccacctccgggggcagggcatagccaaacaaaaggcagcagaaacctctgcagacttaaatgtccctgtctgacagcttggaagagagtagtggttctcccagcatgcagcttgagatctgagaatggacagactgcctcctcaagtgggtccctgacccccgagtaacctaactgggaggcaccccaagtaggggcagactgacacctcacatggctgggtactcctctgagaaaaaacttccagaggaacgatcaggcagcaacatttgctgttcaccaatatccactgttctgcagcctcctgtgctaatacccaggcaaatgggtctggagaggacctccagcaagctccaacagacctacagctgagggtcctgactgttagaaggaaaactaacaaacagaaaggacatccacaccaaaaccctatctgtacggcaccatcatcaaagaccaaaggtagataaaaccacaaagatggggaaaaaaacacagcagaaaaactggtaactctaaaaattagagcgcttctcctcctccaaaggaacgcagctcctcaccagcaatggaaccaagctggacagagaatgactttgacgagttgagagaagaaggcttcagatgatcaaactactctgagctaaaggaggaagttcgaacccacggcaaagaagttaaaaaccttgaaaaaaattagatgaatggctaactagaataaccaatgcagagaagtccttaaaggacctgatggagctgaaaaccatggcacaagaactacatgacaaatgcacaagcctcagtagctgattcgatcaactggaagaaagggtatcagtgatggaagatcaaatgaatgaaatgaagcaagaagagaagtttagagaaaaaagaaaaaaaagaaatgaacaaagcctccaagaaatatgggactatgtgaaaagaccaaatctacgtctgattggtgtacctgaaagtgatggggagaatggaaccaagctggaaaacactctgcaggatattatccaagagaacttccccaatctagcaaggcaggctgacattcaaattcaggaaatacagagaacgccacaaatataatcctcgagaagagcaactccaagacacataattgttagattcactaaagttgaaatgaaggaaaaaatgttaagggcagccagagagaaaggtcagcttacccacaaaggaaagcccatcagattaacagctgatctctcggcagaaactctacaagccagaagagagtgggggccaatattcaacattcttaaagaaaagaattttcaacccagaatttcatatccagccaaactatgcttcataagtgaaggagaaataaaatatagacaagtgaacgatgaaagattttgtcaccaccaggcctgccctacaagagctcctgaaggaagcactaaacatggaaaggaacaaccggtaccagccactgcaaaaacatgccaaattgtaaacaccattgaggccaggaagaaactgcatcaactaacgagcaaaataaccagctaacatcatcatgacaggatcaaattcacacataacaatattaaccttaaatgtaaataggctaaatgctccaattaaaagacacagactggcaaactggataaagagtcaagacccatcagtgtgctgtattcaggaaacccatctcacgtgcagagacacacataggctcaaaataaagggatggaggaagatctaccaaacaaacggaaaacaaaaaaaggcaggggttgcaatcctagtctctgataaaacagactttaaaccaacaaagatcaaaagagacacagaaggccattacataatggtaaagggatcaattcaacaagaagagttaactatcctaaatatatatgcacccaatacaggagcacctagattcataaagcaagtccttagagacctacaaagagacttagactcccacacaataataatgggagactttaacaccccactgtcaacattagacagatcaatgagacagaaaattaacaaggatatccaggaattgaactcaactctgcaccaagcggacctaatagacatctacagaactctccaccccaaatcaacagaatatacattcttttcggcaccacaccacaccgattccaaaattgaacacatagttggaagtaaagcactcctcagcaaatgtaaaagaacagaaagtacaacaaactgtctctcagaccacagtgcaatcaaactaaaactcaggattaagaaactcactcaaaaccgctcaactacatggaaactgaacaacctgctcctgaatgactactgggtacataacgaaatgaaggcagaagtaaagatgttctttgaaaccaacgagaacaaagacacaacataccagaatctctgggacacattcaaagcagtgtgtagaggaaaatttatagcactaaatgcccacaagagaaagcaggaaagatctaaaattgacagcctaacatcacaattaaaagaactagagaaacaagagcaaacacattcaaaagctagcagaaggcaagaaataactacaatcagagcagaactgaaggagatagagacatacaaaaaacccttcaaaaaatcaatgaatccaggagctggttttttgaaaagatcaacaaaattgatagaccactagcaaaactaatacagaagagagaagaatcaaatagacacaataaaaaatgataaacgggatatcaccactgatcccacagaaatacaaactaccatcaaagaatactataaacacctctatgcaaataaactagaaaatctagaagaaatggataaattcctcgacacatacaccctcccaagactaaaccaggaagaagctgaatctctgaatagaccaataacaggctctgaaattgaggcaacaattaacaccttaccaaccaataaaagtccaggaccagatggattcacagccaaattctaccagaggtacaaggaggagctggtacgattccttctgaaactattccaatcaatagaaaaagagggaatcctccctaactcattttatgaggccagcatcatcctgataccaaagcctggcagagacacaacaaaaaaagagaatttcagaccaatatccctgatgaacatcgatgcaaaaatttttaataaaatactggcaaactgaatccagcagcacatcacaaagcttatccaccatgatcaagctggcttcattcctgggatgcaaggctggttcaacatacggaaaatcaataaatgtaatccagcatataaacagaaccaacaacacacaacacatgattatctcaacagatgcagaaaaggcctttgacaaaattcaacagcccttcatgctaaaaactctcaataaattaggtactgatgggacgtatctcaaaataataagcgctatctatgaccaacccacagccaatatcatactggatgggcaaaaactggaagcattccctttgaaaactggcacaagacagggatgccctctctcaccactcctattcaacacagtgttcgaagttctggcagggcaatcaggcaggagaaagaaataaagggtattcaattaggaaaagaggaggtcaaattgtccctgtttgcagatgacatgattgtatatatagaaaaccccattgtctcagcccaaaatctccttaagctgataagcaacttcagcaaagtctcaggatcaaaatcaatgtgcaaaaatcacaagcattcttatacaccaataacagacaaacagagagccaaatcatgagtgaactcccattcacaattgcttcaaagagaataaaatacctaggaatccaactcacaagggatgtgagagacctcttcaaggagaactataaaccactgctcaatgaaatgagaggatacagataaatggaagaacattccatgctcatgggtaggaagaatcaatatcgtgaaaatggccatactgcccaaggtaattttatagattcaatgccatccccatcaagctaccaatgactttcttcacagaattggaaaaaactactttaaagttcatatggaaccaaaaaagagcccgcattgccaagtcaatcctaagccaaaagaacaaagctagaggcatcacactacctgacttcaaactatactacaaggctacagtaaccaaaacagcatggtactggtaccaaagcagagatatagaccaatggaacaaaacagtgccctcagaaataatactgcatatctacaaccatctgatctttgacaaacctgacaaaaacaagcaatggggaaaggattccctatttaataaatggtgctgggaaaactggctagccatatgtagaaagctgaaattggatcccttccttacaccttgtacaaaaattaattcaagatggattacagacttaaatgttagacctaaaaccataaaaaccctagaagaaaacctaggcaataccattcaggacataggcatgggcaagaacttcatgtctagaacaccaaaagtaatggcaacaaaagccaaaattgacaaatgggtctaattaaactaaagagcttctgcacagcaaaagaaactaccatcagagtgaagaggcaacctacagaatgggagaaaatttttgcaatctgacaaaagggctaatttttgcatctgacaaagggctaatatccagaatctacaatgaactcaaacaaatttacaagaaaaaaacaaatttacaagaaaaaaacaaaatttacaagaaaaaaacaaatttacaagaaaaaaacaaacaaccccatcaaaaagtgggcaaaggataagaacagtcacttctcaaaagaagacatttatgcagccaaaagacacatgaaaaaattctcatcatcactggccatcagagaaatgcaaatcaaaaccacaatgagataccatctcacaccagttagaatggcgatcattaaaaagtcaagaaacaacaggtgctggagaggatgtggagaaataggaacacttttacactgttagtgggactgtaaactagttcaacattgtggaaatcagtatggcgattcctcagggatctagaactagaaataccatttgacccagccatcccattactgggtatatacccaaaggattataaatcatgctgctataaagacacttgcacacatatgtttattgtggtactattcacaatagcaaagacttggaattaacccaaatgtccaacaatgatagactagattaagaaaatgtggcacatatacactatggaatactttgcagccataaaaaaggatgagttcatgtcctttgtagggacatggatgaagctggaaaccatcattctcggcaaactatcgcaaggtcaaaaaaccaaacaccgcatgttctcactcataggtggtaactgaacaatgagaacacatggtcacaggaaggggaacatcacgcactggggcctgttgtggggtggggggagtgggcagggatagcattaggagacatacctaatgttaaatgacgatttaatgggtgcagcacaccaacatggcacatgtatacatatgtaacaaacccacacgttgtgcacatgtactctaaaacttaaagtataattaaaataaataaataaagtaaaaaagaaatcctaaggatactcaaattgttgtttaggtgaagatggatgatgccttccttgaatcatcagctaccaccgacagagtgaagtgagatggaatagtgggcacaatctcattcatcctactctatgtagcctaatgggtccagaatttatcatcactattttacactggaaaaaagatgagattatgaggggtcagggaggctttgagtttttgctctaacttcaccactaattaagaatgtgatcttgggtaagccactttaacctctgtaaatgtcaaatttcttatcagtaaaatgtgactatacaagacaataaatttgaaaatactttgcaaaattgaaagtaccatggaaataattcttcaatcccaaaaggttatgaacattattaaaatttgccacatggaagagcacacaccacagagacataactgtgatcataaacagatttacaaaagtggtgtttcattatggagggccatagggctgataaagacaaatgcatcaccaagctatgtccgagctcattcagatttttacaggaaacacagagcttctagctgaattatctctggatggtgtggaaattgtccaacacgttcctaatttcaaagaaacagaactgaatcttgaaaacccaagaggcctttacagaaactgacaagagatgaattaatataggtatcaagctacagaccaaattaaagttttacaaaactttgaaagagggtcagaaagaagaaacttatgggaagcagagtcctggaaagtcagctttgatggagtgacaatatgtgcaacacagtgagcaatctcttaggtaggcagcttcagggatgggggttgccctttgaaaggacttgggccactcttgagtctaagaggctaagtcacaaacaatgctaagcaactaaaaatagcttcttgtttaatagtaaaattctgcatagtaaaaggagaagcagggggtatgacacacgtggtagttagcagtctactagtgactttactgccacaaccagaaaagccagctgatgtgtcagacgtgagaaagcgaaagtatgtcacagcgaatgtagcttttccacacgtatttcaagaaagaaatgaaaaaggccaacttctataatggtgcctactgtgcattaacagagataaactaggggtctaagaactcagttttctacagggtcccagaagtatagccatatattgccccattctctaatggaaatagccagagaaatagaaatatcaagactggagaacatcaaatacctcattggaaaagcccccacataggaaaatgtgtgggcttgaattcttccattctggaagggtaaaggcctgagtgatgatgctgggattagacactgaaactctttagagaagcaaaacaagtataataaagctgtactttattatattaaataaataacacacagactaccaaatagcctgccccttataacagcgttaatgtgattttgatctgaaatgtatagagacattttgcattttttcggtataaaaagttcatgagatttggccctaatctggaccttttcttcatttttttttctacttgagggactataatctttatttttaaatttgttttatattctccgaacattacctaacgcatagaaaactcttcttgaaccatttttctctgttctttgtaaaatattacatttgactgttccttagactgctttaatcattcctgcctatgcaccctcctcaaaatccagtttaaattaattgttccttattcaagattccttatatccacctcccttggggcagcaatcacctatcacccaggactacacttgtgtatgtacatatcttccctattacaaatcaggttctttgaaaaaatacaaatggtaagagagtggatttttggagtcagtacattctcttttcaaatccttcttctgccccttactggcaataagggctgagtgacctagagcaaattacttaacttctctgagcctcagttttctaatctgcaaaataggagccatcacttcacaagtctgtaagacttatattagactaagtgcctgcctgtacactgttctcttttctctctttctatatacctgaaggcattataggtgctagatgtctgtttaaagaccagacaatattgtcttaaaaaaacaaacaaaaacacagacaataccatctttaaaaaaaaaaaaaagtccaggtaagaaataaataaggccatagaatggaagctttacaaggactctctgtgagacaggatctcctcaagtgtccccaggttaaattagaagtatatatccgtacaattgttcagccagtttgtgcactgtactgaggatgaatgaacacctatcctaaatatcctagtcttctgactaaaaacaagatcatatttcataacgattattgttacattcatagtgtcccaggtgatttagaggataaataaaaatccattaaagaggtaaagacataaaaacgagaaacatggactggtttacacataacacatacaaagtctattataaaactagcatcagtatccttgaatgcaaacctttttctgagtatttaacaatcgcaccctttaaaaaatgtacaatagacattaagagacttaaacagatatataatcattttaaattaaaatagcgttaaacagtacctcaagctcaataagcattttaagtattctaatcttagtatttctctagctgacatgtaagaagcaatctatcttattgtatgcaattagctcattgtgtggataaaaaggtaaaaccattctgaaacaggaaaccaatacacttcctgtttaatcaacaaatctaaacatttattcttttcatctgtttactcttgctgttgtccaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacttaatcaacaaatctaaacatttattcttttcatctgtttactcttgctcttgttcaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaatgtaagtatatttcctttcttactaaaattattacatttagtaatctagctggagatcatttcttaataacaatgcattatactttcttagaattacaagaatcccaaactcaccaggatgctcacatttaagttttacatgcccaagaaggtaagtacaatattttatgttcaatttctgttttaataaaattcaaagtaatatgaaaatttgcacagatgggactaatagcagctcatctgaggtaaagagtaactttaatttgtttttttgaaaacccaagtttgataatgaagcctctattaaaacagttttacctatatttttaatatatatttgtgtgttggtgggggtgggaagaaaacataaaaataatattctcacctttatcgataagacaattctaaacaaaaatgttcatttatggtttcatttaaaaatgtaaaactctaaaatatttgattatgtcattttagtatgtaaaataccaaaatctatttccaaggagcccacttttaaaaatcttttcttgttttaggaaaggtttctaagtgagaggcagcataacactaatagcacagagtctggggccagatatctgaagtgaaatctcagctctgccatgtcctagctttcatgatctttggcaaattacctactctgtttgtgattcagtttcatgtctacttaaatgaataactgtatatacttaatatggctttgtgagaattagtaagttaaatgtaaagcactcagaaccgtgtctggcataaggtaaataccatacaagcattagctattattagtagtattaaagataaaattttcactgagaaatacaaagtaaaattttggactttatctttttaccaatagaacttgagatttataatgctatatgacttattttccaagattaaaagcttcattaggttgtttttggattcagatagagcataagcataatcatccaagctcctaggctacattaggtgtgtaaagctacctagtagttgtgccagttaagagagaatgaacaaaatctggtgccagaaagagcttgtgccagggtgaatccaagcccagaaaataataggatttaaggggacacagatgcaatcccattgactcaaattctattaattcaagagaaatctgcttctaactacccttctgaaagatgtaaaggagacagcttacagatgttactctagtttaatcagagccacataatgcaactccagcaacataaagatactagatgctgttttctgaagaaaatttctccacattgttcatgccaaaaacttaaacccgaatttgtagaatttgtagtggtgaattgaaagcgcaatagatggacatatcaggggattggtattgtcttgacctacctttcccactaaagagtgttagaaagatgagattatgtgcataatttagggggtggtagaattcatggaaatctaagtttgaaaccaaaagtaatgataaactctattcatttgttcatttaaccctcattgcacatttacaaaagattttagaaactaataaaaatatttgattccaaggatgctatgttaatgctataatgagaaagaaatgaaatctaattctggctctacctacttatgtggtcaaattctgagatttagtgtgcttatttataaagtggagatgatacttcactgcctacttcaaaagatgactgtgagaagtaaatgggcctattttggagaaaattcttttaaattgtaatataccatagaaatatgaaatattatatataatatagaatcaagaggcctgtccaaaagtcctcccaaagtattataatcttttatttcactgggacaaacatttttaaaatgcatcttaatgtagtgattgtagaaaagtaaaatttaagacatatttaaaaatgtgtcttgctcaaggctatattgagagccactactacatgattattgttacctagtgtaaaatgttgggattgtgatagatggcattcaagagttccttctctctcaacattctgtgattcttaactcttagactatcaaatattataatcatagaatgtgatttttatgcttccacattctaactcatctggttctaatgattttctatgcagattggaaaagtaatcagcctgcatctgtgataggcacttacgatgcagaaagtctaacattttgcaaagccaaattaagctaaaaccagtgagtcaactatcacttaacgctagtcataggtacttgagccctagtttttccagttttataatgtaaactctactggtccattctttacagtgacattgagaacagagagaatggtaaaaactacatactgctactccaaataaaataaattggaaattaatttctgattctgacctctatgtaaactgagctgatgataattattattctaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaaggtaaggcattactttatttgctctcctggaaataaaaaaaaaaaagtcagggggaaaagtaccacattttaaagtgacataacatttttggtatttgtaaagtacccatgcatgtaattagcctacattttaagtacactgtgaacatgaatcatttctaatgttaaatgattaactggggagtataagctactgagtttgcacctaccatctactaatggacaagcctcatcccaaactccatcacctttcatattaacacaaaactgggagtgagagaaggtactgagttgagtttcacagaaagcaggcagattttattatatatttttcgattcttcagatcatttactgaaatagccaatactgattacctgaaaggcttttcaaatggtgtttccttatcatttgatggaaggactacccataagagatttgtcttaaaaaaaaaaactggagccattaaaatggccagtggactaaacaaacaacaatctttttagaggcaatccccactttcagaatcttaagtatttttaaatgcacaggaagcataaaatatgcaagggactcaggtgatgtaaaagagattcacttttgtctttttatatcccgtctcctaaggtataaaattcatgagttaataggtatcctaaataagcagcataagtatagtagtaaaagacattcctaaaagtaactccagttgtgtccaaatgaatcacttattagtggactgtttcagttgaattaaaaaaatacattgagatcaatgtcatctagacattgacagattcagttccttatctatggcaagagttttactctaaaataattaacatcagaaaactcattcttaactcttgatacaaatttaagacaaaaccatgcaaaaatctgaaaactgtgtttcaaaagccaaacactttttaaaataaaaaatcccaagatatgacaatatttaaacaattatgcttaagaggatacagaacactgcaacagttttttaaaagagaatacttatttaaagggaacactctatctcacctgcttttgttcccagggtaggaatcacttcaaatttgaaaagctctcttttaaatctcactatatatcaaaatatttcctccttagcttatcaactagaggaagcgtttaaatagctcctttcagcagagaagcctaatttctaaaaagccagtccacagaacaaaatttctaatgtttaaacttttaaaagttggcaaattcacctgcattgatactatgatggggtagggataggtgtaagtatttagaagatgttcttcacacaaatttatcccaaacggaagcatgtcctagcttactctagtgtagttctgttctgctttggggaaaatataaggagattcacttaagtagaaaaataggagactctaatcaagatttagaaaagaagaaagtataatgtgcatatcaattcatacatttaacttacacaaatataggtgtacattcagaggaaaagcgatcaagtttatttcacatccagcatttaatatttgtctagatctatttttatttaaatctttatttgcacccaatttagggaaaaaatttttgtgttcattgactgaattaacaaatgaggaaaatctcagcttctgtgttactatcatttggtatcataacaaaatatgtaattttggcattcattttgatcatttcaagaaaatgcgaataattaatatgtttggtaagcttgaaaataaaggcaacaggcctataagacttcaattgggaataactgtatataaggtaaactactctgtactttaaaaaattaacatttttcttttatagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtgccctaggggctctaaaatggtttcacttatttatcccaaaatatttattattatgttgaatgttaaatatagtgctatgtagattggttagtaaaactatttaataaatttgataaatataaacaagcctggatatttgttattttggaaacagcacagagtaagcatttaaatatttcttagttacttgtgtgaactgtaggatggttaaaatgcttacaaaagtcactctttctctgaagaaatatgtagaacagagatgtagacttctcaaaagcccttgctttgtcctttcaagggctgatcagacccttagttctggcatctcttagcagattatattttccttcttcttaaaatgccaaacacaaacactcttgaaactcttcatagatttggtgtggctatgaattccgaattcccctatcacctaagtgtgggctaatgtaacaaagagggatttcacctacatccattcagtcagtctttgggggtttaaagaaattccaaagagtcatcagaagaggaaaaatgaaggtaatgttttttcagactggtaaagtctttgaaaatatgtgtaatatgtaaaacattttgacacccccataatatttttccagaattaacagtataaattgcatctcttgttcaagagttccctatcactctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaatgtaagtatatttcctttcttactaaaattattacatttagtaatctagctggagatcatttcttaataacaatgcattatactttcttagaattacaagaatcccaaactcaccaggatgctcacatttaagttttacatgcccaagaaggtaagtacaatattttatgttcaatttctgttttaataaaattcaaagtaatatgaaaatttgcacagatgggactaatagcagctcatctgaggtaaagagtaactttaatttgtttttttgaaaacccaagtttgataatgaagcctctattaaaacagttttacctatatttttaatatatatttgtgtgttggtgggggtgggagaaaacataaaaataatattctctcactttatcgataagacaattctaaacaaaaatgttcatttatggtttcatttaaaaatgtaaaactctaaaatatttgattatgtcattttagtatgtaaaataccaaaatctatttccaaggagcccacttttaaaaatcttttcttgttttaggaaaggtttctaagtgagaggcagcataacactaatagcacagagtctggggccagatatctgaagtgaaatctcagctctgccatgtcctagctttcatgatctttggcaaattacctactctgtttgtgattcagtttcatgtctacttaaatgaataactgtatatacttaatatggctttgtgagaattagtaagtaaatgtaaagcactcagaaccgtgtctggcataaggtaaataccatacaagcattagctattattagtagtattaaagataaaattttcactgagaaatacaaagtaaaattttggactttatctttttaccaatagaacttgagatttataatgctatatgacttattttccaagattaaaagcttcattaggttgtttttggattcagatagagcataagcataatcatccaagctcctaggctacattaggtgtgtaaagctacctagtagctgtgccagttaagagagaatgaacaaaatctggtgccagaaagagcttgtgccagggtgaatccaagcccagaaaataataggatttaaggggacacagatgcaatcccattgactcaaattctattaattcaagagaaatctgcttctaactacccttctgaaagatgtaaaggagacagcttacagatgttactctagtttaatcagagccacataatgcaactccagcaacataaagatactagatgctgttttctgaagaaaatttctccacattgttcatgccaaaaacttaaacccgaatttgtagaatttgtagtggtgaattgaaagcgcaatagatggacatatcaggggattggtattgtcttgacctacctttcccactaaagagtgttagaaagatgagattatgtgcataatttaggggtggtagaattcatggaaatctaagtttgaaaccaaaagtaatgataaactctattcatttgttcatttaaccctcattgcacatttacaaaagattttagaaactaataaaaatatttgattccaaggatgctatgttaatgctataatgagaaagaaatgaaatctaattctggctctacctacttatgtggtcaaattctgagatttagtgtgcttatttataaagtggagatgatacttcactgcctacttcaaaagatgactgtgagaagtaaatgggcctattttggagaaaattcttttaaattgtaatataccatagaaatatgaaatattatatataatatagaatcaagaggcctgtccaaaagtcctcccaaagtattataatcttttatttcactgggacaaacatttttaaaatgcatcttaatgtagtgattgtagaaaagtaaaaatttaagacatatttaaaaatgtgtcttgctcaaggctatattgagagccactactacatgattattgttacctagtgtaaaatgttgggattgtgatagatggcatccaagagttccttctctctcaacattctgtgattcttaactcttagactatcaaatattataatcatagaatgtgatttttatgccttccacattctaatctcatctggttctaatgattttctatgcagattggaaaagtaatcagcctacatctgtaataggcatttagatgcagaaagtctaacattttgcaaagccaaattaagctaaaaccagtgagtcaactatcacttaacgctagtcataggtacttgagccctagtttttccagttttataatgtaaactctactggtccatctttacagtgacattgagaacagagagaatggtaaaaactacatactgctactccaaataaaataaattggaaattaatttctgattctgacctctatgtaaactgagctgatgataattattattctaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaaggtaaggcattactttatttgctctcctggaaataaaaaaaaaaaagtagggggaaaagtaccacattttaaagtgacataacatttttggtatttgtaaagtacccatgcatgtaattagcctacattttaagtacactgtgaacatgaatcatttctaatgttaaatgattaactggggagtataagctactgagtttgcacctaccatctactaatggacaagcctcatcccaaactccatcacctttcatattaacacaaaactgggagtgagagagaagtgactgagttgagtttcacagaaacgcaggcaagattttattatatatttttcaagttccttcacagatcatttactggaatagccaatactgagttacctgaaaggcttttcaaatggtgtttccttatcatttgatggaaggactacccataagagatttgtcttaaaaaaaaaaactggagccattaaaatggccagtggactaaacaaacaacaatctttttagaggcaatcccactttcagaatcttaagtatttttaaatgcacaggaagcataaaatatgcaagggactcaggtgatgtaaaagagattcacttttgtctttttatatcccgtctcctaaggtataaaattcatgagttaataggtatcctaaataagcagcataagtatagtagtaaaagacattcctaaaagtaactccagttgtgtccaaatgaatcacttattagtggactgtttcagttgaattaaaaaaatacattgagatcaatgtcatctagacattgacagattcagttccttatctatggcaagagttttactctaaaataattaacatcagaaaactcattcttaactcttgatacaaatttaagacaaaaccatgcaaaaatctgaaaactgtgtttcaaaagccaaacactttttaaaataaaaaaatcccaagatatgacaatatttaaacaattatgcttaagaggatacagaacactgcaacagttttttaaaagagaatacttatttaaagggaacactctatctcacctgcttttgttcccagggtaggaatcacttcaaatttgaaaagctctcttttaaatctcactatatatcaaaatagttgcctccttagcttatcaactagaggaagcgtttaaatagctcctttcagcagagaagcctaatttctaaaaagccagtccacagaacaaaatttctaatgtttaaagcttttaaaagttggcaaattcacctgcattgatactatgatggggtagggataggtgtaagtatttatgaagatgttcattcacacaaatttacccaaacaggaagcatgtcctacctagcttactctagtgtagctcgtttcgtctttggggaaaatataaggagattcacttaagtagaaaaataggagactctaatcaagatttagaaaagaagaaagtataatgtgcatatcaattcatacatttaacttacacaaatataggtgtacattcagaggaaaagcgatcaagtttatttcacatccagcatttaatatttgtctagatctatttttatttaaatctttatttgcacccaatttagggaaaaaatttttgtgttcattgactgaattaacaaatgaggaaaatctcagcttctgtgttactatcatttggtatcataacaaaatacgcaattttggcattcattttgatcatttcaagaaaatgtgaataattaatatgtttggtaagcttgaaaataaaggcaacaggcctataagacttcaattgggaataactgtatataaggtaaactactctgtactttaaaaaattaacatttttcttttatagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaacaagcctggatatttgttattttggaaacagcacagagtaagcatttaaatatttcttagttacttgtgtgaactgtaggatggttaaaatgcttacaaaagtcactctttctctgaagaaatatgtagaacagagatgtagacttctcaaaagcccttgctttgtcctttcaagggctgatcagacccttagttctggcatctcttagcagattatattttccttcttcttaaaatgccaaacacaaacactcttgaaactcttcatagatttggtgtggcccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataa

SEQ ID NO: 2534 - DNA, 919 bp; single-stranded, linear
aggcccagttgaaaccagggagttgctctcctttctcctcccttgacctcacccctcagaccatgccaattctgcctcctaaacctcccaggccagcccctcccccagctcccagtgacagtgtcctcaggtacctgagctcagctctcggtgctaccagagggactgcagggctgcagaggctgagtcccacacgcagggaacagccatgccactgctagcagaccagtaagagaatggccacctggggcctgagcgccctcggccatccaccagaaacaaagtgtcaaggagaagctgcccgaagcccatgggacaaaccactggggactggaacaccagtaattctgtattgggaagcggcaccaagagatgtgcttctcagagcctgaggctgaacgtggatgtttagcagcgtgaccggctaccagacaaactctcatctgttccagtggcctcctggccacccaccaggaccaagcagggcgggcagcagagggccagggtagtccaggtgatggcagatgagatcccactgggcaggaggcctcagtgagctgagtcaggcttccccttcctgccacaggggtcctctcacctgctgccatgcttcccatctctcatcctccttgacaagatgaagtgataccgtttaagtaatcttttttcttgtttcactgatcttgagtactagaaagtcatggatgaataattacgtctgtggttttctatggaggttccatgtcagataaagatccttccgacgcctgccccacaccaccacctcccccgccttgcccggggttgtgggcaccttgctgctgcacatataaggcgggagctgttgccaactcttcagagccccacgaaggaccagaacaagacagagtgcctcctgccgatccaaacatgagccgcc

SEQ ID NO: 2535 - DNA, 452 bp; single-stranded, linear
gccacccaccaggaccaagcagggcgggcagcagagggccagggtagtccaggtgatggcagatgagatcccactgggcaggaggcctcagtgagctgagtcaggcttccccttcctgccacaggggtcctctcacctgctgccatgcttcccatctctcatcctccttgacaagatgaagtgataccgtttaagtaatcttttttcttgtttcactgatcttgagtactagaaagtcatggatgaataattacgtctgtggttttctatggaggttccatgtcagataaagatccttccgacgcctgccccacaccaccacctccccccgccttgcccggggttgtgggcaccttgctgctgcacatataaggcgggaggttgttgccaactcttcagagccccacgaaggaccagaacaagacagagtgcctcctgccgatccaaacatg

SEQ ID NO: 2536 - DNA, 2749 bp; single-stranded, linear
gatccaggagaccagtctcctagtaccaggtctgcttgcctaaacttggagtataagagccatagacactgtctcttcgatcagtccttgcccccaccccctgctgttgcacccttatctttcaccctattgctcctgcattgaagacagaagcacccagtttcccctgcctcagcataacttgctagccttcatttcctcgtgctggtcacatcacaccacaacccgacccaaaccctggtttctctaccatgcccctgcttccctgcaccccaggcttgtcacactcatcttctaccaaaactccagctttgtgctgtggcctgtcaacctgtcccatggaaaagggggccaccccatccttcagggactgtcccctggctctccacactcctggctttgccactttctctctagctgtggtttctcaggtcctttgagaacttcccataactgtccctgtttccttcccacctctgtaggcctgagctgcaaaccagctcccactccacccaggctccagggccgactgggatttagatccctcaatatggctttccttcagggagtagttctcttctctcctcttgccctcccggctcaaacttgtccatgccacctgctacaccgtcctgcagctcccagtaactaacactattctcaaggcccacctttgtccctaggtccctaagcctaattatctgagttatcagaaggatggcctagtgtttgcagtcatatctccatcaagggttctgtcctctagatgtgggccttagcgcattgccttactgcactgagactagaccagtgaaggagtgagctgaactccatatccacctgcaaggaataagggtcaatgggaaggctgcctagagggagagggagctctagctaccagcggccagaggactagcccacccatggacgtttaaccatgtgccagaatgcctaccatgttcaagtttgccccagtgaccctggtggcccactaatagtggtggcccacagtcaggggcagatttgtacaagggatggtaggaagaggttccagtgcacagaaaccccaagctggctcggagccaggctacttcctcccaccacctgtttccactcggtccatctctatgacaaaggaagaagatggcctttgaataagcagtctttcttcccatgtcgataattttgagtactagaaaacgatgaataagtctgtggtttgctatggaggttccatgtcagataaagctgcttctgatgcctgcccttccccccatgccctgcctggggcccgccccgcccctctcgatgaatatatataaggtgaaggctcctgtggcttcttcagaactctttggaggaccagaacgagacaatggttcttgccagctctaccaccagcatcctctgtatgctgctcccgctcctgatgctcttccaccagggactccagatttcagacaggggctcagatgcccaccatttactcaggacgttggattgcaggactattgccttggagattttggtgaagctcccagtgagtagctggctgaggttagcctgggcaggctggcttcaacaggtgcctcggaccaataagcctcatgattctttcttttagtatcctcaggtatctggactcaataatagtgacgacaaagccaatctgagggtaagagccctgctcttgggcattcttgggttccatctgtctcctgcctgggtgactttagccatgtcactgcaccctgctttgcttccgttttcacatctatctcagtggggttattaaggaaatcatcagatgactctctgagcctcagtctgtgccacagccagctgcaataatgaaagttgcattttaggagatacaatggagagagaactgtgagtgaaccctgccacaggcctctggctccactttcagtggggatgccatggggatgccatggaccagtgaacgagttgccttctgtgactgtgtcttttgcttttcttcctcctccaaaactgagcttgtgttctccacttccaccagcctaagacattaccatttgcagttattttcccagctctagttagatacaatggttctgtttcgtttttatttgtttgcaagcgtgctgagtgtctacgtttcccctccctagggacatgatgaagtctgtaggattttcttctagatatctagaagttcttaattaaattaaagcattggggttggggatttagctcagtggtagagtgcttgcctagcaagcgcaaggccctgagttcattccccagctccgaaaaaaagaaaaaagaaaaagaaaaaaaattaaagcattaaccttggtgtttggcatcttgggcataagtatttcccttggccaaccttctgccttttctagagcttgtctggagagatatgtttcccttaaaaacagacagatctgcttagagccttcacacagtccacaggctgccaggggttaagacctggtgctcaggagaaacaggcccttgtctgggatgtgccctagctttagccccaggataaggaaaggaccaggagtaaggctgttcaaagaaacctctaacagcagtcacacctccccagctctcacctccccagctctcacctccccagctctcacctctcccgctctcacctccccagctctcacctctccagctctcacttccccagttctcacctccccagctctcacctctccagctctcacctccccagctctcacct

SEQ ID NO: 2537 - DNA, 923 bp; single-stranded, linear
cagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaac

SEQ ID NO: 2538 - DNA, 882 bp; single-stranded, linear
tgtgtaagtaagtgcaagctacagagaaaaccaaggaagaaaaaaattgccagagatccaggttaaaaaaaaaaaaagaaaaagaaaagaaaaccaaggaagcaatcatcataaaagacaggtgagtgggttacctctaagggcgagcagtcacgattagaggacaaatatggggagagttttggagcgttggcgatttttttttgacttaagcatggttaaatgggtgattgcttataattacttgttaaattaggttaattaggttttatttacatgttttatgctcttttctgcatgcatttgtgctctatttttttaattaaaaaataaaataaagtaaaactatgtttcttgcacttaaaatactggaaaaccaaagagaatctgaaaaacttttagaatgaagagagtttggcaagacggcaagaacccttgctttttccactgggcctttcttcctcccaccctgagggtgctccatggaaaatgcaaatctacttaactgactttcgcaaatgtcaaatgtagagtacgaatttcaaggggagcctggggctgtgccatatcctgctgtgagctacagttttccagcctctagagccatcttaacaaggtgcctgcctggtgtctactaccccagtatgtgctccaacccctgcccaggcctcctagtgctagagaggatatagacatggcctctccatggaaacctccagggctggtatgacaccttaacaaacaaaaagggaggattgccggtacagcggagtcccgcaggaggataggtgttgccttctaggtggtagggaggctgagagggccatccagagtagggaccacgaactggggtctcaacatgaagagtcgttcatcagatct

SEQ ID NO: 2539 - DNA, 5925 bp; single-stranded, linear
aggcccagttgaaaccagggagttgctctcctttctcctcccttgacctcacccctcagaccatgccaattctgcctcctaaacctcccaggccagcccctcccccagctcccagtgacagtgtcctcaggtacctgagctcagctctcggtgctaccagagggactgcagggctgcagaggctgagtcccacacgcagggaacagccatgccactgctagcagaccagtaagagaatggccacctggggcctgagcgccctcggccatccaccagaaacaaagtgtcaaggagaagctgcccgaagcccatgggacaaaccactggggactggaacaccagtaattctgtattgggaagcggcaccaagagatgtgcttctcagagcctgaggctgaacgtggatgtttagcagcgtgaccggctaccagacaaactctcatctgttccagtggcctcctggccacccaccaggaccaagcagggcgggcagcagagggccagggtagtccaggtgatggcagatgagatcccactgggcaggaggcctcagtgagctgagtcaggcttccccttcctgccacaggggtcctctcacctgctgccatgcttcccatctctcatcctccttgacaagatgaagtgataccgtttaagtaatcttttttcttgtttcactgatcttgagtactagaaagtcatggatgaataattacgtctgtggttttctatggaggttccatgtcagataaagatccttccgacgcctgccccacaccaccacctcccccgccttgcccggggttgtgggcaccttgctgctgcacatataaggcgggagctgttgccaactcttcagagccccacgaaggaccagaacaagacagagtgcctcctgccgatccaaacatgagccgccgccacccaccaggaccaagcagggcgggcagcagagggccagggtagtccaggtgatggcagatgagatcccactgggcaggaggcctcagtgagctgagtcaggcttccccttcctgccacaggggtcctctcacctgctgccatgcttcccatctctcatcctccttgacaagatgaagtgataccgtttaagtaatcttttttcttgtttcactgatcttgagtactagaaagtcatggatgaataattacgtctgtggttttctatggaggttccatgtcagataaagatccttccgacgcctgccccacaccaccacctccccccgccttgcccggggttgtgggcaccttgctgctgcacatataaggcgggaggttgttgccaactcttcagagccccacgaaggaccagaacaagacagagtgcctcctgccgatccaaacatggatccaggagaccagtctcctagtaccaggtctgcttgcctaaacttggagtataagagccatagacactgtctcttcgatcagtccttgcccccaccccctgctgttgcacccttatctttcaccctattgctcctgcattgaagacagaagcacccagtttcccctgcctcagcataacttgctagccttcatttcctcgtgctggtcacatcacaccacaacccgacccaaaccctggtttctctaccatgcccctgcttccctgcaccccaggcttgtcacactcatcttctaccaaaactccagctttgtgctgtggcctgtcaacctgtcccatggaaaagggggccaccccatccttcagggactgtcccctggctctccacactcctggctttgccactttctctctagctgtggtttctcaggtcctttgagaacttcccataactgtccctgtttccttcccacctctgtaggcctgagctgcaaaccagctcccactccacccaggctccagggccgactgggatttagatccctcaatatggctttccttcagggagtagttctcttctctcctcttgccctcccggctcaaacttgtccatgccacctgctacaccgtcctgcagctcccagtaactaacactattctcaaggcccacctttgtccctaggtccctaagcctaattatctgagttatcagaaggatggcctagtgtttgcagtcatatctccatcaagggttctgtcctctagatgtgggccttagcgcattgccttactgcactgagactagaccagtgaaggagtgagctgaactccatatccacctgcaaggaataagggtcaatgggaaggctgcctagagggagagggagctctagctaccagcggccagaggactagcccacccatggacgtttaaccatgtgccagaatgcctaccatgttcaagtttgccccagtgaccctggtggcccactaatagtggtggcccacagtcaggggcagatttgtacaagggatggtaggaagaggttccagtgcacagaaaccccaagctggctcggagccaggctacttcctcccaccacctgtttccactcggtccatctctatgacaaaggaagaagatggcctttgaataagcagtctttcttcccatgtcgataattttgagtactagaaaacgatgaataagtctgtggtttgctatggaggttccatgtcagataaagctgcttctgatgcctgcccttccccccatgccctgcctggggcccgccccgcccctctcgatgaatatatataaggtgaaggctcctgtggcttcttcagaactctttggaggaccagaacgagacaatggttcttgccagctctaccaccagcatcctctgtatgctgctcccgctcctgatgctcttccaccagggactccagatttcagacaggggctcagatgcccaccatttactcaggacgttggattgcaggactattgccttggagattttggtgaagctcccagtgagtagctggctgaggttagcctgggcaggctggcttcaacaggtgcctcggaccaataagcctcatgattctttcttttagtatcctcaggtatctggactcaataatagtgacgacaaagccaatctgagggtaagagccctgctcttgggcattcttgggttccatctgtctcctgcctgggtgactttagccatgtcactgcaccctgctttgcttccgttttcacatctatctcagtggggttattaaggaaatcatcagatgactctctgagcctcagtctgtgccacagccagctgcaataatgaaagttgcattttaggagatacaatggagagagaactgtgagtgaaccctgccacaggcctctggctccactttcagtggggatgccatggggatgccatggaccagtgaacgagttgccttctgtgactgtgtcttttgcttttcttcctcctccaaaactgagcttgtgttctccacttccaccagcctaagacattaccatttgcagttattttcccagctctagttagatacaatggttctgtttcgtttttatttgtttgcaagcgtgctgagtgtctacgtttcccctccctagggacatgatgaagtctgtaggattttcttctagatatctagaagttcttaattaaattaaagcattggggttggggatttagctcagtggtagagtgcttgcctagcaagcgcaaggccctgagttcattccccagctccgaaaaaaagaaaaaagaaaaagaaaaaaaattaaagcattaaccttggtgtttggcatcttgggcataagtatttcccttggccaaccttctgccttttctagagcttgtctggagagatatgtttcccttaaaaacagacagatctgcttagagccttcacacagtccacaggctgccaggggttaagacctggtgctcaggagaaacaggcccttgtctgggatgtgccctagctttagccccaggataaggaaaggaccaggagtaaggctgttcaaagaaacctctaacagcagtcacacctccccagctctcacctccccagctctcacctccccagctctcacctctcccgctctcacctccccagctctcacctctccagctctcacttccccagttctcacctccccagctctcacctctccagctctcacctccccagctctcacctcagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaactgtgtaagtaagtgcaagctacagagaaaaccaaggaagaaaaaaattgccagagatccaggttaaaaaaaaaaaaagaaaaagaaaagaaaaccaaggaagcaatcatcataaaagacaggtgagtgggttacctctaagggcgagcagtcacgattagaggacaaatatggggagagttttggagcgttggcgatttttttttgacttaagcatggttaaatgggtgattgcttataattacttgttaaattaggttaattaggttttatttacatgttttatgctcttttctgcatgcatttgtgctctatttttttaattaaaaaataaaataaagtaaaactatgtttcttgcacttaaaatactggaaaaccaaagagaatctgaaaaacttttagaatgaagagagtttggcaagacggcaagaacccttgctttttccactgggcctttcttcctcccaccctgagggtgctccatggaaaatgcaaatctacttaactgactttcgcaaatgtcaaatgtagagtacgaatttcaaggggagcctggggctgtgccatatcctgctgtgagctacagttttccagcctctagagccatcttaacaaggtgcctgcctggtgtctactaccccagtatgtgctccaacccctgcccaggcctcctagtgctagagaggatatagacatggcctctccatggaaacctccagggctggtatgacaccttaacaaacaaaaagggaggattgccggtacagcggagtcccgcaggaggataggtgttgccttctaggtggtagggaggctgagagggccatccagagtagggaccacgaactggggtctcaacatgaagagtcgttcatcagatct

SEQ ID NO: 2540 - DNA, 1460 bp; single-stranded, linear
gcacacgggaagatatcagaaacatcctaggatcaggacaccccagatcttctcaactggaaccacgaaggctgtttcttccacacagcactttgatctccatttaagcaggcacctctgtcctgcgttccggagctgcgttcccgatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagatgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaac

SEQ ID NO: 2541 - DNA, 614 bp; single-stranded, linear
gatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 2542 - DNA, 9900 bp; single-stranded, linear
gaattcaataaaaaacaagcagggcgcgtggtggggcactgactaggagggctgatttgtaagttggtaagactgtagctctttttcctaattagctgaggatgtgtttaggttccattcaaaaagtgggcattcctggccaggcatggtggctcacacctgtaatctcagagctttgggagactgaggtaggaggatcacttgagcccaggaatttgagatgagcctaggcaacatagtgagactcttatctctatcaaaaaataaaaataaaaatgagccaggcatggtgcggtggaccacgcacctactgctaggggggctgaggtgggaggatcattgagcctgggaggttgaggctgcagtgatccctgatcaaacattgcatttcagcctgggtgacagagtgagaccctgtctcagaaaaaaaaaaaaaaagtcattcctgaaacctcagaatagacctaccttgccaagggcttccttatgggtaaggaccttatggacctgctgggacccaaactaggcctcacctgatacgacctgtccttctcaaaacactaaacttgggagaacattgtcccccagtgctggggtaggagagtctgcctgttattctgcctctatgcagagaaggagccccagatcatcttttccatgacaggacagtttccaagatgccacctgtacttggaagaagccaggttaaaatacttttcaagtaaaactttcttgatattactctatctttccccaggaggactgcattacaacaaattcggacacctgtggcctctcccttctatgcaaagcaaaaagccagcagcagccccaagctgataagattaatctaaagagcaaattatggtgtaatttcctatgctgaaactttgtagttaattttttaaaaaggtttcattttcctattggtctgatttcacaggaacattttacctgtttgtgaggcattttttctcctggaagagaggtgctgattggccccaagtgactgacaatctggtgtaacgaaaatttccaatgtaaactcattttccctcggtttcagcaattttaaatctatatatagagatatctttgtcagcattgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaaggtgagtacctatctggcaccatctctccagatgttctggtgatgctctcagtatttctaggcatgaaaacgttaacagctgctagagaagttggaactggtggttggtggcagtccagggcacacagcgaggcttctccctgccactcttttttctgagggtttgtaggaagtttcctcagttggagggagtgagagctgctcatcaaggacttctctgtccggttggaggttaactctgtctcttgctctctcatttctgcctggaccaagactctgtgcaccgagttgaccgtaacagacatctttgctgcctccaaggtaagaagccgtcccacggtctgttttagcaaatggggagatccatccccaaatgtctgaacaagaaacttgtctaatggaaaacgagcgggcccaaattaactctaaggtgttagatgttttcaaagaacgagaagtctgatctttactcttaagcatgttttggtctttctggtttcacttgatttagaagacatgtaatagaaagcttacatgctgtagtcctgactcagatcctggtcaaagaaaagccctcttgggttttacttagctttggcatagtgcctggaacgtaggaggcactcaataaatgcctgttgaatgagagaatttttctggcccatacatttctgaaaaaccaaatactctcacagaaacagatattgagatgacaggttgagggagctttcattttgtctaagagacttcctatggcaacagaaaaggtatcgccagagcccctcctcttccacagcctggccacctaacagccctctggttccggggctgccgtccagagctctcagcttgctctggccggccgaactcccctccagctcggtctggaaccatcctgctgggcagcgtccagcacatccctgcttcgggctgcctgggcacctcgcctctctgcctcctgtgctgcctcacccccacccctctatctgtagtgggagggagatagatttgacagctgatagtgcattttctctgacaaacacatgactacagccgtatcaatagttttgtgcatttcagttcctgttttcatggaaacacacggctgagaatgaaagccccaaagcctcaatttcacagtggtctcctaactacctgctttccatgcaaactagggagatgatatggccaggagtgaagccctgtgtgttgggcagggtcacactccagcacccagaccatagaacagggcccatcctgcttcatgagggaaactgctcttcgggcctttagctggactatctcatttcattagttatcccgggagtccgatacaggatgagattctgaagggcaaatacacactttttttttttttttgagatagggtcttgttctgtcacccaggctggagtgcagtggtgcgatttcagctcatagcagcctccacctcccaggctcaagctatcttcctacctcagcctcccaagtagccgggacgacaggtgtgcaccaccacgcctggctaatttttgtatttttttgtagagatggagtcttgccattttgcccaggcttgtctcgaacttctgggctcaagcaatccgtccacctcggcctctcaaagtgctgggattagccactgcacctgggcaacagtttatgtgtgtgtgtgtgtgtgtgtgtatatatgtgtgtgtgtgtatatatatgtgtgtatgtatatatgtgtatgtatatgtgtgtgtgtgtgtgtgtgtgtgtgtgtgtataaaatctccaagtccatccaaccgagatggctcctactagaagccaagagtccaccgggttgagcactgggtctctggaggcctgtcggactgctgagaaggctctaacaaagccaagggaagggccacctcactagaagccaggcctggaggaagggtgagggctgagggctggaggtaagactgcctgtggttttagacccaggctctgccactgactagctgtgtggctggccttcagacatcttcacagctctctgcacctcagtttccacatgtgaagatatgaaagtgattctgaaggtgattgcaaggttgattggaatccagctcttgagttagtgcaaagtgttattgtgagatgatataaccacgattaaaagcaagaacaggtgcagagaagcgatgattctaagaaggaggggaccgggttggaaaggatcaaaccatccaggatgccgagtctggggcaatccatctgggctgtttctggaagacccccgggtgcaggccaggacactgctgccctcccgtccttaactcccctcttcactcagtcctcactcacctccctctcacacacacaaacatctcctagaataatccccactgcctgccttcactcttacccgtctcatttgcctcccctgaacttcatcctcctggagttcacgatctcactcttcactcttttcttcccctcgaagattcagcactgcttacttacatgttaagatatttcagaacagtgaaatgttgctattttcaaaaacctacaaaggtggtatgcagaggaaaaggtacttctttgtgttcccaaagaaaacatctttccaaaatccagcctattgattttatttcttcgggggaacaagaattttagtatctctaagttgggtagcattctactcttggcagttgctggaaagaaggcactggtctaggtcctgggcttcacaggtaacacctgtcagggtgtctatgaagtcaaggctgtctgaggaacagcaaagtgggaagaagcaagctggctggctgatgaagggtttcttgggtggacaagtagttggagcgatttcctatttaccaaagagagctaaagttcataattctacagagagttccataatgaacctcaaatacctctgttttttgaaggagtttctcatatacagcactagctgactatcctgggcaggatgggagataatgaatgcagtgccaatcgggctggatttatatggtcctagtgaggctggtcaagaaccgagttagaactctcacagagtcactgcccacagaagaaatctcccaagtggctgtttcctgacattcccgggaggcaggcctccttctgagtcactccctaagcagttctgaactgtgaggtcagccaggctgtccaagtgcactccctgagccactggcagacacactcagcagccagagctagacaggcaggtggtaggagtccagggccacggcagggatggagtgtcgccccctcgctgcgataccagagcaagtaaaacgttaaggccttgcactaaagctgcccttaggatgcattcttttaaagtttttccatttaatgcagactcttttcaattcttattttatccttgtttcctttagaaagtcctttgaaaaatatctttagagggttttttcctatactatgtggccatatacgggtcaaaattaagtttaatttccaggctccaagccagcgtttcagaaaaatctcaccaaggtttgtggtaaaagaagcaaagggctgactttttggttttcttgaatctcactgttccctctgcagcagcatgcatgtctgcccacctccagacacacaggcaccatctgccgccccccatcagcccgtgtcccttccacctcgactcgcctacaaagcccagagaggtctgtttcttggcccccagagcccaaagatactgacacactcttacatttccaactagaatcaggaacgaggagtgactctcagtcagttcattaagtaaatgtctttctaaccgctctgcccatgggacatcacgccccacaggggaaaggggaagcttctgtagcctgggattctggtgcctcagtctgggtctagactttcctgaaaaaacgttaaaatatgaactgcattcctagaatttagcctacataaataagagatgaacacaaagatttctatagtttactcactgccgcttatttacagaagcaaaaatctgccacgataggggcctgacaaatgacagtaccactgtgcaatgcgtttctacgcagctctcaatcccatgttctctaataccaccgaaggcttaggaaatgcttatggtatatgtaaagagtaaagaagttacaaacagtatcaacagttgacccctattttaaaaagtatttttgaaaagtgtgacgatatttaccaaaatattaacgagcaatagttacctctggctggtgggatgagtgaatgtatttttgttgaatatatgttacctttatagtaaatatatgttatcttgatcatcagaaaaaaaaatatgtaagaacttgaaagctgcttggacagcgctgctgatagaaacccctgagcatcttgtcactgttcttctgattcagagggtctgggtggggcaggggtggtctgagattctgtatttctaagaagctcccagtgatgtccatgctgctgtccatggaccacactttgagtatcaagggaccagagcatgtcgggggagaggctggggatagctttctttatctgaactggataaaggaactgggctcaagctaagaaccctctccaggttctgcatctttgttcttcagtgaaaaatgagaggacacaccaggccaggttcagactgagacacaatccctctcctgggttcccaatgacttgtctcttgtccattcccttctctaaggctaagggccccccaggaagagccatgtggccagaccctcacagttgctggcattccaaggagattctcactccgcatcattggtccaaaaggccccttacagaagctctgcccaaggctcagatcaatggcacctgctcccagagctcctctgatctcccaggacacctttccctgatctgtgcacttatctcttgctgcctggcaaaatgtcttagctcctcacttgggccatgtgctgctctcctctcccatggggagagccacacggagagtgctggccaaagcagcagagttcaggccaaaggatgtgcactcatttattcaacaggcatgcaggatttccagggaaagctggattttaaaacctctgggaacaagagcagaacctgactgagagctcatgtgggcacttttcatagcagaatagctcatgaggtatagagacacggacgcagaacgtgggctgtagcgacagatggtcctgcattctagtccccactgtgccttttcctcatgggatgactttattcaggtaccctttcggcaaaatcctccaagagaaaggaaactgggaggttctggggagaaggctgctgcgtttgcaattgggagaggttgttgacagaggtttatgtctgtggcaagcagccttccttcagtggaatacttgaagacaggtctgtagttgagcaaactcacctccatttgtcctcctggaaagaagaaatcaagaggaaaaatctctctcccatcctccaaatggagctggcacattgctatctgtggcatttgtctttccagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttggtaagctgcactgtattcctggcaagccggccgcgtggctcctggtggacagcagcctcacttctaaacactccttaggagctgcagcacccttggtcaacccattcattcattcactcattcaataagtatttgctgaagttccacaagtgctgggtgtggttctaggtgctgaggacgtgtcactaaagacagcaggccgagtccctgttctcatggaatgttctaatgggagagttagaaaaacaaacatgtaaaatgatggccagcagtgatacgtgctacaaagaaaaacatagaaataaagaacataagagtcatgggggagggggctgacttaggagctggtgacattatctgagcagatatttgaattgagggagcaggccacatgactaactagggagaccattccagggagaaggaggaggtatgcaaaggccttaggatggaaatgaactaacttcctgtatttaaagaccagtaggaaggccagtgtggctggatcagagtgagtgaggggtagtttccaggacagcagatcacacaaggcctttagattccaccacgagtatggagggaacacctgcagagctttgggcaggacaaagactgtacaatctgatttacgtgatttaaaagggtcagtctggctactgtgtggtaaataggctgaaagggggaaagcatagaagcaagatggcctgttgggaggctaccacagtaaaccaggctagagatgatggtggcgtggacagaatgaagcaagatggcctgttgggaggctaccacagtaaaccaggctagagatgatggtggcgtggacagaatgaagcaagatggcctgttgggaggctaccacagtaaaccaggctagagatgatggtggcgtggacaaatggagcagttgaggtgaacagatttgggatatgactaaaaataaaaccagaagatttgctgacagatcggttgtagggggtaagatacaggggaggaaaagatgacctctttgttcctgcccaaacccctctggcgatggtcagtactgtttacagagagatgaaagactggcggcaaggcagggctggaggttcagcagaagatcaagagttcaattttgtacatcgtacatgtaaggtggctcttggatagccaagtgaaggtgttgagaagatggttagaaaagtctggaacttaggggagaggtcagaacttgcaatacaaaaaggagagtccttagatagatactgctgaaaatctgaatgacagaaagggagagatcaaaggactgagcctgagatcaacacatggaggtcaggagaggaggatccagccaaggggcctgaggaggagtgaccagtgaggcaggagaacatggagagtgggcggtaccccaggaagccggtgaggacactcaaggagggagggttgactgtgtcaaatgtactgaaaggacaggtcaggtgaggaccaagaaaggcccctgggtttggctgatggaggccatgggtgaggctgatgtaaatggagaggcaggaaggaaagcccagctggagtgggctcaccgaggatagggtggcgagaggagacaaagaaggaacagtgagggcagacaactctttgaagatgtttagctataaggctgcagagaaactgagcccacagctgcagggtggttatggagtgagggaagctcttttaaggttgggggtatacccagcatgttaatgcacctgggggaatggtccagtggagcaggaagaactgaagagagcagaaagaggaagaatcattagggggcagaagtccttgtagcccagagtggatgttatctaatatcgagtggaggaattaattggctttagaggagaacaaggacatgtatcccctctctgggcctatcaccttgtagacaatgggataggtcatgggataggaacttggcacaacacatgttctctcttttaattctctccattatcttatgaagcaggcaagtaggcaaacaattgtcccaactttacaaaagaaactgaagcttttataaattaagtagtacatcctaagcaatacaattaataaatggtagagctgagattcaaactgaagcagtggcctgggggtagcatctggaatccttcccacctttagggctgctgtgctgcggtgctgctgtttaatggcacagagggccagatgactgaatctctctcagcagtccaggcagtcatgcagaaggcccagtagagcaccgggcaggtctgagccagcatcttcaagttccaccctgtgagcaagcacttagctgtgacacacttctcgagagactggactcccccccgcgcaacccacccaaaagcagataggtaatggtatacagtaaccatttctagaagtgtaagtagtatgcacccaaaataggcaaaacctgctggcctagtgatagagacaactcccagtcaggctagactggaggccttggttttataagtgttcaggtgacaagtgccacagtaggcttgatcaagtagacaggcaggcaagacaaatgcttaccaatgcaagctaatgaaatgtttcttttgcagaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaacagcaatggcatttaatgtattggctatgtttacttgacaaatgaaattatggtttgcaacttttagggaaatcaatttagtttaccaagagactataaatgctatggagccaaaac

SEQ ID NO: 2543 - DNA, 10514 bp; single-stranded, linear
gatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctgaattcaataaaaaacaagcagggcgcgtggtggggcactgactaggagggctgatttgtaagttggtaagactgtagctctttttcctaattagctgaggatgtgtttaggttccattcaaaaagtgggcattcctggccaggcatggtggctcacacctgtaatctcagagctttgggagactgaggtaggaggatcacttgagcccaggaatttgagatgagcctaggcaacatagtgagactcttatctctatcaaaaaataaaaataaaaatgagccaggcatggtgcggtggaccacgcacctactgctaggggggctgaggtgggaggatcattgagcctgggaggttgaggctgcagtgatccctgatcaaacattgcatttcagcctgggtgacagagtgagaccctgtctcagaaaaaaaaaaaaaaagtcattcctgaaacctcagaatagacctaccttgccaagggcttccttatgggtaaggaccttatggacctgctgggacccaaactaggcctcacctgatacgacctgtccttctcaaaacactaaacttgggagaacattgtcccccagtgctggggtaggagagtctgcctgttattctgcctctatgcagagaaggagccccagatcatcttttccatgacaggacagtttccaagatgccacctgtacttggaagaagccaggttaaaatacttttcaagtaaaactttcttgatattactctatctttccccaggaggactgcattacaacaaattcggacacctgtggcctctcccttctatgcaaagcaaaaagccagcagcagccccaagctgataagattaatctaaagagcaaattatggtgtaatttcctatgctgaaactttgtagttaattttttaaaaaggtttcattttcctattggtctgatttcacaggaacattttacctgtttgtgaggcattttttctcctggaagagaggtgctgattggccccaagtgactgacaatctggtgtaacgaaaatttccaatgtaaactcattttccctcggtttcagcaattttaaatctatatatagagatatctttgtcagcattgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaaggtgagtacctatctggcaccatctctccagatgttctggtgatgctctcagtatttctaggcatgaaaacgttaacagctgctagagaagttggaactggtggttggtggcagtccagggcacacagcgaggcttctccctgccactcttttttctgagggtttgtaggaagtttcctcagttggagggagtgagagctgctcatcaaggacttctctgtccggttggaggttaactctgtctcttgctctctcatttctgcctggaccaagactctgtgcaccgagttgaccgtaacagacatctttgctgcctccaaggtaagaagccgtcccacggtctgttttagcaaatggggagatccatccccaaatgtctgaacaagaaacttgtctaatggaaaacgagcgggcccaaattaactctaaggtgttagatgttttcaaagaacgagaagtctgatctttactcttaagcatgttttggtctttctggtttcacttgatttagaagacatgtaatagaaagcttacatgctgtagtcctgactcagatcctggtcaaagaaaagccctcttgggttttacttagctttggcatagtgcctggaacgtaggaggcactcaataaatgcctgttgaatgagagaatttttctggcccatacatttctgaaaaaccaaatactctcacagaaacagatattgagatgacaggttgagggagctttcattttgtctaagagacttcctatggcaacagaaaaggtatcgccagagcccctcctcttccacagcctggccacctaacagccctctggttccggggctgccgtccagagctctcagcttgctctggccggccgaactcccctccagctcggtctggaaccatcctgctgggcagcgtccagcacatccctgcttcgggctgcctgggcacctcgcctctctgcctcctgtgctgcctcacccccacccctctatctgtagtgggagggagatagatttgacagctgatagtgcattttctctgacaaacacatgactacagccgtatcaatagttttgtgcatttcagttcctgttttcatggaaacacacggctgagaatgaaagccccaaagcctcaatttcacagtggtctcctaactacctgctttccatgcaaactagggagatgatatggccaggagtgaagccctgtgtgttgggcagggtcacactccagcacccagaccatagaacagggcccatcctgcttcatgagggaaactgctcttcgggcctttagctggactatctcatttcattagttatcccgggagtccgatacaggatgagattctgaagggcaaatacacactttttttttttttttgagatagggtcttgttctgtcacccaggctggagtgcagtggtgcgatttcagctcatagcagcctccacctcccaggctcaagctatcttcctacctcagcctcccaagtagccgggacgacaggtgtgcaccaccacgcctggctaatttttgtatttttttgtagagatggagtcttgccattttgcccaggcttgtctcgaacttctgggctcaagcaatccgtccacctcggcctctcaaagtgctgggattagccactgcacctgggcaacagtttatgtgtgtgtgtgtgtgtgtgtgtatatatgtgtgtgtgtgtatatatatgtgtgtatgtatatatgtgtatgtatatgtgtgtgtgtgtgtgtgtgtgtgtgtgtgtataaaatctccaagtccatccaaccgagatggctcctactagaagccaagagtccaccgggttgagcactgggtctctggaggcctgtcggactgctgagaaggctctaacaaagccaagggaagggccacctcactagaagccaggcctggaggaagggtgagggctgagggctggaggtaagactgcctgtggttttagacccaggctctgccactgactagctgtgtggctggccttcagacatcttcacagctctctgcacctcagtttccacatgtgaagatatgaaagtgattctgaaggtgattgcaaggttgattggaatccagctcttgagttagtgcaaagtgttattgtgagatgatataaccacgattaaaagcaagaacaggtgcagagaagcgatgattctaagaaggaggggaccgggttggaaaggatcaaaccatccaggatgccgagtctggggcaatccatctgggctgtttctggaagacccccgggtgcaggccaggacactgctgccctcccgtccttaactcccctcttcactcagtcctcactcacctccctctcacacacacaaacatctcctagaataatccccactgcctgccttcactcttacccgtctcatttgcctcccctgaacttcatcctcctggagttcacgatctcactcttcactcttttcttcccctcgaagattcagcactgcttacttacatgttaagatatttcagaacagtgaaatgttgctattttcaaaaacctacaaaggtggtatgcagaggaaaaggtacttctttgtgttcccaaagaaaacatctttccaaaatccagcctattgattttatttcttcgggggaacaagaattttagtatctctaagttgggtagcattctactcttggcagttgctggaaagaaggcactggtctaggtcctgggcttcacaggtaacacctgtcagggtgtctatgaagtcaaggctgtctgaggaacagcaaagtgggaagaagcaagctggctggctgatgaagggtttcttgggtggacaagtagttggagcgatttcctatttaccaaagagagctaaagttcataattctacagagagttccataatgaacctcaaatacctctgttttttgaaggagtttctcatatacagcactagctgactatcctgggcaggatgggagataatgaatgcagtgccaatcgggctggatttatatggtcctagtgaggctggtcaagaaccgagttagaactctcacagagtcactgcccacagaagaaatctcccaagtggctgtttcctgacattcccgggaggcaggcctccttctgagtcactccctaagcagttctgaactgtgaggtcagccaggctgtccaagtgcactccctgagccactggcagacacactcagcagccagagctagacaggcaggtggtaggagtccagggccacggcagggatggagtgtcgccccctcgctgcgataccagagcaagtaaaacgttaaggccttgcactaaagctgcccttaggatgcattcttttaaagtttttccatttaatgcagactcttttcaattcttattttatccttgtttcctttagaaagtcctttgaaaaatatctttagagggttttttcctatactatgtggccatatacgggtcaaaattaagtttaatttccaggctccaagccagcgtttcagaaaaatctcaccaaggtttgtggtaaaagaagcaaagggctgactttttggttttcttgaatctcactgttccctctgcagcagcatgcatgtctgcccacctccagacacacaggcaccatctgccgccccccatcagcccgtgtcccttccacctcgactcgcctacaaagcccagagaggtctgtttcttggcccccagagcccaaagatactgacacactcttacatttccaactagaatcaggaacgaggagtgactctcagtcagttcattaagtaaatgtctttctaaccgctctgcccatgggacatcacgccccacaggggaaaggggaagcttctgtagcctgggattctggtgcctcagtctgggtctagactttcctgaaaaaacgttaaaatatgaactgcattcctagaatttagcctacataaataagagatgaacacaaagatttctatagtttactcactgccgcttatttacagaagcaaaaatctgccacgataggggcctgacaaatgacagtaccactgtgcaatgcgtttctacgcagctctcaatcccatgttctctaataccaccgaaggcttaggaaatgcttatggtatatgtaaagagtaaagaagttacaaacagtatcaacagttgacccctattttaaaaagtatttttgaaaagtgtgacgatatttaccaaaatattaacgagcaatagttacctctggctggtgggatgagtgaatgtatttttgttgaatatatgttacctttatagtaaatatatgttatcttgatcatcagaaaaaaaaatatgtaagaacttgaaagctgcttggacagcgctgctgatagaaacccctgagcatcttgtcactgttcttctgattcagagggtctgggtggggcaggggtggtctgagattctgtatttctaagaagctcccagtgatgtccatgctgctgtccatggaccacactttgagtatcaagggaccagagcatgtcgggggagaggctggggatagctttctttatctgaactggataaaggaactgggctcaagctaagaaccctctccaggttctgcatctttgttcttcagtgaaaaatgagaggacacaccaggccaggttcagactgagacacaatccctctcctgggttcccaatgacttgtctcttgtccattcccttctctaaggctaagggccccccaggaagagccatgtggccagaccctcacagttgctggcattccaaggagattctcactccgcatcattggtccaaaaggccccttacagaagctctgcccaaggctcagatcaatggcacctgctcccagagctcctctgatctcccaggacacctttccctgatctgtgcacttatctcttgctgcctggcaaaatgtcttagctcctcacttgggccatgtgctgctctcctctcccatggggagagccacacggagagtgctggccaaagcagcagagttcaggccaaaggatgtgcactcatttattcaacaggcatgcaggatttccagggaaagctggattttaaaacctctgggaacaagagcagaacctgactgagagctcatgtgggcacttttcatagcagaatagctcatgaggtatagagacacggacgcagaacgtgggctgtagcgacagatggtcctgcattctagtccccactgtgccttttcctcatgggatgactttattcaggtaccctttcggcaaaatcctccaagagaaaggaaactgggaggttctggggagaaggctgctgcgtttgcaattgggagaggttgttgacagaggtttatgtctgtggcaagcagccttccttcagtggaatacttgaagacaggtctgtagttgagcaaactcacctccatttgtcctcctggaaagaagaaatcaagaggaaaaatctctctcccatcctccaaatggagctggcacattgctatctgtggcatttgtctttccagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttggtaagctgcactgtattcctggcaagccggccgcgtggctcctggtggacagcagcctcacttctaaacactccttaggagctgcagcacccttggtcaacccattcattcattcactcattcaataagtatttgctgaagttccacaagtgctgggtgtggttctaggtgctgaggacgtgtcactaaagacagcaggccgagtccctgttctcatggaatgttctaatgggagagttagaaaaacaaacatgtaaaatgatggccagcagtgatacgtgctacaaagaaaaacatagaaataaagaacataagagtcatgggggagggggctgacttaggagctggtgacattatctgagcagatatttgaattgagggagcaggccacatgactaactagggagaccattccagggagaaggaggaggtatgcaaaggccttaggatggaaatgaactaacttcctgtatttaaagaccagtaggaaggccagtgtggctggatcagagtgagtgaggggtagtttccaggacagcagatcacacaaggcctttagattccaccacgagtatggagggaacacctgcagagctttgggcaggacaaagactgtacaatctgatttacgtgatttaaaagggtcagtctggctactgtgtggtaaataggctgaaagggggaaagcatagaagcaagatggcctgttgggaggctaccacagtaaaccaggctagagatgatggtggcgtggacagaatgaagcaagatggcctgttgggaggctaccacagtaaaccaggctagagatgatggtggcgtggacagaatgaagcaagatggcctgttgggaggctaccacagtaaaccaggctagagatgatggtggcgtggacaaatggagcagttgaggtgaacagatttgggatatgactaaaaataaaaccagaagatttgctgacagatcggttgtagggggtaagatacaggggaggaaaagatgacctctttgttcctgcccaaacccctctggcgatggtcagtactgtttacagagagatgaaagactggcggcaaggcagggctggaggttcagcagaagatcaagagttcaattttgtacatcgtacatgtaaggtggctcttggatagccaagtgaaggtgttgagaagatggttagaaaagtctggaacttaggggagaggtcagaacttgcaatacaaaaaggagagtccttagatagatactgctgaaaatctgaatgacagaaagggagagatcaaaggactgagcctgagatcaacacatggaggtcaggagaggaggatccagccaaggggcctgaggaggagtgaccagtgaggcaggagaacatggagagtgggcggtaccccaggaagccggtgaggacactcaaggagggagggttgactgtgtcaaatgtactgaaaggacaggtcaggtgaggaccaagaaaggcccctgggtttggctgatggaggccatgggtgaggctgatgtaaatggagaggcaggaaggaaagcccagctggagtgggctcaccgaggatagggtggcgagaggagacaaagaaggaacagtgagggcagacaactctttgaagatgtttagctataaggctgcagagaaactgagcccacagctgcagggtggttatggagtgagggaagctcttttaaggttgggggtatacccagcatgttaatgcacctgggggaatggtccagtggagcaggaagaactgaagagagcagaaagaggaagaatcattagggggcagaagtccttgtagcccagagtggatgttatctaatatcgagtggaggaattaattggctttagaggagaacaaggacatgtatcccctctctgggcctatcaccttgtagacaatgggataggtcatgggataggaacttggcacaacacatgttctctcttttaattctctccattatcttatgaagcaggcaagtaggcaaacaattgtcccaactttacaaaagaaactgaagcttttataaattaagtagtacatcctaagcaatacaattaataaatggtagagctgagattcaaactgaagcagtggcctgggggtagcatctggaatccttcccacctttagggctgctgtgctgcggtgctgctgtttaatggcacagagggccagatgactgaatctctctcagcagtccaggcagtcatgcagaaggcccagtagagcaccgggcaggtctgagccagcatcttcaagttccaccctgtgagcaagcacttagctgtgacacacttctcgagagactggactcccccccgcgcaacccacccaaaagcagataggtaatggtatacagtaaccatttctagaagtgtaagtagtatgcacccaaaataggcaaaacctgctggcctagtgatagagacaactcccagtcaggctagactggaggccttggttttataagtgttcaggtgacaagtgccacagtaggcttgatcaagtagacaggcaggcaagacaaatgcttaccaatgcaagctaatgaaatgtttcttttgcagaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaacagcaatggcatttaatgtattggctatgtttacttgacaaatgaaattatggtttgcaacttttagggaaatcaatttagtttaccaagagactataaatgctatggagccaaaac

SEQ ID NO: 2544 - DNA, 3597 bp; single-stranded, linear
ggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctc

SEQ ID NO: 2545 - DNA, 3241 bp; single-stranded, linear
ggatcctaatcaagaccccagtgaacagaactcgaccctgccaaggcttggcagtttccatttcaatcactgtcttcccaccagtattttcaatttcttttaagacagattaatctagccacagtcatagtagaacatagccgatctgaaaaaaacattcccaatatttatgtattttagcataaaattctgtttagtggtctaccttatactttgttttgcacacatcttttaagaggaagttaattttctgattttaagaaatgcaaatgtggggcaatgatgtattaacccaaagattcttcgtaatagaaaatgtttttaaaggggggaaacagggatttttattattaaaagataaaagtaaatttattttttaagatataaggcattggaaacatttagtttcacgatatgccattattaggcattctctatctgattgttagaaattattcatttcctcaaagacagacaataaattgactggggacgcagtcttgtactatgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgaggtaattttctttatgattcctacagtctgtaaagtgcataggtaatcatttgtgatggttcctttactatatatagagatctgttataaataataagattctgagcacattagtacatgggtgataactacatcaccagcaaacattctgttaaaagttatgaatgctggtgtgctgtaaaaatgattgtatttcctttcctctccagactctgaggattcctgttcctgtacataaaaatgtaagttaaattatgattcagtaaaatgatggcatgaataagtaaatttcctgttttaagctgtaaatcattagttatcattggaactatttaattttctatattttgttttcatatgggtggctgtgaatgtctgtacttataaatatgaggaatgactttttatcaagtagaatcctttaaacaagtggattaggctctttggtgatgttgttagtttgcctcccaaagagcatcgtgtcagggattctttccagaaggattccacactgagtgagaggtgcgtgctagtctccgtgcagttctgactctttctcactctaacgtgtttctgaaagtattagcaactcagaattatatttttagaaccatgatcagtagacattaaaatatataacaaatgccctatattaataatttctgcatacttaaataattatgactatatgatggtgttgtatgcatttgaatatgtcctggtcatattaaaatgtaaaatatatagttttattagtctaaatagaataaaactaccagctagaactgtagaaacacattgatatgagtttaatgtataatgcattacacttccaaaacatttttttccagttacataattaagttatatcctttataaaactcctcagtaatcatataagcttcatctactttttgaaaattttatcttaatatgtggtggtttgttgcctagaaaacaaacaaaaaactctttggagaagggaactcatgtaaataccacaaaacaaagcctaactttgtggaccaaaattgttttaataattattttttaattgatgaattaaaaagtatatatatttattgtgtacaatatgatgttttgaagtatgtatacattgcagaatggacaatggaccaaatttttataccttgtcttgattatttgcattttaaaaattttcctcatttagcaccaactgtgcactgaagaaatctttcagggaataggcacactggagagtcaaactgtgcaagggggtactgtggaaagactattcaaaaacttgtccttaataaagaaatacattgacggccaaaaagtaagttacacacattcaatggaagctatatttgtctggctgtgcctatttctatggaattgacagtttcctgtaatacctattgtcatttttcttttttcacagaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcagtataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttcaatttgctgctggcctctgtcttagcaattgaagttagcacagtccattgagtacatgcccagtttggaggaagggtctgagcacatgtggctgagcatccccatttctctggagaagtctcaaggttgcaaggcacaccagaggtggaagtgatctagcaggacttagtggggatgtggggagcagggacacaggcaggaggtgaacctggttttctctctacagtatatccagaacctgggatggtgcagggtaaatggtagggaataaatgaatgaatgtgctttccaagactgattgtagaactaaaatgagttgtaaggcgtcccctggaagaagggcagtgtgggaacctgtaactaggttcctgcccagcctgtgagaagaatttggcagatcaatctcattgccagtatagagaggaagccagaaaccctctctgccaaggcctgcaggggttcttaccccacctgaccctgcaccataacaaaaggaacagagagacactggtagggcagtcccattagaaagactgagttccgtattcccgggggcagggcagcaccaggccgcacaacactccattctgcctgcttatggctatcagtagcatcactagagattcttctgtttgagaaaacttctcaaggatcc

SEQ ID NO: 2546 - DNA, 816 bp; single-stranded, linear
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcaatataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 2547 - DNA, 4057 bp; single-stranded, linear
ggatcctaatcaagaccccagtgaacagaactcgaccctgccaaggcttggcagtttccatttcaatcactgtcttcccaccagtattttcaatttcttttaagacagattaatctagccacagtcatagtagaacatagccgatctgaaaaaaacattcccaatatttatgtattttagcataaaattctgtttagtggtctaccttatactttgttttgcacacatcttttaagaggaagttaattttctgattttaagaaatgcaaatgtggggcaatgatgtattaacccaaagattcttcgtaatagaaaatgtttttaaaggggggaaacagggatttttattattaaaagataaaagtaaatttattttttaagatataaggcattggaaacatttagtttcacgatatgccattattaggcattctctatctgattgttagaaattattcatttcctcaaagacagacaataaattgactggggacgcagtcttgtactatgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgaggtaattttctttatgattcctacagtctgtaaagtgcataggtaatcatttgtgatggttcctttactatatatagagatctgttataaataataagattctgagcacattagtacatgggtgataactacatcaccagcaaacattctgttaaaagttatgaatgctggtgtgctgtaaaaatgattgtatttcctttcctctccagactctgaggattcctgttcctgtacataaaaatgtaagttaaattatgattcagtaaaatgatggcatgaataagtaaatttcctgttttaagctgtaaatcattagttatcattggaactatttaattttctatattttgttttcatatgggtggctgtgaatgtctgtacttataaatatgaggaatgactttttatcaagtagaatcctttaaacaagtggattaggctctttggtgatgttgttagtttgcctcccaaagagcatcgtgtcagggattctttccagaaggattccacactgagtgagaggtgcgtgctagtctccgtgcagttctgactctttctcactctaacgtgtttctgaaagtattagcaactcagaattatatttttagaaccatgatcagtagacattaaaatatataacaaatgccctatattaataatttctgcatacttaaataattatgactatatgatggtgttgtatgcatttgaatatgtcctggtcatattaaaatgtaaaatatatagttttattagtctaaatagaataaaactaccagctagaactgtagaaacacattgatatgagtttaatgtataatgcattacacttccaaaacatttttttccagttacataattaagttatatcctttataaaactcctcagtaatcatataagcttcatctactttttgaaaattttatcttaatatgtggtggtttgttgcctagaaaacaaacaaaaaactctttggagaagggaactcatgtaaataccacaaaacaaagcctaactttgtggaccaaaattgttttaataattattttttaattgatgaattaaaaagtatatatatttattgtgtacaatatgatgttttgaagtatgtatacattgcagaatggacaatggaccaaatttttataccttgtcttgattatttgcattttaaaaattttcctcatttagcaccaactgtgcactgaagaaatctttcagggaataggcacactggagagtcaaactgtgcaagggggtactgtggaaagactattcaaaaacttgtccttaataaagaaatacattgacggccaaaaagtaagttacacacattcaatggaagctatatttgtctggctgtgcctatttctatggaattgacagtttcctgtaatacctattgtcatttttcttttttcacagaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcagtataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttcaatttgctgctggcctctgtcttagcaattgaagttagcacagtccattgagtacatgcccagtttggaggaagggtctgagcacatgtggctgagcatccccatttctctggagaagtctcaaggttgcaaggcacaccagaggtggaagtgatctagcaggacttagtggggatgtggggagcagggacacaggcaggaggtgaacctggttttctctctacagtatatccagaacctgggatggtgcagggtaaatggtagggaataaatgaatgaatgtgctttccaagactgattgtagaactaaaatgagttgtaaggcgtcccctggaagaagggcagtgtgggaacctgtaactaggttcctgcccagcctgtgagaagaatttggcagatcaatctcattgccagtatagagaggaagccagaaaccctctctgccaaggcctgcaggggttcttaccccacctgaccctgcaccataacaaaaggaacagagagacactggtagggcagtcccattagaaagactgagttccgtattcccgggggcagggcagcaccaggccgcacaacactccattctgcctgcttatggctatcagtagcatcactagagattcttctgtttgagaaaacttctcaaggatccatgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcaatataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 2548 - DNA, 2024 bp; single-stranded, linear
tagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctggaatttaaattcaagcatgttttaacttttggtttaaggtacttgggtgtacctggcagtgttgtaagctctttacattaattaattaactctctaggtactgttatcttcattttataaacaaggcagctgaagttgagagaaataagtaacctgtcctaggtcacacaattaggaaatgacagatctggcagtctatttccaggcagtctatttccacgaggtcatgagtgcgaaagagggactaggggaagaatgattaactccagggagctgacttttctagtgtgcttacctgttttgcatctctcaaggatgtgccatgaagctgtagccaggtggaattgtaccacagccctgacatgaacacctgatggcagctgctgggttggagcctagacaaaaacatgaagaaccatggctgctgcctgagcccatcgtgctgtaattatagaaaaccttctaagggaagaatatgctgatatttttcagataagtaccccttttataaaaatcctccaagttagccctcgattttccatgtaaggaaacagaggctttgagataatgtctgtctcctaagggacaaagccaggacttgatcctgtcttaaaaatgcaaaatgtagtacttcttccatcaaaggtagacatgcactaagggacaggttttggcttggtatcagaatacatttttaaaagctgtgtaagaattgaacgggctgtactagggggtata

SEQ ID NO: 2549 - DNA, 931 bp; single-stranded, linear
gatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgaggtcctctgcattttcatatacatcttagattcggctgacaattttctacaaaaaaagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctc

SEQ ID NO: 2550 - DNA, 1327 bp; single-stranded, linear
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagatt

SEQ ID NO: 2551 - DNA, 1664 bp; single-stranded, linear
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagtgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatatttggtgtt

SEQ ID NO: 2552 - DNA, 1998 bp; single-stranded, linear
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagactttcattcacaacagacagcttttaaggctaacgtccagctgtatttacttctggctgtgccgtttggctgtttaagctgccaattgtagcactcagctaccatctgaggaagaaagcattttgcatcagcctggagtgaaccatgaacttggattcaagactgtcttttctatagcaa

SEQ ID NO: 2553 - DNA, 1405 bp; single-stranded, linear
gtcttttgaaaggatctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccac

SEQ ID NO: 2554 - DNA, 2006 bp; single-stranded, linear
cggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcagttgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaatcatgaacttggattcaagactgtcttttctatagcaagtgagagccacaaattcctcacccccctacattctagaatgatctttttctaggtagattgtgtatgtgtgtgtatgagagagagagagagagagagagagagagagagagaaattatctcaagctccagaggcctgatccaggatacatcatttgaaaccaactaatttaaaagcataatagagctaatatat

SEQ ID NO: 2555 - DNA, 11355 bp; single-stranded, linear
tagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctggaatttaaattcaagcatgttttaacttttggtttaaggtacttgggtgtacctggcagtgttgtaagctctttacattaattaattaactctctaggtactgttatcttcattttataaacaaggcagctgaagttgagagaaataagtaacctgtcctaggtcacacaattaggaaatgacagatctggcagtctatttccaggcagtctatttccacgaggtcatgagtgcgaaagagggactaggggaagaatgattaactccagggagctgacttttctagtgtgcttacctgttttgcatctctcaaggatgtgccatgaagctgtagccaggtggaattgtaccacagccctgacatgaacacctgatggcagctgctgggttggagcctagacaaaaacatgaagaaccatggctgctgcctgagcccatcgtgctgtaattatagaaaaccttctaagggaagaatatgctgatatttttcagataagtaccccttttataaaaatcctccaagttagccctcgattttccatgtaaggaaacagaggctttgagataatgtctgtctcctaagggacaaagccaggacttgatcctgtcttaaaaatgcaaaatgtagtacttcttccatcaaaggtagacatgcactaagggacaggttttggcttggtatcagaatacatttttaaaagctgtgtaagaattgaacgggctgtactagggggtatagatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgaggtcctctgcattttcatatacatcttagattcggctgacaattttctacaaaaaaagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagattccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagtgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatatttggtgttccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagactttcattcacaacagacagcttttaaggctaacgtccagctgtatttacttctggctgtgccgtttggctgtttaagctgccaattgtagcactcagctaccatctgaggaagaaagcattttgcatcagcctggagtgaaccatgaacttggattcaagactgtcttttctatagcaagtcttttgaaaggatctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaccggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcagttgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaatcatgaacttggattcaagactgtcttttctatagcaagtgagagccacaaattcctcacccccctacattctagaatgatctttttctaggtagattgtgtatgtgtgtgtatgagagagagagagagagagagagagagagagagagaaattatctcaagctccagaggcctgatccaggatacatcatttgaaaccaactaatttaaaagcataatagagctaatatat

SEQ ID NO: 2556 - DNA, 5191 bp; single-stranded, linear
gaattcagtaacccaggcattattttatcctcaagtcttaggttggttggagaaagataacaaaaagaaacatgattgtgcagaaacagacaaacctttttggaaagcatttgaaaatggcattccccctccacagtgtgttcacagtgtgggcaaattcactgctctgtcgtactttctgaaaatgaagaactgttacaccaaggtgaattatttataaattatgtacttgcccagaagcgaacagacttttactatcataagaacccttccttggtgtgctctttatctacagaatccaagacctttcaagaaaggtcttggattcttttcttcaggacactaggacataaagccacctttttatgatttgttgaaatttctcactccatcccttttgctgatgatcatgggtcctcagaggtcagacttggtgtccttggataaagagcatgaagcaacagtggctgaaccagagttggaacccagatgctctttccactaagcatacaactttccattagataacacctccctcccaccccaaccaagcagctccagtgcaccactttctggagcataaacataccttaactttacaacttgagtggccttgaatactgttcctatctggaatgtgctgttctctttcatcttcctctattgaagccctcctattcctcaatgccttgctccaactgcctttggaagattctgctcttatgcctccactggaattaatgtcttagtaccacttgtctattctgctatatagtcagtccttacattgctttcttcttctgatagaccaaactctttaaggacaagtacctagtcttatctatttctagatcccccacattactcagaaagttactccataaatgtttgtggaactgatttctatgtgaagacatgtgccccttcactctgttaactagcattagaaaaacaaatcttttgaaaagttgtagtatgcccctaagagcagtaacagttcctagaaactctctaaaatgcttagaaaaagatttattttaaattacctccccaataaaatgattggctggcttatcttcaccatcatgatagcatctgtaattaactgaaaaaaaataattatgccattaaaagaaaatcatccatgatcttgttctaacacctgccactctagtactatatctgtcacatggtctatgataaagttatctagaaataaaaaagcatacaattgataattcaccaaattgtggagcttcagtattttaaatgtatattaaaattaaattattttaaagatcaaagaaaactttcgtcatactccgtatttgataaggaacaaataggaagtgtgatgactcaggtttgccctgaggggatgggccatcagttgcaaatcgtggaatttcctctgacataatgaaaagatgagggtgcataagttctctagtagggtgatgatataaaaagccaccggagcactccataaggcacaaactttcagagacagcagagcacacaagcttctaggacaagagccaggaagaaaccaccggaaggaaccattctcactgtgtgtaaacatgacttccaagctggccgtggctctcttggcagccttcctgatttctgcagctctgtgtgaaggtaagcacatctttctgacctacagcgttttcctatgtctaaatgtgatccttagatagcaaagctattcttgatgctttggtaacaaacatcctttttattcagaaacagaatataatcttagcagtcaattaatgttaaattgaagatttagaaaaaactatatataacacttaggaaatataaaggtttgatcaatatagatattctgcttttataatttataccaggtagcatgcatatatttaacgtaaataagtaatttatagtatgtcctattgagaaccacggttacctatattatgtattaatattgagttgagcaaggtaactcagacaattccactccttgtagtatttcattgacaagcctcagatttgtcattaattcctgtctggtttaaagataccctgattatagaccaggcatgtataacttatttatatatttctgttaattctttctgaaggcaatttctatgctggagagtcttagcttgcctactataaataacactgtggtatcacagaggattatgcaatattgaccagataaaaataccatgaagatgttgatattgtacaaaaagaactctaactcttatataggaagttgttcaatgttgtcagttatgactgttttttaaaacaaagaactaactgaggtcaagggctaggagatattcaggaatgagttcactagaaacatgatgccttccatagtctccaaataatcatattggaattagaaggaagtagctggcagagctgtgcctgttgataaaatcaatccttaatcactttttcccccaacaggtgcagttttgccaaggagtgctaaagaacttagatgtcagtgcataaagacatactccaaacctttccaccccaaatttatcaaagaactgagagtgattgagagtggaccacactgcgccaacacagaaattatgtaagtactttaaaaaagattagatattttgttttagcaaacttaaaattaaggaaggtggaaatatttaggaaagttccaggtgttaggattacagtagtaaatgaaacaaaacaaaataaaaatatttgtctacatgacatttaaatatggtagcttccacaactactataaatgttattttggacttagactttatgcctgacttaaggaatcatgatttgaatgcaaaaactaaatattaatctgaaccatttctttcttatttcagtgtaaagctttctgatggaagagagctctgtctggaccccaaggaaaactgggtgcagagggttgtggagaagtttttgaagaggtaagttatatattttttaatttaaatttttcatttatcctgagacatataatccaaagtcagcctataaatttctttctgttgctaaaaatcgtcattaggtatctgcctttttggttaaaaaaaaaggaatagcatcaatagtgagtttgttgtacttatgaccagaaagaccatacatagtttgcccaggaaattctgggtttaagcttgtgtcctatactcttagtaaagttctttgtcactcccagtagtgtcctattttagatgataatttctttgatctccctatttatagttgagaatatagagcatttctaacacatgaatgtcaaagactatattgacttttcaagaaccctactttccttcttattaaacatagctcatctttatatttttaattttattttagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagatatacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttagtgtttttatgtgctctccaaattttttttactgtttctgattgtatggaaatataaaagtaaatatgaaacatttaaaatataatttgttgtcaaagtaatcaagtgtttgtcttttttttagttttagcttattgggattctctttgtttatatttaaaattatactttgatttagaaaacataaatgcttccccttagcattttgttatggaaaattacaaacttttatttttagaaaacagaactcctttccagaaataggttacaaacagtagtgtcctccacagaatgttggaaatgttttcaactccccactgtatactatcttgctaataagtctgtcttcagatttcgattaaccggtttgtatgtctgtgcactttagcatagctggacattaaagaggaaagagagtacatattataagttgcttatcagtaactgaggagtaaaactgataaatgtgaggcaaagaagtttaaaatatggttaaagcctaagcatatttgcaaacaaatcaaacaatactctgagaagtaaaaacataattatttaattaacaaatttcagtggataaattttataacaaattagacacagttgaaaataaaattagaaaactagaaaatagaacaaaagaaacttctggaattca

SEQ ID NO: 2557 - DNA, 2007 bp; single-stranded, linear
tattcatcaagtgccctctagctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgct

SEQ ID NO: 2558 - DNA, 1750 bp; single-stranded, linear
cctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctttgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagcagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggatgaaaccctgtctctactaaaaatacaaaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggt

SEQ ID NO: 2559 - DNA, 1807 bp; single-stranded, linear
ggatccaagtaggattgagtgtcctgtagttattatccacagggaacattctacaaagttttgggagactgtaatgtcatgggaaatgcaagaatatgtgtccagcatggaagggaatcagtatggaagtcttttgataaattgtggcatttatcactaacattgcctcaaaactttagactacctgccatatacaaattagaggtgaaaattacttccatgtaatatacaagccaacacaaagaatcctatcccagtttcttggatggataggcaagaatctgggtaaggtttattgtgcaataatcctcttctctcttctataggccaggatttaagtttacctcaaaaatggaaaattttggctgggaaaattacatgtgggaagacatcttcagtggagattttagtaattacagtttcagctatgaccctaccccttttctactagattctgccccatgttggccagaatccctagaaatcaattatgttttgatcatcatctatgccctgatgtttctactgaacgtgatgtgaaactccctgccgatgctggtcatcttattcagctgagtcagccactgtcaccgatgtctacctgctgaccctggccttggccgacctgttcttttccctgacattgcccatcttggctgcctccaagatgaatggctggatttttggcacaatctgtgccaggtggtctagctcctgaaggaagtcaacttctacggtggtattctactactggcctgccgcagcatggactgttacctggccattgtccatgccacacgcacactgacccagcagcgccacttggtcaagttcatatgtctgggtttgtggaacctgttcctgttactgtccctacgcatcttgcttttccgaaggaccttctacccatccaatgttagcccagtctgctatgaggacatgggcaacaatacagcaaactggtggatgctgttacggatcctgccccagtcctttggcttcatcgtgccgctgcgatcatgctgttctgctacagattcaccctgcatacgctgtttaaggcccatatggggcagaagcactggaccatgtgggtcatctttgctgttgtcctcattttcctgctctgctggctgccctacaacctggtcctgctggcagacaccctcatgggaacccagatgaccaatgagacctgtgagcgccgcaacgacatcaaccaggccctggatgccactgagattctgggcatccttcacagctacctcaatcccctcatctacgccttcattggccagaagttttgccatggacttctcaagattatagccatacacggcttgatcagcaaggactccctgcccaaagacagcaggccttcctttgttggctcttcttcagggcacacttccactactctctaagacctcttgcctaagtgcagtcccgtggggttcctcccttctcttcacagtcacattccaagcctcatgtccactagctcttcttggtctcagtgtcagtgcagcccccactgtggtcgcaggaagcagaggaggccacgttcttactagtttcccttgcatgatttagaaagcctgccctggtacctcaccccttgccataattactacatcacttgctggagctctgtccctcctgcccttgagctcatggcactctatgttctaagaagtgaaaatctacactccagtgagacagctctgcatactcattaggatggttaatgtcagaagaaagaaaatcataaaatagaaggtgtccacaaaggtgcagatgataagtg

SEQ ID NO: 2560 - DNA, 1510 bp; single-stranded, linear
gtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctttgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagcccgtggggttcctcccttctcttcacagtcacattccaagcctcatgtccactggttcttcttggtctcagtgtcaatgcagcccccattgtggtcacaggaagcagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggatgaaaccctgtctctactaaaaatacaaaaaaaaaaaaaaaaaa

SEQ ID NO: 2561 - DNA, 2245 bp; single-stranded, linear
gggagaaacatagggaatagaaaataagtaagaaggggacacctgggaacaggtttgccttcttgcattttgcttaatgctggcccttccctgaatgtctaagaccaacctggtccccacatccaaatgcacagacacagctgaggatggagaaggctaaagagggacagaggtagagacataggctgagaggaggcagttgtaggttgagctagggctaaggtgttttccccatattccatcttaccccacactcaggccaggccttagagttgtggaaggtggagaacactgggaagccaacctccgaagaagaccaggttggagtcaaaggaggaaggagagctctcattgccaaaccaacagggaagccaaggatatcccagtaactgctctcacatcattgatgagaatgccttgaatccgagctactaaatcacatttccttccttctaaccttccagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagt

SEQ ID NO: 2562 - DNA, 9319 bp; single-stranded, linear
tattcatcaagtgccctctagctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgctcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctttgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagcagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggatgaaaccctgtctctactaaaaatacaaaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtggatccaagtaggattgagtgtcctgtagttattatccacagggaacattctacaaagttttgggagactgtaatgtcatgggaaatgcaagaatatgtgtccagcatggaagggaatcagtatggaagtcttttgataaattgtggcatttatcactaacattgcctcaaaactttagactacctgccatatacaaattagaggtgaaaattacttccatgtaatatacaagccaacacaaagaatcctatcccagtttcttggatggataggcaagaatctgggtaaggtttattgtgcaataatcctcttctctcttctataggccaggatttaagtttacctcaaaaatggaaaattttggctgggaaaattacatgtgggaagacatcttcagtggagattttagtaattacagtttcagctatgaccctaccccttttctactagattctgccccatgttggccagaatccctagaaatcaattatgttttgatcatcatctatgccctgatgtttctactgaacgtgatgtgaaactccctgccgatgctggtcatcttattcagctgagtcagccactgtcaccgatgtctacctgctgaccctggccttggccgacctgttcttttccctgacattgcccatcttggctgcctccaagatgaatggctggatttttggcacaatctgtgccaggtggtctagctcctgaaggaagtcaacttctacggtggtattctactactggcctgccgcagcatggactgttacctggccattgtccatgccacacgcacactgacccagcagcgccacttggtcaagttcatatgtctgggtttgtggaacctgttcctgttactgtccctacgcatcttgcttttccgaaggaccttctacccatccaatgttagcccagtctgctatgaggacatgggcaacaatacagcaaactggtggatgctgttacggatcctgccccagtcctttggcttcatcgtgccgctgcgatcatgctgttctgctacagattcaccctgcatacgctgtttaaggcccatatggggcagaagcactggaccatgtgggtcatctttgctgttgtcctcattttcctgctctgctggctgccctacaacctggtcctgctggcagacaccctcatgggaacccagatgaccaatgagacctgtgagcgccgcaacgacatcaaccaggccctggatgccactgagattctgggcatccttcacagctacctcaatcccctcatctacgccttcattggccagaagttttgccatggacttctcaagattatagccatacacggcttgatcagcaaggactccctgcccaaagacagcaggccttcctttgttggctcttcttcagggcacacttccactactctctaagacctcttgcctaagtgcagtcccgtggggttcctcccttctcttcacagtcacattccaagcctcatgtccactagctcttcttggtctcagtgtcagtgcagcccccactgtggtcgcaggaagcagaggaggccacgttcttactagtttcccttgcatgatttagaaagcctgccctggtacctcaccccttgccataattactacatcacttgctggagctctgtccctcctgcccttgagctcatggcactctatgttctaagaagtgaaaatctacactccagtgagacagctctgcatactcattaggatggttaatgtcagaagaaagaaaatcataaaatagaaggtgtccacaaaggtgcagatgataagtggtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctttgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagcccgtggggttcctcccttctcttcacagtcacattccaagcctcatgtccactggttcttcttggtctcagtgtcaatgcagcccccattgtggtcacaggaagcagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacgggatgaaaccctgtctctactaaaaatacaaaaaaaaaaaaaaaaaagggagaaacatagggaatagaaaataagtaagaaggggacacctgggaacaggtttgccttcttgcattttgcttaatgctggcccttccctgaatgtctaagaccaacctggtccccacatccaaatgcacagacacagctgaggatggagaaggctaaagagggacagaggtagagacataggctgagaggaggcagttgtaggttgagctagggctaaggtgttttccccatattccatcttaccccacactcaggccaggccttagagttgtggaaggtggagaacactgggaagccaacctccgaagaagaccaggttggagtcaaaggaggaaggagagctctcattgccaaaccaacagggaagccaaggatatcccagtaactgctctcacatcattgatgagaatgccttgaatccgagctactaaatcacatttccttccttctaaccttccagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagt

SEQ ID NO: 2563 - DNA, 591 bp; single-stranded, linear
ccgctgtcaagatgcttctggccatggtccttacctctgccctgctcctgtgctccgtggcaggccaggggtgtccaaccttggcggggatcctggacatcaacttcctcatcaacaagatgcaggaagatccagcttccaagtgccactgcagtgctaatgtgaccagttgtctctgtttgggcattccctctgacaactgcaccagaccatgcttcagtgagagactgtctcagatgaccaataccaccatgcaaacaagatacccactgattttcagtcgggtgaaaaaatcagttgaagtactaaagaacaacaagtgtccatatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaat

SEQ ID NO: 2564 - DNA, 2810 bp; single-stranded, linear
atatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagacccaagtgatcatgggctgaaggctatgtccacagatccaaggcgggataggctgtactgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgcgagtaagggtgtatgcatctgccctgactgcctggccctgtggtcaaggatgggggaaggcagctctgcctgcagctccaccccatttataaagcactgtggtgccttctgctgggacatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttgccctgtctagaaacgaggcctgctgagcttggaaccatcccactccctgctctcaagccgtctgctcctgggttagcctgtggctgacctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggggttgtgcgggttccttaagggctgtagtctgtgtgcgtgtctggttttttcctcctccttatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtggctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgc

SEQ ID NO: 2565 - DNA, 17073 bp; single-stranded, linear
ggatccatgcccagaattattcacgaaattcacttaaaatagcatatatgcttgaacccaggagtctgaggctgcagcgagctatgatcatgtcactgcactccagcccagcctgggcgacagagcaagactctgtgtctaaagaaatgaaaataaaaataaataaaatagcatatacaggcaacaatccaaatgttcattgcagaaattatgattattattgtttttcttttagaggcagggtgtcactctgttgcccagactaatcttgacctcctgtgatcctcaagagatcctccggtctctgcttcccaaagttcttggattacaggtgtgaggcactgggcctagacattgcagggattattaaaccatggtgcatactaccattaaaggtatgaggtaggttttatatgctgacctagaaagatggtgcaacaccataggggaacaagaaggctgcaaagtggcagcacagcaggagtctttaagaaataggtatttgtttcagcttaagaagtgtctggctgggcgtggtggctcacacctgtaatcccagcacttagggaggcttaggtgggcggatcacttgaggttaggagttcaagaccagcccagtcaacaccggtgaaaccccatctctactaaaaatacaaagaaattagctgggcttggtggcaggtggctgtaatcccagctactcaggagctgaggcaggagaatcatctgaacccgggaggccgaggttgcagtgagcctagatcgcaccactgcactccagcctgggtgacagagtaagactcggtcaaaaaaaaaaaaaaaaaagaccgggtgcgaggtctctcgcctgtaatcccagcactttgggaggcctaggcaggaggatcacaaggtcaggagatcgagaccatcctggccaacatggtgaaaccccatctctactaaaatacaaaaattagccgggtgtgatggcacacgcctgtagtcccagctactcaggaggctgaggcaggggaatcgcttgaaaccaggaggtggaggctgcagtgagccgagatcacgccactgcactccagcctggcgacagagcaagactccatctcaaaaaagaaaagaaaacaaacaaacaaacaaaatccccaaaaagcaaaagtgtctgcatggacttgtgcctaactactcacagtggctacttcttgggggaggtgaaaggggaccctgttaaagaatttttcttctgtattgtttttcttcaactgagtctgcattaattttatatttaatactctccccacccctgatgctcacaggttgctttagctggtggaaggagaacctgcacctctggttttggcaaagtgtagaaggggacaagggcactgctctgcacctgcacaggttcttgcctcctggggtcagtttaatgaatctcagtggtgtttcttgggaagaacacagtggacactcacttgccagtcagtagacaaatcactgaagtccatgtctggcagttctcaatgtcatggggactgtaaggttgtcatgtctcacagttccctgacttagaagattagtggtgacagacacttctcagctctgctcgggagagcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctctcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactggagccctgcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctgctcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctccctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgacatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgacactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgtgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaagttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggggttgtgcgggttccttaagggctgtagtctgtgtgcgtgtctggttttttcctcctccttatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtgtcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaaggtggaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttgcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggaggtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcatgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcgtagttttcaagatttttgtccaaaaatataatttgaaccatgaaccgggcatctggctcttggcagagtctccctctttccccaaggtggtagatgtgactgtcaggagcctgggcagctgacgacaaggctgagcaggtcagattgtgactgtcccctggactgtcatcctgttgcgggcaccagctgttccctagagaactaggacacctgccacgggttatttagactgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtatgtgtttaagtctgtgtgtgtttgtgtgtgtgtgtctctgtgtgtgtgtctgtatctgtgtgtgtttgtgtctgtgtgtgtttgtgtgtgtgtctgtgtgtgtctgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgttcccaaagtgttgatggctgggagaaggggccagaggaggagtgaggggtggggtttgtccagccctgggctttccgggctctagagatagcatggtgtaggctcaatgacagttctggggacagcaagttggaggttcaggggcagcttcaggacagcaggatggaggctcagggacaattcctgggaggccagtgccctcgttcctccttgtcctcatcctcccccttgctccaggaaactgagagctgagcctggagcttccagacagtcagtgctgggggtgaccatccagcagtgatggtggcctgtgaagggtcctgcttctgtcctcagcctctcatggggtgggcttgtggaggagctgtggtctggagagagtggcagttggagcagaacgtgcctgcgtttgtttcctagggctgtcgtaacaaagtgccacaaaatggttagcttagaaccacagagatttgttgtctcacaattctgaagtccagaagttggaaataaagatgttggcagtgttcccaaccacatgttcttgggctcccatgaaacagaagttgatattaggccaaggaagcttcccagacaagactttattaagtcttatgccccgaaagtttgggcagaagagagacggtgcaggaggaagaattcttggctgactccccaaggggaatgcattgtggtgtcttaaggagggtgacatacataatttatgagctacatgagtgtcattgcacatatggggtggagcgaagggtgctcagacgcatgctaacacatacgttgcatgatcagaaaatggcagataagcccctccctgggtgaggactttagtattatcataagaccagggtcattctcctggccttgtgcacaagcaggtgatggagtcaactcccgtcagtaagacttatggcgggatgctgcttatcttagtttatttcagacagttggcaaggtctggccagcgagtatggcacctggagggtggtgctgcaaggtctagtggtcagcgggcacgtatggaacaatacgttagtgggggtgggccgagtcccatttatactctctcagcagggccatgctccctctgaaggcactagggaaggattagtttcaggcctctcttcagcttctgttagtttcttggcttgtgacaccaaagctgtaatctttcttttgttttgtttttgtgacggagttttgctcttgttgcccaggctggagtgcaatggcacaatctcggctcactgcaacctcctcctcccaggtttaagcaattcttctgcctcagcctttggagtagctgtgattacaaggcacctgctaccacgcctggctagtttttgtatttttagtagagacggtgtttcgctatgttggccaggctggtctcaaactcctgatatcaagtgatccgtctgtctctgcctcccaaagtgttgggattacaggcatgagccaccgtgcctggccaaagttccagtctttacagggatttttccttgtgtgcatttctgtgtccaaatttcccctttttaaaatcacaataatagtgaattaaggctggccctaacgatttaatcttaacttgatcatctgcaaagacactatttccatataaggtcacattcacagctactggggttaggacttcaacctagagggcctgacttctggcccaacacatcatggcccatcccagcatgccccatccccttcctgggtgccccaggcagatcacaggagggcctgactgctgggctttgggctgacattgggatcatctgcctagttagggctgtgaccagactgagataggaggtgggacctgactcctgaggcagggcttgaactctggaccagattacagactagctgaaacaggcaaaagcacccctccataagacacacccactggtgccaagtgagtttgccgttctcatggtaacagctggaaattactgcccctttccatggcaatgacctgaaagttaccaccccttttctagaaatttctaaataacctcctccttaatttgtatatagttacaagtgggtataaatatgtgtgcagaactgcctctgagctgctactctgggctgactgcctatggggcatccctgctccataaggagcagtacctctgctgccactgtgcacagctgcttaaataaaagttgctctctaataccaccgactcgcccttgaattctttcctgggtgaagc

SEQ ID NO: 2566 - DNA, 19883 bp; single-stranded, linear
atatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagacccaagtgatcatgggctgaaggctatgtccacagatccaaggcgggataggctgtactgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgcgagtaagggtgtatgcatctgccctgactgcctggccctgtggtcaaggatgggggaaggcagctctgcctgcagctccaccccatttataaagcactgtggtgccttctgctgggacatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaacttcccctcagatggccatacccccttgtcgctgtacccaactctccggtcctactttgtagctctcaggtgtcacatgtggatcctgccctaccatcccccttgccctgtctagaaacgaggcctgctgagcttggaaccatcccactccctgctctcaagccgtctgctcctgggttagcctgtggctgacctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggggttgtgcgggttccttaagggctgtagtctgtgtgcgtgtctggttttttcctcctccttatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgcccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtggctcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcggatccatgcccagaattattcacgaaattcacttaaaatagcatatatgcttgaacccaggagtctgaggctgcagcgagctatgatcatgtcactgcactccagcccagcctgggcgacagagcaagactctgtgtctaaagaaatgaaaataaaaataaataaaatagcatatacaggcaacaatccaaatgttcattgcagaaattatgattattattgtttttcttttagaggcagggtgtcactctgttgcccagactaatcttgacctcctgtgatcctcaagagatcctccggtctctgcttcccaaagttcttggattacaggtgtgaggcactgggcctagacattgcagggattattaaaccatggtgcatactaccattaaaggtatgaggtaggttttatatgctgacctagaaagatggtgcaacaccataggggaacaagaaggctgcaaagtggcagcacagcaggagtctttaagaaataggtatttgtttcagcttaagaagtgtctggctgggcgtggtggctcacacctgtaatcccagcacttagggaggcttaggtgggcggatcacttgaggttaggagttcaagaccagcccagtcaacaccggtgaaaccccatctctactaaaaatacaaagaaattagctgggcttggtggcaggtggctgtaatcccagctactcaggagctgaggcaggagaatcatctgaacccgggaggccgaggttgcagtgagcctagatcgcaccactgcactccagcctgggtgacagagtaagactcggtcaaaaaaaaaaaaaaaaaagaccgggtgcgaggtctctcgcctgtaatcccagcactttgggaggcctaggcaggaggatcacaaggtcaggagatcgagaccatcctggccaacatggtgaaaccccatctctactaaaatacaaaaattagccgggtgtgatggcacacgcctgtagtcccagctactcaggaggctgaggcaggggaatcgcttgaaaccaggaggtggaggctgcagtgagccgagatcacgccactgcactccagcctggcgacagagcaagactccatctcaaaaaagaaaagaaaacaaacaaacaaacaaaatccccaaaaagcaaaagtgtctgcatggacttgtgcctaactactcacagtggctacttcttgggggaggtgaaaggggaccctgttaaagaatttttcttctgtattgtttttcttcaactgagtctgcattaattttatatttaatactctccccacccctgatgctcacaggttgctttagctggtggaaggagaacctgcacctctggttttggcaaagtgtagaaggggacaagggcactgctctgcacctgcacaggttcttgcctcctggggtcagtttaatgaatctcagtggtgtttcttgggaagaacacagtggacactcacttgccagtcagtagacaaatcactgaagtccatgtctggcagttctcaatgtcatggggactgtaaggttgtcatgtctcacagttccctgacttagaagattagtggtgacagacacttctcagctctgctcgggagagcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctggtgtcctggccttgtgtatctcttagagatggcaaaatttgcagccctgacctcaaggattacaaactaatttccagtcctgtaggggtcatgggttctgctgtggccagtgtggcactgagtttgtcaggcagaatttctaattatggaaggaactctgcttcctcagtgattgaactgacctttgtgggggtgcctttgtggggtgagaatgggcatacttgggcctcagttgtgatggccatggggtggagctgaggtctaggcccagggctgggaaagcttctaccaaccccgaggcatttgggtgttttagggcagaagaggagccaggaggatgggtatgccccactggagctgtgtgtggggcagcaggtgagggtgggattccagagggagggtcaacccagccaagcagaggaaggggaggagagggtttgttttggaaagaacatcaccctctcagtttcctggggtctggatagcctgttcttgtgatgagctggaggatgtgggccctgcttggatcctcctctcccctccctgcccccattttctcttcctgtgatttatgctgttctgggctcaccctcttcccagagctctcacgctacagctgacaggcagggcaggcgttttaattattattaatttttttttgagacagagtttgagacagtatcaagagtgggtatcctctcagcgtgtcttcaagtagcatcccagagccccgctcctgggtacccacaacatgaacaccgtccagaagcaagggcagcctctgcaggtggggcgggggttggaaaacatttatcaaacggttgagttgggtgcaggggatgcaacatgatcaaacagggtcttgcctccaggagcctcatgtagggacaacgcacagtgatgaccttcaactgcagtggggcagcaaggctgtgggaggggtgttttgggcagagcaggcgacgtgggtacctcttcaccaagacagcaggaagagcacggacatcattttcccgtctcacctccagactcccaggggactgtgccaatatcctcactggagccctgcccatggccactgctcaacccttgggccctgtcagttcagggctgtgcagaaggagagttgcctgtgctcaggctcaggggttccgtccagctaaggaggcctactaggggactggggaaaggcctcatgaaggaccaggcctgtgatggggagggaagatggcagaggggacagtgggaagcagagcagcaggggtctcctccacgcctctctgtacttctcccacccacccttgcctgctcccctctgccctgggtatgtgcccttgtccacccaacacctctgcagtgccaagtccagccctgacttcttcctgagctgtggcccagcgttcccacaggcatttacctcacggatgcagcactgcccctcatcctcttctctgaaagtgtgtgggaaatgcttcttggtgccatctctctcccaccctgccttccctgcaccttctctatgaggtgtctgttgtctctgtacttgcctccagctggcctttcagaccccatccctccctgcctcctgcccatccctacccctgtcagcaccttacatactctgtgcccaacagcattggggattcccactgtgctgaaggaagtcctcatgtggtccagagagggagctggcccctgctcccatttccagcaccattttctggcacaggctccatgtccccaggctccagctgcttctggggtaccaaggtctgcatttcttcctcttcccccagcagacagaagaccttgctggacaggtgtccacttcaatagtaacttctgaggctgccagcctcctgaatggtccagaagaaccagacccttccccgcccccattaaaaaagacaaaatatggccaggcatgttggctcatgcctgacatcccagcactttgggaggccaaagcaggtgaatcacttgaggccaggagtacgagaccagcctgacaaacatggtgaaaccctgtgtctactaaaaatacaaaaattagccaggcgtggtgactcatgcttgtaaatgcttgtaatcccagctacttgggaggctgaagcaggaggatcacttgaactcgggaggcagaggttgcagtgagccgagatcacgccactgtgttccagcctgagcgacagagcgacactccgtctaaaaaaaaaaaatatatatatatatacacacatatatatatgcataatagtctctgtgtaacagtaagtggatgcagtaactggtgtgagggcaacttggagagtgtgcttggaggcacagagatgctcagggctgcctggactgcctccatgatggtggcctgctctgtattaggtgagtgttcaggaaaggtgagggcagggcagcccacagcttcacagtggcccagggaagcagggcaggcaggctatgaggcctagtaggcatctgggccagactttgacactgaggccatggaatgggtggggctctgagaacagaccaaagtgatcatgggctgaaggctatgtccacagatccaaggcgggataggctgtgctgggcagtgatgtcagccaggctccccagcgggactgggggtgtcaggggcagctctgtcccaggtggcagacactggtttcccctcctgctctcacaaccggcctgttaccaggtgttgtctgagctgtggtgaggcttccctggtgacattcaggagcagggagcctgtgagtaagggtgtatgcatctgccctgactgcctggccctgtggtcaaggatgggggaaggcagctctgcctgcagctccaccccatttataaagcactgtggtgccttctgctggggcatgtgctgagtggtgcctcgcaggcactgccctcgggaagttcacaggcttatgtggaagctggtgggaatgggccaagaagagaggtgtcaggagccaggtattgggcaggtcccaggtctctgagcctcagtttcttcatctgtaggagggtggtgaccctgccctgctcagcttaccaggtacagatgtaagttttcagtgcagaggaaaagcagagaagttcccctcagatggccatacccccttgtcgctgtacccaactctccggtcctactttgtagctctcaggtgtcacatgtggatcctgccctaccatcccccttccctgtctagaaacgaggcctgctgagcttggagccatcccactccctgctctcaagccgtctgctcctgggttagcctgtggctggcctggcctgattctacatagatgtgggtgtttctccactgctggggcagcagttgtccattctggggcctgggtcagctctcagctgtggccgttgtgcctgtgcttccccaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggtgaggcttcctgatcatcagtcttaacaggggactgtcctatgggtacctgtatacgctgccgggagtggggcagagtggggttagagtagtgcctgctgcccattggggttgtgcgggttccttaagggctgtagtctgtgtgcgtgtctggttttttcctcctccttatcagtaatcagtcttgtataaccaggctggccctgcttcctgcctaggggctatcggtgtaccatctggagttgcaaatggggtgatagggcgtcagcggccttcccacacccaagcacttcctgacacccagcccctcatctctagccaacctctggctcccctagggatcctggggctcaggcctcacgctccagcatccgggggctttgccttctggtgttgctcttctttgcaggtgccttggaacaggggtgcaacagagttcagaaagtgccatctgttgcatggataccctgctgccaccctcgtccacctttctggggcagaacagttggatgggtctttatttaagaggacaaaagggagagagaatgcatagaggctgggtctggtgtcacgcctgtaatcccaacactttgggaggccaaggcaggtggatcccttgaggtcaggaggtcaagactagcctggccaacatggtgaaaccccgtctctactaaaaatacaaaaaaaaaaaaattagctgggcatggcgggagatgcctgtaatcccagctactcgggaggctgaggcaggataatcacttgaacccaggaggcggaggttgcagtgagccaagatcacaccactgcactctagcctgggtgacagagggagactgtctcaaaaaaaaaaatttgcttagaatttgtctgtgtgaccctgggcaagtcatttcccctccttgggactcagttccttgcctgtgaacggggacagtgcttctcccttacagagctgttgtgagaattaaagtagaaaatgtacctatggtggttgttggtagtgaccagttcccccaaccctgactcccctgcaggatggggcctgggcccgggaatgggggatgggctggcagaggatgactgtcccagagaggagtcttctcggcagatgtggagacctagctgagtcagaggccaggatctaagtttgagggtgttccttacaccctgcagccatgagtctttggctgagtcaaatggcctttctgagctcagttccttatcagtaaagcctggacagtggtccaggacgctggacactgtgtgagtgttaggacacaggacactgtgtgagtgcaggtggggacccatggagcactctgctggggagcaattcatggggagcacccctccagagagggatgatttgcacagggccctcagcccagtcccttgcaggctggaccttggagagtgaggccctgaggcgagacatgggcacctggctcctggcctgcatctgcatctgcacctgtgtctgcttgggagtctctgtcacaggggaaggacaaggtgagggctgggcactaatgtctgtatgaggtgggtggagaactagggcatgtttgggggactgggttgtccgatgtcaagcctctagggaaaggtttggcccaaactgtgctggggcatgtcctctaggggtcagcctggacctcagtctctagtctccctacttttacctccctaccttcattccctggaccgactgtagtctcccttccttcactctcttgacgcctctccagatctgacttgcccgtgtaccacaggtcagagcccatcacttcccaggcctcccagtgcttccctggacagattctgggatcatttactggtgactgccctgctagggtgtcagctgtcagatcctccccaacccccgagctcagctctggcctgaagtacttaccgtgggctcctgatggtcactgtctccagggccaaggtctagaaccttcacctgcctcaccaacaacattctcaggatcgattgccactggtctgccccagagctgggacagggctccagcccctggctcctcttcaccaggtgagcatggagggccatgcccacctggacagggatgagggtgagttccccaggattgaagcagctatgccaggacagtgtagcagccccgtggtgctgacaaatgccctttccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacggtgagcagcagctataggtctggggcggggccgcttggcaagaacatcctggctgcttgggggtttggagcagggccttgcagcctgtgagtggcccagtgagtgttctcagtcccagccgagtgagatccagggctgggggcaggcttggcccttgggaggggagggcccatatggttactgcaggggcagggttttggcaggaaataaacatgcacggctgctagttggggcaggggctggcacttgagtcatgtgaaatgcacttcagtcataccaggaaggactccaataagatgctgggaaaagcttccagcagcagactgtgaaggaaagggaaagcaagatttagaaaccacctagtctaggtgcagaggccagaggaagtcattgctgtcctgtcccgcctggggcttttgtggaccagtctcccagtgaggtgcctggtctgagagggccttgaccattccccttgggagtctttcagaccccagtcttgtgtgttctgactgacacacccagacccatggggcttcagcctcacatggattcactctgttccagttaagctggacccgccctctgacttgcagagcaacatcagttctggccactgcatcctgacctggagcatcagtcctgccttggagccaatgaccacacttctcagctatgagctggccttcaagaagcaggaagaggcctgggaggtaacactttggctggctttccctgggggcctctctcctgggaacagcagtccagggtagactccccactctacatagggagatgtcaacttgtagtgatgagaagggaggaactagagcggggtgtgtgtgcacacacacatgctggcatgcagatgtgtatgctttatgtgtgtgtatgggagtagggtgagtgcgcctgtgtctctgtgtgtgcacataagtgtggtgagtgtgcatgtatgtgtttatgtgtacacatatgtaactgtgcacactcatgtttgtgtgcccatgtttgtgtgtttatatgtaagtgtacatatgtgtgtgcctgtgccttgcatttgtgtgagtgtgcacatgggcatgcctatgtgtatgagtgtgtatgtgagtgtggtgagttgcttctgtgcacacacttttgtttatgagtgtgcatgcaagtgtgatgagtgtgaaagtgttcctgtagacatgtttgcctgtgtgtgcatatgtgtatttgtgggcaaacgcagctgtgtctgtgagtgtgagtgtgccttctgtgtgtgtgtgtgcacgtgaatgtggtgagtgtgtctgtgtgttaacacaagtgtgttcaagagtgtgttatatgagcatataatgcatgtgtgtattctcgagggctgagggacccagccccaccttcaccacctgctaactgtccccacccccacagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaaggtggaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttggagcaaaggaaagtgtaaaactgtgtgacacaacctagtttatgttttgaggaatagattgctgggacaaggggacatgggggacctgctggaggccaatgggggccagtgaggtgcccacagggagacgatttgcatgagccagtgaaagaagtggagatagagaaaagtggagagaattgcagggtctcatgaggggaaatagaagggacatgtgggtggatgagatatgagtggtgacccctgaggtggggaaatgggggacagccttgcagggaggttggtgaagtctatttggacctgttgggttggagccccaggtgacatccttgtgggagggtcagtggatccttggcagcaagtctggtgctcagggagacactgggtggggtgggagccacagaccttctgctgatggcaaagacagggttcctggaggtgctggctccctctgtgatctgaggacccagctagtaactccccgttctgaacccgccatcgcagctcacgctgtaaaggacgcgcgcctcagtataaatcagttctatgcggccgttaggcaaggaggcccagttgggtcctgccctgagagtgggttggaatgtgatgagatgggagagaggcagtggcagggacgaggtgggcggacctcctgctgatggaaggaagctcagcctctgcagtgacctcaggccacctgggtcgccataggcctctgactggcctctcttggcctcagggtgaagagaatcttctaccagaacgtgccctctccagcgatgttcttccagcccctctacagtgtacacaatgggaacttccaggtgtgtgcagagaccacagaaggacatggggggcaggggttgcccagagctctggcctgcccaagatgttggctttcatgagggttggcggccagtatgggaggcttgtcagtgcttggagccttttttgtatattcagtgaatttcaatttatacgcgtatctcaaatggggaaaaattagctttattttccattgctgatttctttttgttctcaggtctctagttccattgttgattgaaaaaatgtaaatttctcataacttatctctgtcccctctggtttgcagctttctgcacccaccatgtgcctcacctcctccttctgcgaaggtgtctgtcctgtggccatggggaagggtctgtggtgtgtgtgctgcccttggggctctcactgcctctgggctcctgctctgcctggtcccctggtctccccggatcacatgatggcaccacagctgaggagtgggctctgcacttcccccccttccacccatgttgggctcctacagcccaggcaccagtgagcaacttgggggttgcatcagcccctcccctccctgctgggctgttggttcatgccccctgggtgggaggagggggagagggagagctccagtgagtggtctctggtttttcccctcagactcctcactttgggcaaaggacaagaggcagtgagggcccctccctggggtctgggccaagctgaccactcttctccagaatcttccctccctgtccccttcacactgtggctccagcttactatgcagaaaaatccttttctctctcaatgaggagcgtagttttcaagatttttgtccaaaaatataatttgaaccatgaaccgggcatctggctcttggcagagtctccctctttccccaaggtggtagatgtgactgtcaggagcctgggcagctgacgacaaggctgagcaggtcagattgtgactgtcccctggactgtcatcctgttgcgggcaccagctgttccctagagaactaggacacctgccacgggttatttagactgcgggtgaggatctggtgccataggttggtctccagggagcactgcagtgatggagggtgttgtgtgtgtgatgcatgggatggaggctcctggtcccaccaagggaacagcttccttttggaggcgggggcctcctgtggccccacagaaggatccaggtctgctggccatagccgagtgctttgaaagtcaccagtcctgacagcgattcgtgtgtgtgtctgtgtgtgtgtgtgtgtgtttatgtgtctgtgtgtgttcgtgtgtgtgtctgtgtgtgtgtttgtgtgtgtatgtctgtgtgtgtgtgtttatgtgtgtgtgtctgtatgtgtttaagtctgtgtgtgtttgtgtgtgtgtgtctctgtgtgtgtgtctgtatctgtgtgtgtttgtgtctgtgtgtgtttgtgtgtgtgtctgtgtgtgtctgtgtgtgtgtctgtgtgtgtgtttatgtgtctgtgtatgtttgtgtgtgtgtttgtgtgtgtgtgtttgtgtttatgtgtgtatgtctgtgtgtgtctgtgtgtctgtgtgtgtatgtgtctgtgtgtgtttatgtgtctgtgtgtgttcgtgtgtgtgtctgtgtgtgtgtgtttgtgtgtgtatgtctgtgtgtgtgtgtgtttatgtgtgtgtgtctgtgtgtgtttatgtctgtgtgtgtttgtgtgtgtgtgtctcgtgtgtgtgtgtctgtgtgtatctgtgtgtgtttgtgtgtgtgtgtgtctctgtgtgtgtgtgtgtttgtgtatgtttgtgtgtgtgtgtgtgtgtgttgggaatgcccagtctctgcagctgctgaaaggccctgaggcacatgctgtcaggagctggctctgtcctgggcagatatcaccatctgtacctcggttcaggctgccgtgggcaccaggccctgtgctgggggagtgctgaggagcctgaagggactcagggtcccgtgatgaggctgggctggcacatggaggaaagacagaatgtccaagacacaggcgctgcttggcctctgggtgtggacctcaggagggcttcctggaggaggagggatgctgggcttgccagaaaggaggcagctgctcccaggatgagttctgaacatgctacctgagcccttccctcctcccgtgctctgttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgttcccaaagtgttgatggctgggagaaggggccagaggaggagtgaggggtggggtttgtccagccctgggctttccgggctctagagatagcatggtgtaggctcaatgacagttctggggacagcaagttggaggttcaggggcagcttcaggacagcaggatggaggctcagggacaattcctgggaggccagtgccctcgttcctccttgtcctcatcctcccccttgctccaggaaactgagagctgagcctggagcttccagacagtcagtgctgggggtgaccatccagcagtgatggtggcctgtgaagggtcctgcttctgtcctcagcctctcatggggtgggcttgtggaggagctgtggtctggagagagtggcagttggagcagaacgtgcctgcgtttgtttcctagggctgtcgtaacaaagtgccacaaaatggttagcttagaaccacagagatttgttgtctcacaattctgaagtccagaagttggaaataaagatgttggcagtgttcccaaccacatgttcttgggctcccatgaaacagaagttgatattaggccaaggaagcttcccagacaagactttattaagtcttatgccccgaaagtttgggcagaagagagacggtgcaggaggaagaattcttggctgactccccaaggggaatgcattgtggtgtcttaaggagggtgacatacataatttatgagctacatgagtgtcattgcacatatggggtggagcgaagggtgctcagacgcatgctaacacatacgttgcatgatcagaaaatggcagataagcccctccctgggtgaggactttagtattatcataagaccagggtcattctcctggccttgtgcacaagcaggtgatggagtcaactcccgtcagtaagacttatggcgggatgctgcttatcttagtttatttcagacagttggcaaggtctggccagcgagtatggcacctggagggtggtgctgcaaggtctagtggtcagcgggcacgtatggaacaatacgttagtgggggtgggccgagtcccatttatactctctcagcagggccatgctccctctgaaggcactagggaaggattagtttcaggcctctcttcagcttctgttagtttcttggcttgtgacaccaaagctgtaatctttcttttgttttgtttttgtgacggagttttgctcttgttgcccaggctggagtgcaatggcacaatctcggctcactgcaacctcctcctcccaggtttaagcaattcttctgcctcagcctttggagtagctgtgattacaaggcacctgctaccacgcctggctagtttttgtatttttagtagagacggtgtttcgctatgttggccaggctggtctcaaactcctgatatcaagtgatccgtctgtctctgcctcccaaagtgttgggattacaggcatgagccaccgtgcctggccaaagttccagtctttacagggatttttccttgtgtgcatttctgtgtccaaatttcccctttttaaaatcacaataatagtgaattaaggctggccctaacgatttaatcttaacttgatcatctgcaaagacactatttccatataaggtcacattcacagctactggggttaggacttcaacctagagggcctgacttctggcccaacacatcatggcccatcccagcatgccccatccccttcctgggtgccccaggcagatcacaggagggcctgactgctgggctttgggctgacattgggatcatctgcctagttagggctgtgaccagactgagataggaggtgggacctgactcctgaggcagggcttgaactctggaccagattacagactagctgaaacaggcaaaagcacccctccataagacacacccactggtgccaagtgagtttgccgttctcatggtaacagctggaaattactgcccctttccatggcaatgacctgaaagttaccaccccttttctagaaatttctaaataacctcctccttaatttgtatatagttacaagtgggtataaatatgtgtgcagaactgcctctgagctgctactctgggctgactgcctatggggcatccctgctccataaggagcagtacctctgctgccactgtgcacagctgcttaaataaaagttgctctctaataccaccgactcgcccttgaattctttcctgggtgaagc

SEQ ID NO: 2567 - DNA, 2042 bp; single-stranded, linear
aattcagaactcctcagccccccaagaaaaaaatatccccgtggaaattcctttttaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcccctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgccaacgccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaacgccttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggtgagtcggggtggggattgccgtcgggccagttctccgaagcccgggaggaccggctcccgggtcaggtcatgcatgcttaggtagctgtttatgggaaggaggggctagagacagcgattgaaagcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgaggtgtgaaccacgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttggggg

SEQ ID NO: 2568 - DNA, 2986 bp; single-stranded, linear
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 2569 - DNA, 3003 bp; single-stranded, linear
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagcctcatccgcgtgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 2570 - DNA, 1846 bp; single-stranded, linear
ctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaagg

SEQ ID NO: 2571 - DNA, 1846 bp; single-stranded, linear
aattcagaactcctcagccccccaagaaaaaaatatccccgtggaaattcctttttaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcccctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgccaacgccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaacgccttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaagg

SEQ ID NO: 2572 - DNA, 4704 bp; single-stranded, linear
gaattcctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatccctctttgccttggacttcttctcccgcgattttccccacttacttaccctcacctgtcaggctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagagcctctgtgcccccatcaccctcgtttccagtgaattagtgtcatgtcagcatcagctcagggcttcatcgtggggctctcagttccgattccccaggctgaattgggagtgagatgcctgcatgctgggttctgcacagctggcctcccgcggttgggtcaacattgctggcctggaagggaggagcgccctctagggagggacatggccccggtgcggctgcagctcaccagccccaggggcagaagagacccaaccacttcctattttttgaggctatgaatatagtacctgaaaaaatgccaagcactagattatttttttaaaaagcgtactttaaatgtttgtgttaatacacattaaaacatcgcacaaaaacgatgcatctaccgctccttgggaaataatctgaaaggtctaaaaataaaaaagccttctgtggaaaaaaaaaaaaaaaaaaaaaaaaaaaaaaaaaaaaaaaaaaaaaaaaaa

SEQ ID NO: 2573 - DNA, 4654 bp; single-stranded, linear
gaattcctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatccctctttgccttggacttcttctcccgcgattttccccacttacttaccctcacctgtcaggctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagagcctctgtgcccccatcaccctcgtttccagtgaattagtgtcatgtcagcatcagctcagggcttcatcgtggggctctcagttccgattccccaggctgaattgggagtgagatgcctgcatgctgggttctgcacagctggcctcccgcggttgggtcaacattgctggcctggaagggaggagcgccctctagggagggacatggccccggtgcggctgcagctcaccagccccaggggcagaagagacccaaccacttcctattttttgaggctatgaatatagtacctgaaaaaatgccaagcactagattatttttttaaaaagcgtactttaaatgtttgtgttaatacacattaaaacatcgcacaaaaacgatgcatctaccgctccttgggaaataatctgaaaggtctaaaaataaaaaagccttctgtgg

SEQ ID NO: 2574 - DNA, 2291 bp; single-stranded, linear
ctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgcccgcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagca

SEQ ID NO: 2575 - DNA, 11649 bp; single-stranded, linear
gaattcctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatccctctttgccttggacttcttctcccgcgattttccccacttacttaccctcacctgtcaggctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagagcctctgtgcccccatcaccctcgtttccagtgaattagtgtcatgtcagcatcagctcagggcttcatcgtggggctctcagttccgattccccaggctgaattgggagtgagatgcctgcatgctgggttctgcacagctggcctcccgcggttgggtcaacattgctggcctggaagggaggagcgccctctagggagggacatggccccggtgcggctgcagctcaccagccccaggggcagaagagacccaaccacttcctattttttgaggctatgaatatagtacctgaaaaaatgccaagcactagattatttttttaaaaagcgtactttaaatgtttgtgttaatacacattaaaacatcgcacaaaaacgatgcatctaccgctccttgggaaataatctgaaaggtctaaaaataaaaaagccttctgtggaaaaaaaaaaaaaaaaaaaaaaaaaaaaaaaaaaaaaaaaaaaaaaaaaagaattcctgccactcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcacgtcaaaccccctcagcctgttggcttctgttcaccagctgcaagggtttacatacacggccaccgccatccaaaatgtcgtgcaccgattgttccatgcctcatatggggcccgtagggatgccaccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacaccgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgcactggctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatccctctttgccttggacttcttctcccgcgattttccccacttacttaccctcacctgtcaggctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaaggacttgacttgcaatttctacctagaaatacatggacaatacccccaggcctcagtctcccttctcccatgaggcacgaatgatctttctttcctttccttttttttttttttcttttctttttttttttttttgagacggagtctcgctctgtcacccaggctggagtgcaatggcgtgatctcggctcgctgcaacctccgcctcccgggttcaagtaattctgctgtctcagcctcctgcgtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagagcctctgtgcccccatcaccctcgtttccagtgaattagtgtcatgtcagcatcagctcagggcttcatcgtggggctctcagttccgattccccaggctgaattgggagtgagatgcctgcatgctgggttctgcacagctggcctcccgcggttgggtcaacattgctggcctggaagggaggagcgccctctagggagggacatggccccggtgcggctgcagctcaccagccccaggggcagaagagacccaaccacttcctattttttgaggctatgaatatagtacctgaaaaaatgccaagcactagattatttttttaaaaagcgtactttaaatgtttgtgttaatacacattaaaacatcgcacaaaaacgatgcatctaccgctccttgggaaataatctgaaaggtctaaaaataaaaaagccttctgtggctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgcccgcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagca

SEQ ID NO: 2576 - DNA, 665 bp; single-stranded, linear
tcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccga

SEQ ID NO: 2577 - DNA, 4465 bp; single-stranded, linear
gagctcacagagcccccagctggggcatatctggtttccgggggcaggggcgatacccagaggaggaagaagggattctgagagagcccaacaggctccgagcctcaggctggagctgagcttggggcagcaaggaaggaccaggtgcgagggcagaaccatgcggcccgacccctgcagcacggcctgtggcctcccccagctcctgcccgtgcttctgggtcagtctggactttgccacttctgaccaaaagccaccgcaaacccactcaagccaaaagaggaagtgaccgttaggcccaactgggaaggctggcggccaggggcactccaggcagggcgaggggggcggccgggggcgctccaggcggggcgagggagacacccagaactccaggcaggagtcctcgggtgccacctttcctctccacctggccctgcgtgggctctgtcctcagggtggcccgccgtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacgactaaggctggcaggcatgaggtttcctgaaggagaaagagcttgtggggcccagtgtggctgggggggcgctgggactccattctgaagccaaaggcactgggaagggcttccgcagaggagggtttggcaggggttgccaggaacagcctggatggggacagggaacagataaggtgggtggaggagttagccgggagcctggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggctgctcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggtgggctggttcctatctaggaagagggtgggccttagatccctacagcttgccctctgccccctaggcccaggtggagggcagaggtggggactccagcccaggcccaagctggaagagggtggggactttcagggaactggggggcacctggctgtgagagctgtaggacttgggggtggcaagggtgccaggacaaatggtaggatagccatgggcttggggaagctgatctctgctctttccagctgtcccctctctgggcgtcccagcaagcggcccccattccctggctctgcttcaaaggcacctccatactgggaccacgtggagcagggtagaggtgggactccttcctccagccccctaaaaagagcctgcttaatgcctttctcagactggccctaaaggacacattccttggccagatatccttgccacctaagagacaccactactccacagtgtgtgggctaggataaggcacagcctggggagggggctctgaaggggctgaacagacaggccagcctgacctccagctgctcctgcactgagctggatggccaccctgtgacacccatctgcagagggcccagaaccaaaggtgccagggctgcaggactcagggggagatggtccgacgggaggtctggggagggagcgcacagccagcactggtctgtgtgtggtctggcctggcctcacctgaccaagagaagggctcctgcccacagagaaactttagggccagcccaccctctgcaactaccccagccctggggtcctggggttaggctaggagagtcccagctgcaacctcctgggagcaggagagaaggtgtctgtcagatttaggcctgggaccggaatgcaggaacagagaaactgaggtttggaggcacagggacgcaggctttagtgatcccggcctgaggcagggtcagagggccctgctggtgggcgctggtaggtgggtgaccagggactgttagctacagggagtgtgcttccttgcacctgggaggatgcagccagctctgccctcagactcccgaggcacttcctggccagggacctgaaagctgcatttgcctgtgttttgagagtgaaatgattcagaaacaaggactcaagtggtctctctcgcggagcaggtgtccctgtgcctgaatcactcaccctcccccatacactcacaggttgggacagggcctctctgcgccccaggcttcagccctgccctcctcgctgaatgtcagggacacagggcaggccagggatgggtgagacgagaggtctcctcgggcggggagggggcggggttccgccttagggaggagaggacacggccaagtgaagggccagattgcaggatccctcccactcccatctctggggcttcgggtgtccagacctgactcccgctccccctcctcccccagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggtcggggtgtggggcaggggcgcacgcgctggacccccgggacccgcgcagggcgctcaccaggcccgtgcgtacctctcgcaggggcggcggccctgtgcggcctggtctacctgttcgcgcgcctccgctacttccagggctacgcgcgctccgcgcagctcaggtgagggccgggcggggagcggggcggggccggggaaagatcgcgggcgggcggggctcctggggagcgggaccgaagctgggggcgggcgacgggccggagcccagcgcctttggggattcggtgggcgagccctggcggcggccagaggaagtccccgtggggccagggttgcggcggggaagaagcgggcctcctcgcgccacctccccgctgaccgccgcccgcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagacccgggctgcgttctctgggtccgcgggggtggcgcaccgcgggctacggagcctggaggggcccagcccgagtccgggcagcccggggcgggcttcctagtggcggcgtgagagtggctgcgaaggaacgagccctccccctggggcgggactggatccggtcttcacctcctaccccactccctactcagcctcggggtcacaaggccgcccagtcctgccggggttcaccctcctagcgctcagcggtctcctcaccggtccccctcctcaggggccttccctcgactctcagccgccgcagtccctcgtcccctggccttcacagctgacactagatagagcctgtggctctctccccaggtgagggcaggggtttttcttttggtcagcactggatccccctcgttaactgtaggtgttcagggcagccctccgaggtccgcagagctgcgggcaccatgggaacgaagtgagtcagtgacaggcggtctcaaggaaatgtccagaagccttggggatccaggggaggcccacagaaacaaagaagtgacttttagccaagtatgcaggagaaacggaggag

SEQ ID NO: 2578 - DNA, 5130 bp; single-stranded, linear
tcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagagctcacagagcccccagctggggcatatctggtttccgggggcaggggcgatacccagaggaggaagaagggattctgagagagcccaacaggctccgagcctcaggctggagctgagcttggggcagcaaggaaggaccaggtgcgagggcagaaccatgcggcccgacccctgcagcacggcctgtggcctcccccagctcctgcccgtgcttctgggtcagtctggactttgccacttctgaccaaaagccaccgcaaacccactcaagccaaaagaggaagtgaccgttaggcccaactgggaaggctggcggccaggggcactccaggcagggcgaggggggcggccgggggcgctccaggcggggcgagggagacacccagaactccaggcaggagtcctcgggtgccacctttcctctccacctggccctgcgtgggctctgtcctcagggtggcccgccgtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacgactaaggctggcaggcatgaggtttcctgaaggagaaagagcttgtggggcccagtgtggctgggggggcgctgggactccattctgaagccaaaggcactgggaagggcttccgcagaggagggtttggcaggggttgccaggaacagcctggatggggacagggaacagataaggtgggtggaggagttagccgggagcctggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggctgctcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggtgggctggttcctatctaggaagagggtgggccttagatccctacagcttgccctctgccccctaggcccaggtggagggcagaggtggggactccagcccaggcccaagctggaagagggtggggactttcagggaactggggggcacctggctgtgagagctgtaggacttgggggtggcaagggtgccaggacaaatggtaggatagccatgggcttggggaagctgatctctgctctttccagctgtcccctctctgggcgtcccagcaagcggcccccattccctggctctgcttcaaaggcacctccatactgggaccacgtggagcagggtagaggtgggactccttcctccagccccctaaaaagagcctgcttaatgcctttctcagactggccctaaaggacacattccttggccagatatccttgccacctaagagacaccactactccacagtgtgtgggctaggataaggcacagcctggggagggggctctgaaggggctgaacagacaggccagcctgacctccagctgctcctgcactgagctggatggccaccctgtgacacccatctgcagagggcccagaaccaaaggtgccagggctgcaggactcagggggagatggtccgacgggaggtctggggagggagcgcacagccagcactggtctgtgtgtggtctggcctggcctcacctgaccaagagaagggctcctgcccacagagaaactttagggccagcccaccctctgcaactaccccagccctggggtcctggggttaggctaggagagtcccagctgcaacctcctgggagcaggagagaaggtgtctgtcagatttaggcctgggaccggaatgcaggaacagagaaactgaggtttggaggcacagggacgcaggctttagtgatcccggcctgaggcagggtcagagggccctgctggtgggcgctggtaggtgggtgaccagggactgttagctacagggagtgtgcttccttgcacctgggaggatgcagccagctctgccctcagactcccgaggcacttcctggccagggacctgaaagctgcatttgcctgtgttttgagagtgaaatgattcagaaacaaggactcaagtggtctctctcgcggagcaggtgtccctgtgcctgaatcactcaccctcccccatacactcacaggttgggacagggcctctctgcgccccaggcttcagccctgccctcctcgctgaatgtcagggacacagggcaggccagggatgggtgagacgagaggtctcctcgggcggggagggggcggggttccgccttagggaggagaggacacggccaagtgaagggccagattgcaggatccctcccactcccatctctggggcttcgggtgtccagacctgactcccgctccccctcctcccccagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggtcggggtgtggggcaggggcgcacgcgctggacccccgggacccgcgcagggcgctcaccaggcccgtgcgtacctctcgcaggggcggcggccctgtgcggcctggtctacctgttcgcgcgcctccgctacttccagggctacgcgcgctccgcgcagctcaggtgagggccgggcggggagcggggcggggccggggaaagatcgcgggcgggcggggctcctggggagcgggaccgaagctgggggcgggcgacgggccggagcccagcgcctttggggattcggtgggcgagccctggcggcggccagaggaagtccccgtggggccagggttgcggcggggaagaagcgggcctcctcgcgccacctccccgctgaccgccgcccgcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagacccgggctgcgttctctgggtccgcgggggtggcgcaccgcgggctacggagcctggaggggcccagcccgagtccgggcagcccggggcgggcttcctagtggcggcgtgagagtggctgcgaaggaacgagccctccccctggggcgggactggatccggtcttcacctcctaccccactccctactcagcctcggggtcacaaggccgcccagtcctgccggggttcaccctcctagcgctcagcggtctcctcaccggtccccctcctcaggggccttccctcgactctcagccgccgcagtccctcgtcccctggccttcacagctgacactagatagagcctgtggctctctccccaggtgagggcaggggtttttcttttggtcagcactggatccccctcgttaactgtaggtgttcagggcagccctccgaggtccgcagagctgcgggcaccatgggaacgaagtgagtcagtgacaggcggtctcaaggaaatgtccagaagccttggggatccaggggaggcccacagaaacaaagaagtgacttttagccaagtatgcaggagaaacggaggag

SEQ ID NO: 2579 - DNA, 3002 bp; single-stranded, linear
gccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttgaaatggagtctcgctctgtcattcaggctggagtgcagtggtgcgatctcagctcactgcagcctccacttcctgggttcacatgattctcctgcctcagcctcccaagtagctgagactacaggcacatgccactacacccagctaacttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtagctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcgaaacaaacacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggttccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagagatggagcaaagtgagggccgagtgagagcgtgctccagcctggctcccacaggcagctttaaccattaaaactgaagtctgaa

SEQ ID NO: 2580 - DNA, 848 bp; single-stranded, linear
aaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtgcacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaa

SEQ ID NO: 2581 - DNA, 848 bp; single-stranded, linear
aaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaa

SEQ ID NO: 2582 - DNA, 1696 bp; single-stranded, linear
aaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtgcacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaaaaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaaa

SEQ ID NO: 2583 - DNA, 810 bp; single-stranded, linear
agcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactaaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtaaaaaa

SEQ ID NO: 2584 - DNA, 1085 bp; single-stranded, linear
ggtttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaatggggatgcttgcatgtgtaatcttactaagagctaatagaaaggctaggaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacaaaaaaaaaaaaaaaaaa

SEQ ID NO: 2585 - DNA, 1085 bp; single-stranded, linear; identical to SEQ ID NO: 2584

SEQ ID NO: 2586 - DNA, 2885 bp; single-stranded, linear
ggatccttaagccatcatgcaaaatatctagccatgtggagggaccactggaaagatcacacacacacacacacacacacacacacacacatacagagagagagagagacacctgagaaattccatctggtccaactgctggctgttgaagtcctcccagcccagaccccagacactgaatgaaggccttgtgatatagtcaagagcaaaaaaacccagaagattgttattgttttaagtcactgttttcagatagattgctatgcagcaatagattattgaaatagacactacaattttaggtactattattctaagaatattgaattttatttttctgctaatgttctattattttacttttctctgggttttagaaagccaccaggatttaagacagtgaagaatctttgagtcctttgtagagttgaaccaaagtttgaatgtctctttgtggactcgtgtcctagggataccactccaaagggaaaaggggaatatcccttacatatctttgactttggtatccctgattccttcctttttctatagaatgtgtctcatttcagagaaactggtctcttgataatagccatagattacatactgtggtcttcctctacatagaccctacctcacctaccactcctggtcttagctgaaaaacaggctagcctcgactcatactgtcatttcctatcctcccactgaagtgcactggctcagcagatttattactccatagatttattactccattctatgattcatcctctctgcttcctataaaaggcagagacagagcttccagaggagcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccaggtaaggtccctctctccttctccttgaagcacattgccccctctctgggttatcctggaccaatcaagaagacctgatacccacagtctcactttaacagctacttttccaagataaggtaacttagaaaaaggataaggggtgagcccaaccacacagctgctgttgggtagagcctgaactagaattccagctgtgaaccccaaatccagctccttctaggattccagctctgggaacaccctcagtgcagttaccactccagctgcttccagcagaatttgggatcagggtgatcaaagacaggaggcttctggggatgggtgtgcgggctgtttccagataccgggagacccagaatctggtctgtggaagcccagcttccagaaacagcagctctgcagaggtggtacgtatcagggaaactcatgaccaagcattgaatgctcagagcctaaaaggggatccatagttggggtacccttgctctaaggaattggattattatattagcccctcctagcaatgcccagagtagccatcaattcctcttccgtctttcaactggtgatggtgcatccctatttcacagtccataaaagtgaaagggagtttatgaaatgcctcaaagggcagagacattgggtttgggatgggcagcttttccctccacctcttcctttctttctgattccttcttcttaccattccctgttttacaaacagaaagacccaggacacaccctcaatggacttttcttcttgttgtttcattgcagttgggattaatacttcaactacctgctgctacagatttatcaataagaaaatccctaagcagaggctggagagctacagaaggaccaccagtagccactgtccccgggaagctgtaatgtatgtggacgatgaccacccacccctcacacctcagtcctaggttcttccctgggcagggaataggactagtatcagaatgagttggagtcaaatactgtgatgcatacagcatctctaaccttatcccagacatttgccagtgagaaacaatacaagtaaagaaagtggcttctcactctcagctccctttccagctatcattttacatctcagttcgttccttcatcctggaaccaagagagattcacttgggctaccaaaaagagctgcttctctgagtccccttcctttgttttatcttcttccttcatccctgaggcatccccatcagctaggctgatgggctagacagatttcccatagacttggtcacactcccaggctgaaccctcaaggtgttccatctgactgtctcctttctgctccacagcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacagctgccattcatggttttttaaaggataagtaataaagctggtggggta

SEQ ID NO: 2587 - DNA, 5865 bp; single-stranded, linear
agcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactaaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtaaaaaaggtttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaatggggatgcttgcatgtgtaatcttactaagagctaatagaaaggctaggaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacaaaaaaaaaaaaaaaaaaggtttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaatggggatgcttgcatgtgtaatcttactaagagctaatagaaaggctaggaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacaaaaaaaaaaaaaaaaaaggatccttaagccatcatgcaaaatatctagccatgtggagggaccactggaaagatcacacacacacacacacacacacacacacacacatacagagagagagagagacacctgagaaattccatctggtccaactgctggctgttgaagtcctcccagcccagaccccagacactgaatgaaggccttgtgatatagtcaagagcaaaaaaacccagaagattgttattgttttaagtcactgttttcagatagattgctatgcagcaatagattattgaaatagacactacaattttaggtactattattctaagaatattgaattttatttttctgctaatgttctattattttacttttctctgggttttagaaagccaccaggatttaagacagtgaagaatctttgagtcctttgtagagttgaaccaaagtttgaatgtctctttgtggactcgtgtcctagggataccactccaaagggaaaaggggaatatcccttacatatctttgactttggtatccctgattccttcctttttctatagaatgtgtctcatttcagagaaactggtctcttgataatagccatagattacatactgtggtcttcctctacatagaccctacctcacctaccactcctggtcttagctgaaaaacaggctagcctcgactcatactgtcatttcctatcctcccactgaagtgcactggctcagcagatttattactccatagatttattactccattctatgattcatcctctctgcttcctataaaaggcagagacagagcttccagaggagcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccaggtaaggtccctctctccttctccttgaagcacattgccccctctctgggttatcctggaccaatcaagaagacctgatacccacagtctcactttaacagctacttttccaagataaggtaacttagaaaaaggataaggggtgagcccaaccacacagctgctgttgggtagagcctgaactagaattccagctgtgaaccccaaatccagctccttctaggattccagctctgggaacaccctcagtgcagttaccactccagctgcttccagcagaatttgggatcagggtgatcaaagacaggaggcttctggggatgggtgtgcgggctgtttccagataccgggagacccagaatctggtctgtggaagcccagcttccagaaacagcagctctgcagaggtggtacgtatcagggaaactcatgaccaagcattgaatgctcagagcctaaaaggggatccatagttggggtacccttgctctaaggaattggattattatattagcccctcctagcaatgcccagagtagccatcaattcctcttccgtctttcaactggtgatggtgcatccctatttcacagtccataaaagtgaaagggagtttatgaaatgcctcaaagggcagagacattgggtttgggatgggcagcttttccctccacctcttcctttctttctgattccttcttcttaccattccctgttttacaaacagaaagacccaggacacaccctcaatggacttttcttcttgttgtttcattgcagttgggattaatacttcaactacctgctgctacagatttatcaataagaaaatccctaagcagaggctggagagctacagaaggaccaccagtagccactgtccccgggaagctgtaatgtatgtggacgatgaccacccacccctcacacctcagtcctaggttcttccctgggcagggaataggactagtatcagaatgagttggagtcaaatactgtgatgcatacagcatctctaaccttatcccagacatttgccagtgagaaacaatacaagtaaagaaagtggcttctcactctcagctccctttccagctatcattttacatctcagttcgttccttcatcctggaaccaagagagattcacttgggctaccaaaaagagctgcttctctgagtccccttcctttgttttatcttcttccttcatccctgaggcatccccatcagctaggctgatgggctagacagatttcccatagacttggtcacactcccaggctgaaccctcaaggtgttccatctgactgtctcctttctgctccacagcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacagctgccattcatggttttttaaaggataagtaataaagctggtggggta

SEQ ID NO: 2588 - DNA, 741 bp; single-stranded, linear
aaccgagaggctgagactaacccagaaagatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtac

SEQ ID NO: 2589 - DNA, 1522 bp; single-stranded, linear
agcccatgtcctctcttttcaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacgatgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccggg

SEQ ID NO: 2590 - DNA, 1569 bp; single-stranded, linear
attttaaaccaatgtttatattatgtttgttaattttattctatttccttgcaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctc

SEQ ID NO: 2591 - DNA, 1703 bp; single-stranded, linear
tccagtgtacctccagatgactcccccattccctcctgtagttcatgcttttctctccccttcctccccagacacggcctacccacccctggcaaccaacatggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccagtgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagcccccgcccggggaggccgcccgggaggagctgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccacgcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtaggcaggcaggagtgccctaggaggtgctggtgttgcgtgcgtgtgctggggggaccacacggctcacttgctgtggggaagagttgcaggcaccattctgcgttcacgtttgctgaggaggaagttcagaagaggctctgtggctgcattcagagaccagatct

SEQ ID NO: 2592 - DNA, 1913 bp; single-stranded, linear
tcttttaacgtatgtaatgcaaagaacaaacaaataaaggcagaaatttttctaactctgtctcttctctctttcccccagactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgacacatca

SEQ ID NO: 2593 - DNA, 6707 bp; single-stranded, linear
agcccatgtcctctcttttcaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacgatgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggattttaaaccaatgtttatattatgtttgttaattttattctatttccttgcaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctctccagtgtacctccagatgactcccccattccctcctgtagttcatgcttttctctccccttcctccccagacacggcctacccacccctggcaaccaacatggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccagtgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagcccccgcccggggaggccgcccgggaggagctgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccacgcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtaggcaggcaggagtgccctaggaggtgctggtgttgcgtgcgtgtgctggggggaccacacggctcacttgctgtggggaagagttgcaggcaccattctgcgttcacgtttgctgaggaggaagttcagaagaggctctgtggctgcattcagagaccagatcttcttttaacgtatgtaatgcaaagaacaaacaaataaaggcagaaatttttctaactctgtctcttctctctttcccccagactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgacacatca

SEQ ID NO: 2594 - DNA, 1230 bp; single-stranded, linear
atggataacgtcctcccggtggactcagacctctccccaaacatctccactaacacctcggaacccaatcagttcgtgcaaccagcctggcaaattgtcctttgggcagctgcttacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgcttgcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccatagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctagggatcc

SEQ ID NO: 2595 - DNA, 1755 bp; single-stranded, linear
ctattgcagtatctttcagcttccagtcttatctgaagaccccggcaccaaagtgaccaggaggcagagaagaacttcagaggagtctcgtcttgggctgcccgtgggtgagtgggagggtccgggactgcagaccggtggcgatggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttatcagtcctgtcctatataccctctagaaacagaaagcaatttttaggcagctatggtcaaattgagaaaggtagtgtataaatgtgacaaagacactaataacatgttagcctccacccaaaataaaatgggctttaaattt

SEQ ID NO: 2596 - DNA, 1197 bp; single-stranded, linear
atggggacctgtgacattgtgactgaagccaatatctcatctggccctgagagcaacaccacgggcatcacagccttctccatgcccagctggcagctggcactgtgggcaccagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctccgccatctgcaggccaagaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctgggttccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttga

SEQ ID NO: 2597 - DNA, 4182 bp; single-stranded, linear
atggataacgtcctcccggtggactcagacctctccccaaacatctccactaacacctcggaacccaatcagttcgtgcaaccagcctggcaaattgtcctttgggcagctgcttacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgcttgcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccatagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctagggatccctattgcagtatctttcagcttccagtcttatctgaagaccccggcaccaaagtgaccaggaggcagagaagaacttcagaggagtctcgtcttgggctgcccgtgggtgagtgggagggtccgggactgcagaccggtggcgatggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttatcagtcctgtcctatataccctctagaaacagaaagcaatttttaggcagctatggtcaaattgagaaaggtagtgtataaatgtgacaaagacactaataacatgttagcctccacccaaaataaaatgggctttaaatttatggggacctgtgacattgtgactgaagccaatatctcatctggccctgagagcaacaccacgggcatcacagccttctccatgcccagctggcagctggcactgtgggcaccagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctccgccatctgcaggccaagaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctgggttccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttga

SEQ ID NO: 2598 - DNA, 1560 bp; single-stranded, linear
ctccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagatatacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaaaaaaaaccgg

SEQ ID NO: 2599 - DNA, 1561 bp; single-stranded, linear
gaattctctctccagcagccctgccagatgcccgcccagcccctgcctcaggcggggagggcttcagggaagctcaccaaggcagaagggcgggagagattgtcagagccccagctggtgtccagggactgaccgtgagcctgggtgaaagtgagttccccgttggaggcaacagacgaggagaggatggaaggcctggcccccaagaatgagccctgaggttcagggagcggctggagtgagccggccccagatctccgtccagctgcgggtcccagaggcctgggttacactcgcagctcctgggggaggcccttgacgtgcctcagttcccaaacaggaaccctgggaaggaccagagaagtgcctattgcgcagtgagtgcccgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccgtatcacagggccctgggtaaactgaggcaggtgacacagctgcatgtggccggtatcacggggccctggataaacagaggcaggcgacacagctgcatgtggccggtatcacggggccctgggtaaactgaggcaggcgaggccacccccatcaagtccctcaggtctaggtttggcaggtttggcaaaaacacagcaacgctcggttaaatctgaatttcgggtaagtatatcctgggcctcatttggaagagacttagattaaaaaaaaaacgtcgagaccagcccggccaacacggtgaaaccccgtctctactaaaaatacaaaaaattagccaggcgcagtggctcacgcctgtgatcccagcactctgggaggctgaggcaggcggatcacccgaggtcagatgttcaagaccagcctggccgacagggcgaaacactgtctctactacaaatacaaaaattagccgggagtggtggcaggtgcctgtaatctcagctattcaggaggctgaggcaggagaatcacttgaacctgggaggcggaggttgccgtgagccgggatcacgccaccgcactccagcctgggcgatagagcaagactctgtctccaaaaaaataaattaaaaaacccacattgattatctgacatttgaatgcgattgtgcatcctgaattttgtctggaggccccacccgagccaatccagcgtcttgtcccccttctcccccttttcatcaacgccctgtgccaggggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgt

SEQ ID NO: 2600 - DNA, 5160 bp; single-stranded, linear
agcttcatcctggagtcaacagattgggtttgaatcctggctctgtccctttctagctgtgtgtttggttgttactccacctctctgagccttaatttcttcatcagtaaaagtaatattcacctcctagggttgttgggagggagaataagaacttctaaagtacccgaacctagcaactaggacactatatttgcaggcaagatgaagaggggtggggaagtaataggaaacagcccaaatcgagagccataatagtctctctttacttagtgccagtgcaggcctgtgattctgttcttaaaaacgtctggggcaagctgcaggaaagacccgagatagcttatgttctaccataagccttaagggaggaggactccaggcagggagacttaccatggcacctctaagagaaagcctactgaccagagagaggtcagtcatgtactcccgtagcttcttagaatttctgatctgactcgctgcctctagagttgttcaggtggaaattggaaggctatagaggaattcggcagcatacagtggctcacgtctgtaatccaaaatccaagcattttggaaggccaaagtaggaggatcacttaagcccaggagtttaagaccagcctaggcaaccgagtgagatccatctccactaaaaaattttaaaatttgccaggtatggtggtgtgcacctgtagccccagctactcaggagagtcagagaatcggcgcaccccggagttcgaggttgcagtgagccatgatcacgccactgtactccagcctgggtgacagagaagaccacctgtctcaaaaaacataaataaataaataaataaataggccgtgcgcagcggctcacgactgtaattccaacattttagaaggcggaggcagcggatcacctgaggtcaggagttcgggaccagcctgaccaacgtggtgaaaccccaactctactaaaaatacataaattaggcggggcgtggtggtggccgcctgtaatcccagctactcggtaggctgcagcaggagaatggtttgaacccgggaggcagaggttgcagtgagccaaaatcccctcactgcattccagcctgagactaaaaaaaagaggcgatttcccacatcggtggaaatttgagctgtttaaactctggatgcctttttcagttctaatattccagatctccttggtggataaacacttcatttcccttctcctgagcagagctcctgagccctggcccgctggaacctgtcacttctaaaaaagttcgaggtccggactgtctctcccggagccttgaggctgatgagacggagcgagagaggggccgggggcaatggagtctactcgcgggcccagggaggcgccagagggccccgggaccgaccgcaagaataacttccttcctcttccgctaacttcccggcagggctacgctcagggtgggggccccgagggctggggcgtcggcttccccctggggatcccccgcttcagagaagccaagcgttagcgcagccaaagccggaggcagcgaagctccggcccggggtggcgctgggtcagggtaccttctcggcggtcccctggccggccgaactcgcgcctggtgtcctgtcaccccgctccccgccctgagtgagcctgtcccctctcaggggcgcgcccgagtcgctccgggttggctgccaggtccagagttaaactttcagccaatgaaaaagggcgcgagggctgacgcacggaaacgtcatgggaattcccccctccggggggccgagaaggggctttcccggccctgagccctgctggcaggcgaggtgtcgcgaccggtcccaggtgggtcgggcgcggagagaagccgcaaccagagccgccgccacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgtacgtacacctgtacctgtgctggcgcacacacggcagcgtccgtgcagtcgcactcgcacacacatgcacacggagacgtgcccaccggtgcactggtgcctgcacccacacccttcacgcacaaactcaagatacgctcacccgtgtctgtacatcaagacaggcgctgacacacacccacactgagaagctcgggattcacctatctacacacatgctcgcttgcacactcatgttgacgccatggacacacaacatgcaaccaagcactacagccgaaacacacttgtggagctgtgatggagacacactcttgtattaggtggggggggggggggagcgtgcagagatctccctgtcgcctgcgcgcccagaaccggtgcggtgtgggaccagctgctgttgtgaggtttgggagagagagaaaaagagcccactccgaggaggagacacttttcccgcagccccagaatcgcgttctcggggcagaaccccggggcctcccacaggaaagagccccgcctacaggctgttcgaaggggaggccgtccgacagcaggaatgtccccccaaaagcccccggggtttatcagccgtggcctccctcctggcagaaaatcccaaggttgctccagaccgggggaggggagcgggaggcggacttggccccagactgccagcctcctcccggccgtgaaagaccctcctgttccctgccctggagggaggagggggcttaacccaccggggcttcccggattctcctagacctctgcccgctgaaaagcagcgggacgccgtagactgtcgagggccatcccgcccctcccgtcgcgagggcggggccagtggcgtcatttccaggcccgccccctccggccccgcctccccttggtattttcgggactttcctaagctgctctaactttcctgccccttccccgccaagcccaactccggatctcgctctccaccggatctcacccgccacacccggacaggcggctggaggaggtcggaccctcccccaaatctgggcccccattctcccgcccacccccatttagatctgaccccctcccccacgccactcctcccaactttaggcgggcgtctaaaattctgggaagcagaacctggccggagccactagacagagccgggcctagcccagagacatggagagttgctacaacccagtgagtcatgccgcctgcccctgacccggccggctagcccctcgtgtctgtccacctgtctgcccgagccccctactgctgccttacacctgtatgcctcgcagatgctctcagcctgccagtctgtccatctgtctgcaactctgcctccaaaaggagctttctcttgggtctgaggaggaggggggagtgaccactgaagacttggaagatgggaggtggggctagtgtggggggtgctgagagtcggatgccacccccagtctgtctccaaaccagggtctggatggtattattgaatatgatgatttcaaattgaactcctccattgtggaacccaaggagccagccccagaaacaggtcagcaagttcactaacctcccctagtctaaagcgggggagggagagcatgtgccctctctctgggggaggggtctgggagatcgtgtgctcagcaaggtctctctgtccccagctgatggcccctacctggtgatcgtggaacagcctaagcaggttgagtgagcaaaagggagggatgtggaatggcttcagctttggggacaaatggggtagtgtagctggctggcatggaggagcattgccgaagaggcccacaggggattggatggtcactgctgctgatcagagtgctgtagttttggttcagggctactaccagcgactcgggtcactgctggcctgggtggtcttccctgatcacaatgctactatgcccttgaccttcagagaggcttccgatttcgatatggctgtgaaggcccctcccatggaggactgcccggtgcctccagtgagaagggccgaaagacctatcccactgtcaaggtgakccaggatggtgctggmgggtgggctaagtggacagcatgcccaaggccctgacgtgacagtcccttgcctctcctagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccagtaggtgcccttcttacgccttggcccccactggtatgccsktcwtgccagtcccaggccccagccacctccatatgatgttagcatctgaccaaggggaaangatgtaggttggccccaaacccaagggcctaagtagaaactccaatggcttccttgaggaagtaaggctgagctgagcctggcaatgggaaaggtgcctggcaatgggaaaggtgcctcaggaagaaagaactgcatggccaaaggctcccgattctctcttctcagatttaacaacctgggtgtcctgcatgtgactaagaagaacatgatggggactatgatacaaaaacttcagaggcagcggctccgctctaggccccagggccttacgggtatgggtgcagggggtgggtcgggtatgggtgcagggggtgggtgggtcatgggaggtgctcatggaaggagcagggagggagaagccaggggtcacacatgtacctactgcccagaggccgagcagcgggagctggagcaagaggccaaagaactgaagaaggtgatggatctgagtatagtgcggctgcgcttctctgccttccttagagccagtgatggctccttctccctgcccctgaagccagtcacctcccagcccatccatgatagcagtgagtatcctgattgcctggggtgccaggcctggtsgsagaggtggcatgaggggtgacctcaagctgtgcagtcaaacaagacccaggtttcagaacctgcsctgccacatatgagctgagtgatcctgagcaagtcatttccccccc

SEQ ID NO: 2601 - DNA, 3625 bp; single-stranded, linear
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgcccgcggccaccgcgggccctgccgttccctccgccgcgctgcgccatggcgcggcgctgactggcctggcccggccccgccgcgctcccgctcgccccgacccgcactcgggcccgcccgggctccggcctgccgccgcctcttccttctccagccggcaggccccgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacacgggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgc

SEQ ID NO: 2602 - DNA, 1650 bp; single-stranded, linear
actttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcacctcccagcccatccatgatagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctgggggaggccgggcgtggcttgcacgcctgtaatccagcctttgggaggccaaggcaggcagttacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctcaaaaaaaaaaaaaaaaaaaaaa

SEQ ID NO: 2603 - DNA, 3113 bp; single-stranded, linear
cacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaaggagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgacgcgcaggccccggagatgctgcagcgagctcgagagtacaacgcgcgcctgttcggcctggcgcagcgcagcgcccgagccctactcgactacggcgtcaccgcggaccggcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacaacagaggtgaaggaagacagtgcgtacgggagccagtcagtggagcagaaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaaaaaaa

SEQ ID NO: 2604 - DNA, 13548 bp; single-stranded, linear
agcttcatcctggagtcaacagattgggtttgaatcctggctctgtccctttctagctgtgtgtttggttgttactccacctctctgagccttaatttcttcatcagtaaaagtaatattcacctcctagggttgttgggagggagaataagaacttctaaagtacccgaacctagcaactaggacactatatttgcaggcaagatgaagaggggtggggaagtaataggaaacagcccaaatcgagagccataatagtctctctttacttagtgccagtgcaggcctgtgattctgttcttaaaaacgtctggggcaagctgcaggaaagacccgagatagcttatgttctaccataagccttaagggaggaggactccaggcagggagacttaccatggcacctctaagagaaagcctactgaccagagagaggtcagtcatgtactcccgtagcttcttagaatttctgatctgactcgctgcctctagagttgttcaggtggaaattggaaggctatagaggaattcggcagcatacagtggctcacgtctgtaatccaaaatccaagcattttggaaggccaaagtaggaggatcacttaagcccaggagtttaagaccagcctaggcaaccgagtgagatccatctccactaaaaaattttaaaatttgccaggtatggtggtgtgcacctgtagccccagctactcaggagagtcagagaatcggcgcaccccggagttcgaggttgcagtgagccatgatcacgccactgtactccagcctgggtgacagagaagaccacctgtctcaaaaaacataaataaataaataaataaataggccgtgcgcagcggctcacgactgtaattccaacattttagaaggcggaggcagcggatcacctgaggtcaggagttcgggaccagcctgaccaacgtggtgaaaccccaactctactaaaaatacataaattaggcggggcgtggtggtggccgcctgtaatcccagctactcggtaggctgcagcaggagaatggtttgaacccgggaggcagaggttgcagtgagccaaaatcccctcactgcattccagcctgagactaaaaaaaagaggcgatttcccacatcggtggaaatttgagctgtttaaactctggatgcctttttcagttctaatattccagatctccttggtggataaacacttcatttcccttctcctgagcagagctcctgagccctggcccgctggaacctgtcacttctaaaaaagttcgaggtccggactgtctctcccggagccttgaggctgatgagacggagcgagagaggggccgggggcaatggagtctactcgcgggcccagggaggcgccagagggccccgggaccgaccgcaagaataacttccttcctcttccgctaacttcccggcagggctacgctcagggtgggggccccgagggctggggcgtcggcttccccctggggatcccccgcttcagagaagccaagcgttagcgcagccaaagccggaggcagcgaagctccggcccggggtggcgctgggtcagggtaccttctcggcggtcccctggccggccgaactcgcgcctggtgtcctgtcaccccgctccccgccctgagtgagcctgtcccctctcaggggcgcgcccgagtcgctccgggttggctgccaggtccagagttaaactttcagccaatgaaaaagggcgcgagggctgacgcacggaaacgtcatgggaattcccccctccggggggccgagaaggggctttcccggccctgagccctgctggcaggcgaggtgtcgcgaccggtcccaggtgggtcgggcgcggagagaagccgcaaccagagccgccgccacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgtacgtacacctgtacctgtgctggcgcacacacggcagcgtccgtgcagtcgcactcgcacacacatgcacacggagacgtgcccaccggtgcactggtgcctgcacccacacccttcacgcacaaactcaagatacgctcacccgtgtctgtacatcaagacaggcgctgacacacacccacactgagaagctcgggattcacctatctacacacatgctcgcttgcacactcatgttgacgccatggacacacaacatgcaaccaagcactacagccgaaacacacttgtggagctgtgatggagacacactcttgtattaggtggggggggggggggagcgtgcagagatctccctgtcgcctgcgcgcccagaaccggtgcggtgtgggaccagctgctgttgtgaggtttgggagagagagaaaaagagcccactccgaggaggagacacttttcccgcagccccagaatcgcgttctcggggcagaaccccggggcctcccacaggaaagagccccgcctacaggctgttcgaaggggaggccgtccgacagcaggaatgtccccccaaaagcccccggggtttatcagccgtggcctccctcctggcagaaaatcccaaggttgctccagaccgggggaggggagcgggaggcggacttggccccagactgccagcctcctcccggccgtgaaagaccctcctgttccctgccctggagggaggagggggcttaacccaccggggcttcccggattctcctagacctctgcccgctgaaaagcagcgggacgccgtagactgtcgagggccatcccgcccctcccgtcgcgagggcggggccagtggcgtcatttccaggcccgccccctccggccccgcctccccttggtattttcgggactttcctaagctgctctaactttcctgccccttccccgccaagcccaactccggatctcgctctccaccggatctcacccgccacacccggacaggcggctggaggaggtcggaccctcccccaaatctgggcccccattctcccgcccacccccatttagatctgaccccctcccccacgccactcctcccaactttaggcgggcgtctaaaattctgggaagcagaacctggccggagccactagacagagccgggcctagcccagagacatggagagttgctacaacccagtgagtcatgccgcctgcccctgacccggccggctagcccctcgtgtctgtccacctgtctgcccgagccccctactgctgccttacacctgtatgcctcgcagatgctctcagcctgccagtctgtccatctgtctgcaactctgcctccaaaaggagctttctcttgggtctgaggaggaggggggagtgaccactgaagacttggaagatgggaggtggggctagtgtggggggtgctgagagtcggatgccacccccagtctgtctccaaaccagggtctggatggtattattgaatatgatgatttcaaattgaactcctccattgtggaacccaaggagccagccccagaaacaggtcagcaagttcactaacctcccctagtctaaagcgggggagggagagcatgtgccctctctctgggggaggggtctgggagatcgtgtgctcagcaaggtctctctgtccccagctgatggcccctacctggtgatcgtggaacagcctaagcaggttgagtgagcaaaagggagggatgtggaatggcttcagctttggggacaaatggggtagtgtagctggctggcatggaggagcattgccgaagaggcccacaggggattggatggtcactgctgctgatcagagtgctgtagttttggttcagggctactaccagcgactcgggtcactgctggcctgggtggtcttccctgatcacaatgctactatgcccttgaccttcagagaggcttccgatttcgatatggctgtgaaggcccctcccatggaggactgcccggtgcctccagtgagaagggccgaaagacctatcccactgtcaaggtgakccaggatggtgctggmgggtgggctaagtggacagcatgcccaaggccctgacgtgacagtcccttgcctctcctagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccagtaggtgcccttcttacgccttggcccccactggtatgccsktcwtgccagtcccaggccccagccacctccatatgatgttagcatctgaccaaggggaaangatgtaggttggccccaaacccaagggcctaagtagaaactccaatggcttccttgaggaagtaaggctgagctgagcctggcaatgggaaaggtgcctggcaatgggaaaggtgcctcaggaagaaagaactgcatggccaaaggctcccgattctctcttctcagatttaacaacctgggtgtcctgcatgtgactaagaagaacatgatggggactatgatacaaaaacttcagaggcagcggctccgctctaggccccagggccttacgggtatgggtgcagggggtgggtcgggtatgggtgcagggggtgggtgggtcatgggaggtgctcatggaaggagcagggagggagaagccaggggtcacacatgtacctactgcccagaggccgagcagcgggagctggagcaagaggccaaagaactgaagaaggtgatggatctgagtatagtgcggctgcgcttctctgccttccttagagccagtgatggctccttctccctgcccctgaagccagtcacctcccagcccatccatgatagcagtgagtatcctgattgcctggggtgccaggcctggtsgsagaggtggcatgaggggtgacctcaagctgtgcagtcaaacaagacccaggtttcagaacctgcsctgccacatatgagctgagtgatcctgagcaagtcatttcccccccggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgcccgcggccaccgcgggccctgccgttccctccgccgcgctgcgccatggcgcggcgctgactggcctggcccggccccgccgcgctcccgctcgccccgacccgcactcgggcccgcccgggctccggcctgccgccgcctcttccttctccagccggcaggccccgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacacgggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgcactttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcacctcccagcccatccatgatagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctgggggaggccgggcgtggcttgcacgcctgtaatccagcctttgggaggccaaggcaggcagttacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctcaaaaaaaaaaaaaaaaaaaaaacacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaaggagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccgagcgccccctccaggaccccccagtgcgacgcgcaggccccggagatgctgcagcgagctcgagagtacaacgcgcgcctgttcggcctggcgcagcgcagcgcccgagccctactcgactacggcgtcaccgcggaccggcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcggtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacaacagaggtgaaggaagacagtgcgtacgggagccagtcagtggagcagaaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttaaaaaaaaaaaaa

SEQ ID NO: 2605 - DNA, 2163 bp; single-stranded, linear
atgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttactggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggataca

SEQ ID NO: 2606 - DNA, 348 bp; single-stranded, linear
tatcacaacagcatgcacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggctacagatatggca

SEQ ID NO: 2607 - DNA, 2511 bp; single-stranded, linear
atgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttactggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacatatcacaacagcatgcacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggctacagatatggca

SEQ ID NO: 2608 - DNA, 2372 bp; single-stranded, linear
gggccgccgtcggcgcgctgggtgcgggaagggggctctggatttcggtccctcccctttttcctctgagtctcggaacgctccagctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccctggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcaatgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactcttattatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttaggggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaaca

SEQ ID NO: 2609 - DNA, 1376 bp; single-stranded, linear
gggggcggcagggctgagcggccggtgatggggaccccacatcccaggcagtgccggcacccctggcgcctgacatgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccaccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgcatcgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcg

SEQ ID NO: 2610 - DNA, 1077 bp; single-stranded, linear
atgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttga

SEQ ID NO: 2611 - DNA, 1241 bp; single-stranded, linear
ctgcagatgggaagaggtttttccaggaatttaaattgtgcaataaggccacacaatcttacttaaaaaaaatggtgaaggggttttaattacaccatgaagttttacaattttttaggtttttagttctggttttagaaaacagagtagaaggattaacagagaaaaacttcaccattagacaagaagtcaaaatgattctaagggccgcgcaaacaggctttccaagaattaatcatgaggtggtgcttggagaattcctttactccagtgactttgaaacccccttctcactctccactagtctttcaaaggattcatggtgaattgggtctaacgagtataacacggccggccgaacgatgaagctcacgctaccctttcagggcggagaagttcccaggaggaagaatggagaaaaagatcgcagttaggcagtcctcccaacctcaccaaggctccacctctctccaaagccgcaacgtgctgccacctgcgccgggagaggctgcaatcactgtctcctcctctttctttctctttttttttttttcttttttgcctggggtgcccgaccaagcgcagccgcagtctgggcactgccaactgactccaactccttttatggtgagaggatggattcttcgttatttccccgcccaatctggtacccacccacccacccacccaccacgtccgctgggcgcacccaagtctaaccccggggcgcacgccgtagcgcagacaccgtatttctcctcctttctcggccaaccctaggtagaatcctaaaacaactgccctctcttccacgatctagatgttgcggcccgcggacaggaggttcaagaaatagtacactccgagcggcaggcagcgagagcggaaacggtcgccggtttcagtggtggccccactggaagccgagttcaggagcggctaagcgtcgccggggaaagcaccggggcttcccagggtctcctccgagttcccactccgcacctccgagggcgtgaaaaccacgggagccgcccgccccgcgcgcccagccccgccccagcccagacaccgccccccgccagtcttccctgcggcgcccagggaggacgccgtccgcccccttccaatccggccaatgggcgcccgggcagcgcgcggtttgcctccgcctccgccagggaaacttggaggaggagaaaagtttgtacagagggtggaaaggccgcagcacgcgagctcca

SEQ ID NO: 2612 - DNA, 2154 bp; single-stranded, linear
agcccggcagcccgagaggaagatgaacagccccaggccagagcctctgcgagagtggaccccgagccgcccccaggtagccaggagcggcctcagcggcagccgcaaactccagtagccgcccgtgctgcccgtgctggggcggagggcagccagagctggggaccaaggctccgcgccacctgggcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgagggatgccgccctcgccgaagagagccaagaggggaagagcgcgctctccaaattgcttttgtaacttgttttcagtgagcattttattgattcagaatctatcgagaatagcactagcgagctactttccccttgagatgggtcttattcatcttggcaatggagtgagttggattgtggggaggaagaggaatgggaaaatcagtttataaatattaatgtcagccaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtaaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccgggggtggggccctactcggcctttttctcgcatccacctcccgcgtccattccccgctccctgttttccctctgagtccttgggagtgaacgtgtcgcctttaggtcggggctgggattcccacactgtttctcagaggaggcccaacccctctttggaagtcccaaccctaacgcgatttagcaggtgctttggccctacatcccccagtttatgtttcccggaaggctgg

SEQ ID NO: 2613 - DNA, 840 bp; single-stranded, linear
agcccatgactggtttttctgaggcttattatgtagcttcctcttttcctggaacttgttaccagaaatgaaggcagcttcctaatattgataaggtagacatagcatttatatgttttcccaattgattaatgatgaaatctaaatgtgcgactcacttatgcaggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtgttactggtggatgaggctggtggaagcggcagggcagggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcaca

SEQ ID NO: 2614 - DNA, 9060 bp; single-stranded, linear
gggccgccgtcggcgcgctgggtgcgggaagggggctctggatttcggtccctcccctttttcctctgagtctcggaacgctccagctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccctggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcaatgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactcttattatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttaggggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacagggggcggcagggctgagcggccggtgatggggaccccacatcccaggcagtgccggcacccctggcgcctgacatgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccaccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgcatcgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcgatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgactgcagatgggaagaggtttttccaggaatttaaattgtgcaataaggccacacaatcttacttaaaaaaaatggtgaaggggttttaattacaccatgaagttttacaattttttaggtttttagttctggttttagaaaacagagtagaaggattaacagagaaaaacttcaccattagacaagaagtcaaaatgattctaagggccgcgcaaacaggctttccaagaattaatcatgaggtggtgcttggagaattcctttactccagtgactttgaaacccccttctcactctccactagtctttcaaaggattcatggtgaattgggtctaacgagtataacacggccggccgaacgatgaagctcacgctaccctttcagggcggagaagttcccaggaggaagaatggagaaaaagatcgcagttaggcagtcctcccaacctcaccaaggctccacctctctccaaagccgcaacgtgctgccacctgcgccgggagaggctgcaatcactgtctcctcctctttctttctctttttttttttttcttttttgcctggggtgcccgaccaagcgcagccgcagtctgggcactgccaactgactccaactccttttatggtgagaggatggattcttcgttatttccccgcccaatctggtacccacccacccacccacccaccacgtccgctgggcgcacccaagtctaaccccggggcgcacgccgtagcgcagacaccgtatttctcctcctttctcggccaaccctaggtagaatcctaaaacaactgccctctcttccacgatctagatgttgcggcccgcggacaggaggttcaagaaatagtacactccgagcggcaggcagcgagagcggaaacggtcgccggtttcagtggtggccccactggaagccgagttcaggagcggctaagcgtcgccggggaaagcaccggggcttcccagggtctcctccgagttcccactccgcacctccgagggcgtgaaaaccacgggagccgcccgccccgcgcgcccagccccgccccagcccagacaccgccccccgccagtcttccctgcggcgcccagggaggacgccgtccgcccccttccaatccggccaatgggcgcccgggcagcgcgcggtttgcctccgcctccgccagggaaacttggaggaggagaaaagtttgtacagagggtggaaaggccgcagcacgcgagctccaagcccggcagcccgagaggaagatgaacagccccaggccagagcctctgcgagagtggaccccgagccgcccccaggtagccaggagcggcctcagcggcagccgcaaactccagtagccgcccgtgctgcccgtgctggggcggagggcagccagagctggggaccaaggctccgcgccacctgggcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgagggatgccgccctcgccgaagagagccaagaggggaagagcgcgctctccaaattgcttttgtaacttgttttcagtgagcattttattgattcagaatctatcgagaatagcactagcgagctactttccccttgagatgggtcttattcatcttggcaatggagtgagttggattgtggggaggaagaggaatgggaaaatcagtttataaatattaatgtcagccaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtaaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccgggggtggggccctactcggcctttttctcgcatccacctcccgcgtccattccccgctccctgttttccctctgagtccttgggagtgaacgtgtcgcctttaggtcggggctgggattcccacactgtttctcagaggaggcccaacccctctttggaagtcccaaccctaacgcgatttagcaggtgctttggccctacatcccccagtttatgtttcccggaaggctggagcccatgactggtttttctgaggcttattatgtagcttcctcttttcctggaacttgttaccagaaatgaaggcagcttcctaatattgataaggtagacatagcatttatatgttttcccaattgattaatgatgaaatctaaatgtgcgactcacttatgcaggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtgttactggtggatgaggctggtggaagcggcagggcagggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcaca

SEQ ID NO: 2615 - DNA, 4866 bp; single-stranded, linear
aagcttcctgtacctggaatattaatattttatttcagatttgggaaattttcagctagcaatctttaaatatgctttctgacccccttttcctctattttctccttcttaaactactgtaatgtgaacattagctctcttttttaatttttaatttaatttttgtttttattttttgagatgcagtctcactctgtcacccaggctggagtgcagtggcatgatctcagctcactgcaacctttgccttctaggttgaagagattctgctgcctcagtctccccatgagctgggattacagcatgtgccacaatccctggctaatttttttgtatttttagtagagactgggtttcaccatgttggtcaggctggtcttgactcctgacctcaggtgatccactcaccttggcctcccaaagcgctgggattatggcatgagccactgagtctggctgaatgttagctctcttgatgctgtcccataaatcttgtaggctttcatcatttcttttcattcttttttctcctctcactgtatattttcaaaaacctgtcttcagttcacagattctttcttctgcttgatcaagtctgctactggtgatttctactgcatttctcacttcattcattatatttttcagctccaatttcttttatgatttcaatctttctgttacatttcttatgttgtgcatttattgtttctctgatttcaccaaattgtttctctgtgtttgcttcaaagtaactgagcttctttaaaaacaattatcttgaatccattgtcaggccatttgtagtactccatttcttttgggtcagctactgggaaattattgtgtttcttaggtggtgatattttaatttgggttttcatgtttcttgctgccttacactgctgtctgagcatctggtggatctgccccaatttcaggctgtatgggctgactttggtggagaaataccttcttatgtggaataatgcgaggatgctggctgggtgggatgcaaaagttctgacttcagtaggggcaaagctgtgtggtctccatgcagatctgtcagctgaggttggtgttagtgaatactacagggatccttagaggccaacactgtgggtatctacagtggcaatgaggctgttgaggttttcaattgtgacaagtcctccatatctctttttttccccacctgggaagtcatgactgaggacatccctcttggaattaggtctaacttgcaggcctgctcctggtggtggtgacactggtgtctgatgaacagtgcccatggagtggccaagagccaaggcctgaagcatgggcatgcatggagggaccacagcaccagattcaattgtagcaatggtaccagtgcccaaggcacaggcatacttactatcacattgataatggtgtgtaaaatgcaggtacttataaagcagctaaggagccagggactttactgcatgcatacgcagagctacagtggctccaggatccagggtgtgggctagctctccttggtggctgagctggtgactagagcatggacaggcacagagaaaccttgactctaggacccagggtgttcactagctcactatagtggtggctctggtgttggaggtgtgggtgtgtgtagtacagcctcagagacagggtctggagcgcaggtgtgcacattactacagcagctctggagttgagaatatgggttacctttctacagtggctgaactagtgtctggagcaaagactttcacagagagaacttggcttggggtcccagggtgagatctagttcacaacagcagtgactccagtgtctgagacatgaggaggtgcactgcagccacagagccacagtccagagtgtgaatatctgtagagcagccacaacttttggggatcaggaacacacatagaattgtgagaggtggtaaccctggccccagtcctggcgagtgcaacaatagctgcttcttggtgagggggtgtgaggggtagtgcaactgtgtttccctttttagcatcctgctatgggaatggctgttggacaaaagatgccagtgtcctctgtggagcaggacactgggggcctcagtggctctgtgtcacatgactgacacagatagcctacaaatttctttattcgtagctatctcctggtgtctcatatatgccagtctcaccggtgattcttctacatgaatattctttcttttctccattgtgttgttccaaattctttaacaggctcttgagccccatcccccaactccccacccttgtgagggctattttggtttgtgtataactgtctatgtttgtttttttgttggggcataaggctgacatctcctactccaccatcttgctaatgtcacctgcataggaatctttttatgctttccttatattcactaaaatttaacaatatcaaacttaaaaacatatgatcaattgaacttattaatatcaaacttattataaataagaaactaccaggctgggcatggtggctcatgcctgtaatcccaacattttgggaggctgaggtgaaaggatcacttgagcccaggaattcaagaccagcctgggaaatatagagagaccctatctctagagatttttttttttaattagccagtagtgatggcacacatctatagtcccagctactcaggaggctgaggtgggagaattgcttgagcccaggaggtcaaggctgcagcaagcagtaatcatgccactgcactccagcctgggccgcagagtgagaccctgtctcaaaaaaagaacctactagtctacataccacacttcttcatccccatctgagactatatatattttttctaacatgaggcaatgccaaaaagaggagctggtgagtgaaagtaagaacagaaagacatggaggcaagtcttatagaataatagccaacacttaaacttacacttaacagcgtgataggtattgttccaaacacattaaattcatttaatggtccttacatgtctatgtatttggtgattattatccttattattcacattgctgagtgtattattctgttctcatgatgctgatagagacatacccgagactggataacttattaaaaaaaaaaaggtttaatggactcacagttccacgtggatggggagtcctcacaatcatggtagaaagcaaaagacacgtcttacatggcagcagggaagagagagaaatgagaaccaaacaaaaggggtttccccttataaaaccatcagctctcatgcgacttattcactaccatgagaacagtatgggggaaaccacccccatgattcaatgatctaccaggtgcctcccacaacctgtgggaattatgggagctacaattccagatgagatttgggtggggacacagccaaaccacatcactgaggaaactgagttatagggagattagtaacgcccaacacagctggtaggtggtggagccaggcagtctgactctagggtctggactctgaactgcatcatgctgccaagaagttcctcattttttcctctctctaagtttcccttattcccctacagtcattccttcaacagcatttccttcaccatcttttctacttctactatataattaattttttcttcttggtcccaaattccaacgtgcaaatgcagccttatataccctaattcatctttacctttagactttcttccaatgtttctacttcattccattttaaatttatccatgagatgcctatttacaagctgtaaccatcatgaagtgaatgaagaataatacctactactgtacaatagaattccaagagtataaataggagttatggctttctgacttgaaactaaatacttgatacttgattttgctgtctgagatcaatctgaaaagtaataataatcactaacatttgttgagcatcaattgtgggccaagtgtcatttcaatcactctgtacatattaactcatttcatcctacaacaacccggtgaggcaagttctgttattctgttttacagttgaggaaacagaggcatagagagcttaagtagtttgcccagtagatagccagaagaggagccaggatgggtctcgggcagtttaacagcacagctgaagtcttaaccactatgccaacagctttttggtcctacacatcccatgggaagaggaaaataaaaaggtatctatttgtatacctttttatttctgatataagaagcagaattcctttcacatgacctatgtctatttaatacgtcattttgaaacttaccaataaaatttcccaagcgccagaaaactgttagtggctttttccattcttctctatttttttttgtgctactaattttgcttctttccctcagaaggctgccggaatagtaaacattcactgacatgtcataattactggaaaatgggcactggaaaatcacattgtaattaattcaaagcatgttttccaaatgtactactttaaattggagcttatatcataatccaaggaaacctttgtgtgtgtactgttcccacattgctcagcctgggatatccaggagtaattcaccttgcgcctgcctccagaccatcttccatggaagggggtgaccccttgcctcttggcaaccactatttctaagctgccaacattactcttgcattatcaacattctaacttcatgggaagggctgtggtgagtttctggaatgtgaataggaagttgtttttctaaacagcctgacactgaggggaggcagtgagactgtaagcagtctgggttgggcagaaggcagaaaaccagcagagtcacagaggagatg

SEQ ID NO: 2616 - DNA, 1016 bp; single-stranded, linear
gtcgaggatccctaaagtcctttgaagctttcatattctgtaacttttgtgccaagaaggccttacagtgagatgggatcccagtatttattgagtttcctcattcataaaatggggataataatagtaaatgagttgacacgcgctaagacagtggaatagtggctggcacagataagccctcggtaaatggtagccaataatgatagagtatgctgtaagatatctttctctccctctgcttctcaacaagtctctaatcaattattccactttataaacaaggaaatagaactcaaagacattaagcacttttccaaaggtcgcttagcaagtaaatgggagagaccctatgaccaggatgaaagcaagaaattcccacaagaggactcattccaactcatatcttgtgaaaaggttcccaatgcccagctcagatcaactgcctcaatttacagtgtgagtgtgctcacctcctttggggactgtatatccagaggaccctcctcaataaaacactttataaataacatccttccatggatgagggaaaggaggtaagatctgtaatgaataagcaggaactttgaagactcagtgactcagtgagtaataaagactcagtgacttctgatcctgtcctaactgccactccttgttgtcccaagaaagcggcttcctgctctctgaggaggaccccttccctggaaggtaaaactaaggatgtcagcagagaaatttttccaccattggtgcttggtcaaagaggaaactgatgagctcactctagatgagagagcagtgagggagagacagagactcgaatttccggagctatttcagttttcttttccgttttgtgcaatttcacttatgataccggccaatgcttggttgctattttggaaactccccttaggggatgcccctcaactggccctataaagggccagcctgagctgcagaggatcaagacagcacgtggacctcgcacagcctctcccacaggtaccatg

SEQ ID NO: 2617 - DNA, 1160 bp; single-stranded, linear
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 2618 - DNA, 2176 bp; single-stranded, linear
gtcgaggatccctaaagtcctttgaagctttcatattctgtaacttttgtgccaagaaggccttacagtgagatgggatcccagtatttattgagtttcctcattcataaaatggggataataatagtaaatgagttgacacgcgctaagacagtggaatagtggctggcacagataagccctcggtaaatggtagccaataatgatagagtatgctgtaagatatctttctctccctctgcttctcaacaagtctctaatcaattattccactttataaacaaggaaatagaactcaaagacattaagcacttttccaaaggtcgcttagcaagtaaatgggagagaccctatgaccaggatgaaagcaagaaattcccacaagaggactcattccaactcatatcttgtgaaaaggttcccaatgcccagctcagatcaactgcctcaatttacagtgtgagtgtgctcacctcctttggggactgtatatccagaggaccctcctcaataaaacactttataaataacatccttccatggatgagggaaaggaggtaagatctgtaatgaataagcaggaactttgaagactcagtgactcagtgagtaataaagactcagtgacttctgatcctgtcctaactgccactccttgttgtcccaagaaagcggcttcctgctctctgaggaggaccccttccctggaaggtaaaactaaggatgtcagcagagaaatttttccaccattggtgcttggtcaaagaggaaactgatgagctcactctagatgagagagcagtgagggagagacagagactcgaatttccggagctatttcagttttcttttccgttttgtgcaatttcacttatgataccggccaatgcttggttgctattttggaaactccccttaggggatgcccctcaactggccctataaagggccagcctgagctgcagaggatcaagacagcacgtggacctcgcacagcctctcccacaggtaccatgcctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 2619 - DNA, 4003 bp; single-stranded, linear
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatcgacacagtgctttccgtggcactgcatacaatctgaggcctcctctctcagtttttatatagatggcgagaacctaagtttcagttgattttacaattgaaatgactaaaaaacaaagaagacaacattaaaaacaatattgtttcta

SEQ ID NO: 2620 - DNA, 2607 bp; single-stranded, linear
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaaagccaaaaaccaaatttgtatttaaggtatataaattttcccaaaactgataccctttgaaaaagtataaataaaatgagcaaaagttgaa

SEQ ID NO: 2621 - DNA, 97 bp; single-stranded, linear
ttactaagatgattattgttttatagcaattgaaagaacagaaaaatgctggcaccagaacgaatgaggtgagagtggtttatgttgtgaatgggcc

SEQ ID NO: 2622 - DNA, 199 bp; single-stranded, linear
acgacctctctgcccgttgtggtgatctccaacgtcagccagctcccgagcggttgggcctccatcctttggtacaacatgctggtggtggcggaacccagggtatggaaaacacatttgctttggtcccagggtttaagcagagaccccacgctctcgctgctgcatctcgctgctgcatctctgaaatagccccaat

SEQ ID NO: 2623 - DNA, 100 bp; single-stranded, linear
ggtctcaatgtggaccagctgaacatgttgggagagaagcttcttggtatatgcatattaacttgttatgtttataaaaattgaaattcataaaaatatc

SEQ ID NO: 2624 - DNA, 150 bp; single-stranded, linear
ctgatcagtagaaaacatgtttacatctttgtttgtagtgtatagagcatgaaatcaagagcctggaagatttacaagatgaatatgacttcaaatgcaaaaccttgcagaacagaggtaagggttcacaactgaagtggtgcccgttgg

SEQ ID NO: 2625 - DNA, 7156 bp; single-stranded, linear
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatcgacacagtgctttccgtggcactgcatacaatctgaggcctcctctctcagtttttatatagatggcgagaacctaagtttcagttgattttacaattgaaatgactaaaaaacaaagaagacaacattaaaaacaatattgtttctaattaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaaagccaaaaaccaaatttgtatttaaggtatataaattttcccaaaactgataccctttgaaaaagtataaataaaatgagcaaaagttgaattactaagatgattattgttttatagcaattgaaagaacagaaaaatgctggcaccagaacgaatgaggtgagagtggtttatgttgtgaatgggccacgacctctctgcccgttgtggtgatctccaacgtcagccagctcccgagcggttgggcctccatcctttggtacaacatgctggtggtggcggaacccagggtatggaaaacacatttgctttggtcccagggtttaagcagagaccccacgctctcgctgctgcatctcgctgctgcatctctgaaatagccccaatggtctcaatgtggaccagctgaacatgttgggagagaagcttcttggtatatgcatattaacttgttatgtttataaaaattgaaattcataaaaatatcctgatcagtagaaaacatgtttacatctttgtttgtagtgtatagagcatgaaatcaagagcctggaagatttacaagatgaatatgacttcaaatgcaaaaccttgcagaacagaggtaagggttcacaactgaagtggtgcccgttgg

SEQ ID NO: 2626 - DNA, 18648 bp; single-stranded, linear
tcaagatcagcctgggcaacatggcgaaaccccgtctctacaataaatacaaaaaaattatcctggcggagttatgcacgttgtagtcccaactacctgggaggctgaggcgggagaatcacctgagcctgggaggtcgaggctgcagcgagccgagatcggccgctgcattccagcctgggtgacagagcgagaccatgtctcaaaaaataaaaattaaaaaaaaattgttttcattacctcagccctcctcttcctatcccaaggcgtcgaaattccggtcccaccccttcccatggagcccttggcgtctccaggctcctcaagctagtttcggttccgggctcacgcgcgggttctcgaaaatcagctgtttcagtcttgggctagtccactaattggactcctcccctcgtagaaagtgcctacttgaacttctccaccaatcgctgaagctgcaggtgtggtttcggctcagcttgtcccgccctggcggaggggcggagttgcggcggcgccagtgagctcgcagtctgggaagggcttgactgaatggcagccagtgtcggggtggcggctgggaatgggggccgctccggacttccgctgccaactacaagggggcgggtccgaggggggttagccgaagttgtaggcggggcgcgaggttctagtacccgagctcatactagggacgggaagtcgcgaccagagccattggagggcgcggggactgcaaccctaatcaggtacgggccctgagagggtgtgctggggtaggggtgggggtgagagtgagagttcctccgagggaagggcgactggcccaggggttaccccctggagagggtagcttccttccccagattgaaataggagctgtcgcctgctcggtcctcgatcttcttctgtccagcctatctccctaaccctaatgcccctctcccaaaactgccctgcagcttccgagacccggaatctggcattgttatgttggttcggtatctgacgtttttccctctgctctgcattattttttatcttcaccaaaaaacgatgttcaaagatagataaatctaaaaacaaagatagataaatctattacccttgtttcgtaaaaagtataagctactgaaagatgaaacgattgcctaaggtcacacacaaaattcagttcatttcagaaaagcttcttgagtgcaaaatatgtgcctaagaatgagagataatgagaaaaaattgtttcagccccttaacctcagtgtttgcaatccatttggggagaccaggttttttgtttttgttttcatatttgaatctttgctgacttgctcctttaatatcagacacttaaatcctcagatgggactcatcatattttttttgagatggaatcttcactatgttgctcaagcttggtctgcaactcctggctcaagccatcctctcgtcttgttgggcctctcgtcttgtgggcctgcacaaagtgctgggattacaggcatgagccattcatgccctgggcgcaccttggattgcgatgtgtgtgtgttgtgaagcttttttttttggtatcataaaagcaatacagatacatagttttaaaaatcaagcagctactaaaagagttaaaatgaaaatagcccctcccaatccctcccttgttcctgctggaggtagaaaggcagctgatgttattcatgttagtagaagactctcccaccccaagcatttctctttattttgtaataaaatcatgtgacctttttagaccacaaatatgcatgaattctgttctgttaggctcaggctgcaacaagataagtttcagtttcctaaatagacaccagctggcagtgagcagggaacagtggggagaaagatgcatgggacagcctgcttggtgacaggcaaaaaccggtttgttgttcttttagagacagagtcttgctttgtcacccaggctggagtgtagtgatgtgatctctgcttactgcaaccctgcctctgggtacaagccattctcctgcctcagcctcttgagtagctgggattacaggcaacaattttaagtgaagtgaagtttcaggatctcgagcaaagttgtataacctataatcatattcaagattcacaggtcataaacgtgtcatattcttgggattgagcgacccattgcacagcatttagatgtgcttctagaatggagctcctccttcctatatggagggcagtttatatggtgtacttacctgaccaccaaaaagatttggctctaaaaaagcttcaggtggccgggcatggtggttcacccctgtaatccagcactttgggaggcaggtgggcagatcacctgaggtcagaagttcagacagctggacatatggtgaaacctcatctctactaaaaatacaaaaattagactgggcatggtagtgggcgcctgtaatcccagctagtcgggaggctgaggcaggagaatcccttcaactcggacggcagagtttgcagtgaggccgagatcgtgtcactgcagtccagcctgggtgacagagcaagactccatctcaaaaaaagtaaaaaaaaaaaaaagaaaaaaaaaagcttcagagccagcagggatcatgctgtaataaatacttaacatcaacactgatctttaaatgctttagcacaatcaaatataaataacaaacacacacataaatgcaaaataaatgaattagggagatagatgaaataagattgtggaaatagtaatgtttgttaaagctggatggtgatccttgtactattcactctactctagtgtgtatttgaaaattaccattaggctggttatggtggctcatgcctgttaatcccggcattttggaaggctgaggcaggcggattacttgagctcaggagtttagagtctgcctgggcaacatggcaaaatcccatctctacaaaaaattagctggcatgatggcacactcctgtagtcccagctccttgaggggctgaggcagagaatggcttgaacctgagaggctaaagctgcagtgagccaagatcatgccactgcactccagcctgggtgaccaagtgagaccctgtctcaaaaaaaaaaaaaaaaaaaagaaaagaaaattcccattaaagcacaaaggcccacttattgaagctattaaaatacaggttggggccggctgggcatcgcgtcacgcctgtaatcccagcactttggaaggccgaggtaggcgagtcacgagttcaggagatcgagaccatcctggctaacacggtgaaaccccatctctactaaaaatacaaaaaaaaaaatcagccgggcatggtggcgggagcctatagtcccagctactcgggaggctgaggcaggagaatggcatgagcccgggaggcggagcttgcagtgagccaaaatcacaccactgcactccagcctgggcaacagatcgagactccatctgaagaaaaaaaaaatacaggttgggaccacagtggctcatgcctgtaatcctagtactttgggagtccgaagtaggtggatcacctgaggtcaggactttgagaccagcctggccaacatggcaaaaccccatctctactaaaaaatatacaaaaattagctgggcgtggtggtgggtgcctgtaatcccagctactcaggaggctgaggcagaagaatcacaacaaccagggggatggtggttgcaatgagccaagatcatctccacttcactccggcccaggcaaaagagtgagagtcatcttaaaaaaaaaaaaaaaaaaaaaaaaaaaatacagattaggcattcctaatctgaaaaatttggctccaaaatgctccagtcgagcatttcctttgagtgtcatgtgggtgctcaaaaagttagatttttggaccattttcagatttcagagttttggattagggatgctcgactggtaagtaatcgagatattccaaaaatctggacaaatctgaaatccaaaatgcttggaatagcagatactcaactggtagcactccctggaagaatatgcaccaaactgatagcagtggttaccttctggtgaggaggggaaagaaccaagattagcagtaggatcaacatatattttaatgttttctgtatttttattacttgtataatttaaacattttaaattagtaataatgaacaatcatgaaactatggatgatttagtccagcaaaatatccaattgggaaccctcatccttctgcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggtgaggccttcaggaagttgggggaatgaaaaaggtggccttccacttctgggcccccgggatcctggaatcattaatggcaggaaggggttggaaagcctcaggactacagtaacactgcagagacactaatacttcttattcctggtcccaggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggtacttggaacggttgggagtgatggggtagcactgggagcagagcatagaggagtaaggtttggagaatagaatagtacctggaggtggcaagggagacgggaacaaatgtggggaaaggaggacagagtctggacttggggaatcactagcagagagaagggttgcatatacgtgacactgttgggaggatgctatggtgaaaagacaaagggctaagaaccccgaaggaggaggaaatactgtggacattggtggggagggtctagggcaataggtcattgagagtggttgaattggatcaatcctttctgtttacctttctgttagcccttttcccaggatcctacccagttggctgagatgatctttaacctccttctggaagaaaaaagaattttgatccaggctcagagggcccaattggtgaggacaattcagtggtaatgttggaaactcctgaagtagagaggaaccatggaaaggactcagggagttgtctcagaacaggatccccccgacatcctgtggtataatttcaggcctgaacttaaggcatgaaaggccagagttaaaacgtgctcagagcctcttttttcaggaacaaggagagccagttctcgaaacacctgtggagagccagcaacatgagattgaatcccggatcctggatttaagggctatgatggaggttagtagatgtggtaggagttagggttgacagtgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaatcgtgctttgtggaggctgagctggaggtgacagctgagagacagtaaattgttgaggaaatgcatggaaaactaacagtgttttatttgagggggtgtctggtccaagatgaccacttcagaatttgcctggagggtcccacaggtgcctgtgctttgcttggtttccctttcttcctccgccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggtgggaggcagcagaacagaacatgtgggcaacaaggacctgaaaaaatgagggatgttgggaaccctggtaatctagcgctggcttctttctttcttcatccccagttgggtggtggagggtgaaagggagagatgctcaacactcacattatctctttcccaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggtgagaggtaccaccccaaccctcgtcctcgccatgcgctgtgatttgtaagttgcagtgccctgcatatagcaagagatactgttctctatttgtctctgctccccagaatagagccctgctccctgcctgactgcagctctattctgcctcctcagcctcaccacgcagggaagcccagaagtcccagtctccttcagggaaaggaatgaattaacccacaatctggttttgcttcttttttttaatcacccagaaatatatatatatgtattttttttttactgcaacgaatacaatgacaagaaaggaagggaaggaaggaaggaagagaaaattacctattacctagcttattaaacaaaaatggaatcatattgtccatactattttgaaatccatggggttttttttaagcttaacagtattttatatatatatatatatatatatatatatatatatatatatatatatatatattttttttttttttttttttttttttttttgagacggagtctctctctgttccctggctggcggagcggagtcggcacgatctcagctcactgcaacttccaactcccacggttcaagccaattctcctgtctcagcctcccgagcctgggattaccaggcacacaccagcctggctagtttttttgattttttagtagagacgatgtttctccatgttggccaggctggtctcaaactcctgacttcaggtgatccacccaacttgggctcccaaagtgctgggattacaggcgtgacgaccatgcccggccaacagtatattatatttatccatgttatttcttatgtccacacaacagtcccctatatggtggtaacataatttaattaatgaactcctattttcagctatttaggttattttcaatttcttgttaccttttgccaggaaacgtatattttatggtaattatattgtgttgtagaaaaatcactagtctagtccaacttgcttgaaaaatagctactttttaactattttctcatttaaaaatttattataatttagtcttttagaaatataccaggccaggcatggcgtctcatgcctgttatcctagtactttggaaggctgaggacggaggatcacttcagtcttggggtttgagaccagcccgggaaacataacaagaccccatctctacaaaaaaaaaaaattgtttttaattaggcatgtccgacacagtggctcacacatgtggccagcactgtgggaaggccaaggtgggtggatcacttgagggtcaggagttcaagaccagcctggccaatgtggtgaaaccccatctctactaaaaatacaaaaatttgccaggtgtggtggcgcatgcctgtattcccagctactcaggaggctaaggcaggaaatcacttgaactcggaggcagaggttgcagtgagctgtgacaatgccactgtactccagcctgggtgacagagcgagctccgtctcaaaaaaaaaaaaaaaagattaggcatggtggcacacgcctgtagaccctagctactcaggaggctgaggtgggaggattgcttgagcccaggtgttggaggctgcagtgagccatgattataccactgtagtccagcctggacaacagaacgagaccctgtctctaaaagtatatatgtacacataccataatacccagctactgaggaggctgaggcagaaagagtgcttgagtccaggagtttgatgtcagcctgagcaatatagcaagaccctcacctcttaaaaaaatttaaagtagattaaaaaaataccacaattgctcaggtagattaaaaaaataccacaattgctcaggtagattattgaaaaacaggcatatagtacttatggtacaggaccagcatgcatgcatgcatgcattgattgattgattgattgattgattgagacagggtctctctctgtctcccaggctggagtgcctggccttaagtgatctgcccacctttgcttcccaaagtgctgagattacaggtgtgagccaccatgtcagctggcgaggctttttaaaagatagttccaagtgttacagctcttttaggatttgtctagcaggctttcaggtttttgccagaaaccacccccacccccaccaaaaaaaaaaaaaaaaaaaagatatgtacaagttcccagatagtgttcccaactgaatctatttctcatgtgtagtgtatggttgttttcctgtcaccacattgctgattattattatttttaattatagagacagtaaagtacagtagttaaaaatgtgagttggggctgggtgcagtggctcacacctgtaatcccagcactttgggaggccaaggtgggcggatcacctgaggtcaggagttcaagaccagcttggccaacatggcaaaaccccgtctcgactaaaaatatatatatataagttagccgggcgtggtggcaacattacctgtaatcccagctactcgggaggccaacaggcaggagaatctcttgaatccaggaggtggaggttgcagtgagccagatcacaccattgcactccagcctggatgacaagagagtgagactgtctaaaaaaaaaaaacaaagtgtgagttgtacaatgagactgcctgggatcacatacaagcttcatcccttactagttgtattgaccctaaagcaagtcactaacctttctgtgccctccagttttatcatctgtaatgtggggaaaataatagtacctgcctcagagggttgttttgaggattaaatgcattaatatgtggaaagggcttaatataagttgtacatagcatatgaaaactgttatgttaaatctattagcagttttatatgtgaaaatagctttgattttcatttcttggattatgaatcatgttgaataatcctttatatgcttcctggattctttttttttcttccccccagtcagtttctgactcttctcatatttatagagagatcttggaacctggatgggggaatccaggaaactcatggattccttcttcctgaattttatcacccaggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacaggtctagaggccaggcaggaaccctgggggaaagaaggaacaagggaagccattcttacacatactgagctatatattctctccacacctctctctcctcgagcctttgtggtagaaacccagccctgcatgccccaaactccccatcgacccctcatcctcaagactggcagcaagttcaccgtccgaacaaggttggcattccagaactcattcccacttcctttttccaaccctgccactgtgtattttctggctttacagctactgcccactcttggctttttcagtctttcctgaatctccctacctcgttgataccccatcgtcctctttttcaaacacctagcctatacaaaagccgactccgaccacatttccctataccccttgacttccccaggctgctggtgagactccaggaaggcaatgagtcactgactgtggaagtctccattgacaggtaaattggagcaggtgaagggtggccaggacacgggctgctggggtggaggagatactcactcttcacaacagggccctagggctatatccttcctccttccaatcctacctcacagaaattataattcatttcttttgttgaacacttactttgtgacatgcagcatgtcagctactcatttaattgtcacaccaaccccatgaataaactattaccagtgcactgtacaaacaaagatacaggcttagagagactgattacatctcttctcaaggccacatagctagtgagctcaagtcgggtttgaaccgaggtctgtctgatcccaaagacgaaactcctaacttccatactcttttgcccaatgattttttttaaatttatttcttttcaggaatcctcctcaattacaagggtaggtgcttgacaaggacactgcaaacatctgtacagtgtatgacctgcagaaccgggggatttgggaaatggacaaagggagatggcgagatctgaaatggaagtggaacttcagttttttttttttctgctgagtttttacaataattccattccttgtctccatgtatcttcctcctggaacagcttccggaagttcaacattctgacttcaaaccagaaaactttgacccccgagaaggggcagagtcagggtttgatttgggactttggttacctggtaagaatagtttgtgacctatgcttttattactatttttattttttcgagacggagtctcactctgtcccccaggctggagtgcagtggtgccatcttggctcacaggaacctccgccctccccggttcaagcaattcttctgtctcagcctcctgagtacgtagagctataggcagcacaccaccatgcccggctaatttttgtatttttagtagagatagggtttcaccatattggtcgggctggtctcgaactcctgacctcaggtgatccgacccgcctcagcctcccaaagtgctgggatcacaggcatgagccaccatagctggcctgcttttagtccaaaggaacaggggttgggggaagttcccagggcttgagaggtcttgaagccaaacaggggttccagggagactagggtgcccactctggcattttctctccttcccttcaattcacagactctggtggagcaacgttcaggtggttcaggaaagggcagcaataaggtgagatctggacagaggactcgaggcagggggagcttgccaaagagccttctgatgactatgtctttgcctgtcccagaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggagggttagcactcctttcctctaacaaatacctgcagctagaaacatcacatccctctctgtgactcctgtcttctccccacacacggacaccctccctgtggtgattatttccaacatgaaccagctctcaattgcctgggcttcagttctctggttcaatttgctcagcccaaaccttcaggtaggggagtggggccgacaggtcccggcgcgagagcaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcacatatctgtggctatctgtcccacagggcagaactgtaggactgaggatccattattgtcctgggctgacttcactaaggtaactccctgaatcctgtggagctgctggatctagccccacattccaaatactggccttcccacgtgccctccttccctacaccagaggcaactcctcagcttttgctacctttccattcctccagcgagagagccctcctggcaagttaccattctggacatggctggacaaaattctggagttggtacatgaccacctgaaggatctctggaatgatgggtaaggccttggtcacccttccctcatgggcttgtgcttccgggcttgagagtggagtctctgcaccctcacgtggcaagcagggagagagagcaaagcacggtgcaggccacgtctcctcacatttgttaagaataataaggccgggtgtggtggctcacacctgtaatcccagcactttgggaggccgaggcgggcggatcatgaggtcaggagatcgagaccatcctggctaacacggtgaaaccccgtctctactctaaaaatacaaaaaattagccgggcgtggaggcagacaccctgtagtcccagctactcaggaggctgaggcaggaaaatggcgtgaacctgggagatggagcttgcagtgagccgagattgcgtcactgccctccagccttggggtgacgtagcaagactccgtctcaaaaaaaaaaaaaaaaaacaaccaataatagccataaacagtgtttttgtgaagcactcctacattccagagcttgatgggtgctcttcattaattctctcatctcatccttacaaccatgctgagtggtgggttttgccagcttcatttcatgtgaggaaactgagtttcagagaagttaaagaacttacccaagggacacagttgatattcaaatccaggcctatgtgactccaagcccatgctctttccaccacactgcctaccaacttgtgtagcatttggcttttaaaagtgctattcatgaccaggcacgatggctcacgccttgtaatcccagcattttgggaggccgaggtgggtggatcacctgaggtcaggagtttgagaccagcctggccaacatggcgaaaccccatctctattaaaaatacaaaaattagccgggtgtggtggtgggcgcctgtaatcccagctactcaggaggctgaggaggagaatcgcttgaatttaggagagaaggttacagtgagccaagatcgtgccattgcactccagcctgggtgacagagcaagactctgtctcaaaacaaaaccaaaaaaaagtgctatttgtggccaggcgtggttgctcatgcctgtaatcctagcatttttggggaggctgaggagtacagatcacttgagcccaggagttcaaaactaccctgggccacgtggtgaaaccccaaaccccgtctctacgaaaaatacaaaagttagccaggatgggtggtgtgcacctgtggtcccagctactctggaggctgagaggtggggaagattgcttgagcccgggaggtcgaggtggcagtgagctgtgatcatgccactattctccagcctgggtgacagaatacaccctgtctccctgtctcccagaaaaaaaaaaaagtgctgttcatctgtgtgatctcactgaatcttcgtacttcaaaccctcggaaggtggctattgtcagcaaagtgaagtgacttgtaaaagataaaaaaaagctaagtggcagggcttggtccaaagcctggattccaaacctgggctgtttctccatacaaggggagcagggaggcaggggcctgggggggcagggtgttgggcggtgtcacacgtgacacactgtgctccagacgcatcatgggctttgtgagtcggagccaggagcgccggctgctgaagaagaccatgtctggcacctttctactgcgcttcagtgaatcgtcagaagggggcattacctgctcctgggtggagcaccaggatgatggtagctgctctgccctgccattcccacagcctctcctttctgcctggctctcctctggcccctctgcctgccttgcttcgctggctctgaactgaatgctcagtggtttgggactgggcagccagagagtcagagagctccaaggcccggcctcttccctcaagcccgcctgttcctgcattcactctccagacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaaggtgggaatcgttgacatacttcattgctagattgcagagatctaccagacatccatagatcccactccttcctttaaagcatgggaaaactgatatctagaggaattaagggattcgtccatgggatactgctggttactatggggatgagactgccaggaccatctgcactaggggaaaacctcaggctatatgtctggcccactgatcttctctgcttcttgtatatgttcctcacagttaatctccaggaacggaggaaatacctgaaacacaggctcattgtggtctctaatagagtgagatatgaactgttcattcatcctccctaatccttattggctctgcttcagtgaatcgtcaaaagggggcattaccttctcctgggtggagcaccaggatgatggtcagctgctctgccctgccattcccacagcctctcctttctgccttctcctaagctgcccctattccagtctccccagccttccctccctcctagccccactctagttttttctggttctagtctctcctatctcatatttttctgctgccatccttaggttgtctccacaggggtttctggataataatgatcataatcactggtgttaaggggtacctacttgatgcaagcatggagctttttttttttccagacagggttttgttctgtcgcccaggctggagtgcagtggtgtgatcctggctcactgcagcctcgacctcctgagctcaagcaatacaggcatgcatcaccaaactcagctaattttttttgtattttttgtagagatggggtcttaccatgttgacgcatcaggctgttctgaactcctggactcaagcaatccacccaccttggcctcccaaaagtcagggattacaggcgtgcgaccacaccccgcatatatatatttttttttttttttttttttttttttttttgagacagggtctctgttatccaggctggagttgcagtggataatatgactacgagccttgacctaggggttgaagcaatgctcctgcctcagccaccaagtgctgagactacaggcacacgccaatctacactcaatcacactcagctaattttttaaattttttgtagggatggggtatcactgtgtttgcccaggctggtcttgaactcctggcctcaagcagtctcctgccttggcctcccaaattgccgggattgtaggaatgagccatggcacttggctgggggatagaattttttttttttttttttttttttttttttttgagacagtctcactctcattgcccgggctggagtgcagtggtgcaatttcagctcactgcaacctctgcctcccaggctcaagcaattctcctgcctcagcctatagagtagctgggattacaggcgagcgccacccatgcctggttaatttttgttttttttttgagacagagtctcgccctgttgcccaggctggagtgcagtggcacgatctcagctcactgcaacctctgcctcccaggctcaagcaattctcctgcctcagcctcctgagtactgggactacaagcgcgcacaaccaccacacctggtaatttttgtatttttagtagagacagggttttaccatattggccaggctggtctcaaactcctgacctcatgatccgacccaccttggcctcccaaagtgcagggattacaggcgtgagcctctgcacccggcctaacttttgtatttttagtagaaacagggtttcaccatgttggccaggctggtcatgagctcctggcctcaagtgatctgcccgcctcagcctcccaaagtgcttggattacaggtgtgagccacctggcctgagagtttattatgcgccaggcactaggcaaatggtttgcatttattttctcattttattgaatctacaaaatagtcctgtgaagtaaacactgttactgttttcagctaaggaactggatttagagtagtcaagttttgtacctaaggtacgtggctaatgatacaggtctgttagattccgtagccctgattttaaccaccctactgcctctcaagaattactaggtattgttctcatttatagatgataaatctgaggctcagaaaagttaggccacttgcctaaggtcccccagccaggattcaaactccaggaggcctgattccaaacccatgctctttagccctccgccctactgccttcttagactagcttctgcttattctaccattcctgatttcatttgaaccactgagccctgcccctttgtctgtctttgggtatccaggcaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaagtaagtgatgagatggagtggcacacattccctttcctacctcttctccctctcccattacagaaaaagctgaactccaagctcctcattggagagaggtccatctgtgattcctttttttaggaattacacatgccttcccccacctccctgctctttcatcccacaagttcccactcaggctcttcccaggcctttcctgccatcctccctcccttgggctgctgggttgggaactcctaactaagatcggggcctcacttttctctctggattacctagtcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctctttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgccccctaagctggctgtacctgttcctcccccataaaatgatcctgccaatctaatgtgagtgtgaagtttgcacactagtttatgctacctagtctccactttctcaatgcttaggagacagatcactcctggaggctggggatggtaggattgctggggatttttttttttttaaagagggtctcactctgttgcccaggctagagtgcaatggtgcaatcacagctcactgcagcctcaacctcctgggttcaagcaatcctcctacctcagcctcctgggtagctagcaccatggcatcgccaccatgccctattttttttttttaaagacagggtcttgctatattgcccaggctggtcttgaactgggctcaagtgatcctcacgccttgcctcccaaagtgctgggattataggcatgagccactgtgcttggccaggatttttttttttttttttttgagatggagtttctctcttgttgtccaggctggagtgcaatggtgtgatccggggaattc

SEQ ID NO: 2627 - DNA, 2787 bp; single-stranded, linear
cagctggaattcggggcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcaccaaaaagtttcctacaaaggggaccccattgtacagcaccggccgatgctggaggagaggatcgtggagctgttcagaaacttaatgaaaagtgcctttgtggtggagcggcagccctgcatgcccatgcatcctgaccggcccctcgtcatcaagaccggcgtccagttcactactaaagtcaggttgctggtcaagttccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggtctcaagattgacctagagacccactccttgtcagttgtggtgatctccaacatctgtcagatgccaaatgcctgggcgtccatcctgtggtacaacatgctgaccaacaatcccaagaatgtgaacttcttcactaagccgccaattggaacctgggaccaagtggccgaggtgctcagctggcagttctcgtccaccaccaagcgggggctgagcatcgagcagctgacaacgctggctgagaagctcctagggcctggtgtgaactactcagggtgtcagatcacatgggctaacttctgcaaagaaaacatggctggcaagggcttctcctactgggtctggctagacaatatcatcgaccttgtgaaaaagtatatcttggccctttggaatgaagggtacatcatgggtttcatcagcaaggagcgggagcgggccatcttgagcactaagcccccaggcaccttcctgctgcgcttcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctgttgtctccacttgtctatctctatcctgacattcccaaggaggaggcattcgggaagtattgtcggccagagagccaggagcatcctgaagctgacccaggtagcgctgccccatacctgaagaccaagtttatctgtgtgacaccaacgacctgcagcaataccattgacctgccgatgtccccccgcgctttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatg

SEQ ID NO: 2628 - DNA, 219 bp; single-stranded, linear
cgacagcgaccagatcaaggaggaactgccggagccctttgagcatcttctgcagagaatcgcccggagacccaagcctcagcagttctttggattaatgggcaaacgggatgctggacatggccagatctctcacaaaagacataaaacagattcctttgttggactaatgggcaaaagagctttaaattctgtggcttatgaaaggagtgcaatgca

SEQ ID NO: 2629 - DNA, 1021 bp; single-stranded, linear
gagagtgcggagcgaccacgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttagggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttg

SEQ ID NO: 2630 - DNA, 1102 bp; single-stranded, linear
gcgccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaaaaaaaaaaaaaa

SEQ ID NO: 2631 - DNA, 2342 bp; single-stranded, linear
cgacagcgaccagatcaaggaggaactgccggagccctttgagcatcttctgcagagaatcgcccggagacccaagcctcagcagttctttggattaatgggcaaacgggatgctggacatggccagatctctcacaaaagacataaaacagattcctttgttggactaatgggcaaaagagctttaaattctgtggcttatgaaaggagtgcaatgcagagagtgcggagcgaccacgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttagggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttggcgccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaaaaaaaaaaaaaa

SEQ ID NO: 2632 - DNA, 1674 bp; single-stranded, linear
gaaaaagccttccaccctcctgtctggctttagaaggaccctgagccccaggcgccacgacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggat

SEQ ID NO: 2633 - DNA, 1766 bp; single-stranded, linear
aattcagagccaccgcgggcaggcgggcagtgcatccagaagcgtttatattctgagcgccagttcagctttcaaaaagagtgctgcccataaaaagccttccaccctcctgtctgctttagaaggaccctgagccccaggcgccagccacaggactctgctgcagaggggggttgtgtacagatagtaggctttacgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcctcaagagcccaatgcattccatttctggaagtgactttggctgcatgcgagtgctcatttcaggatg

SEQ ID NO: 2634 - DNA, 1268 bp; single-stranded, linear
gaaaaagccttccaccctcctgtctggctttagaaggaccctgagccccaggcgccacgacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggcatcctaaatgagtaaacccagctgtgagacaagagggacaagtggggactgcagctaacttatcatcacacaactcagcctggctgattatcaccatccaggaatgggagcccggagtagactgattttctttttttcttttcca

SEQ ID NO: 2635 - DNA, 373 bp; single-stranded, linear
atgctgagaaaggtagctgccaaaccttgactgcaataacaataacaaaaattaaaaacctaaaataataagtatatcatactgacctttcctgtttaccttgctgtaggtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtgagcaggggacaggcagaactaacccaccctggcacagacaacaggctgtcgagaagggatggcacacttgtgagccccagaggcagctagcacaaaatatccccaggtat

SEQ ID NO: 2636 - DNA, 2472 bp; single-stranded, linear
ggatccaatttttgcccggcataagtgtatagtaaatttcccagccttaaagcacttcccgagagatgctttgagcgctcgcggtaccagtgcgtaaacgccgctccccggctggcgcgggtgtgcgccaactccaacctgcgcgcaagtctgccggtgcgcgctccagtcccacagctccgagtccccgcagtgaaaggagggggcggtgcaccggggtagatgggcccctgaggactcccggggttcagttttccgcggctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataaactgacctaactcgaggaggagctggaatctctcgtgagagtaaggagaacggttccttctgacagaactgatgcgctggaattaaaatgcatgctcaaagcctaacctcacaaccttggctggggctttgggactgtaagcttagagactgtcacttcccaggtgaatcagctagccaggtaactgagctagatattttgtgggggtgtttcctaaacacagcctcaggaaagttgttttcgggacacctggaccagggagtcgtcgcctctggcttctcggtagctggagcgcggcccggagcgcggcgctggcacatcgcccccacacatgaccgtttcccattgccacaggcaagccgcctctgcagagctgtctcagggctctgggcttcattccctggaagttgattgtcctccactccagctgtttcccaaatccttccttcctcccagcacccctcgtgcaacgacgattccagctgcggaccgcatctgtgtcagttacttccaagccacctactgccccctcgcggagtgcgtggggctcccggctcgcagactcccacggcaagtagcaagcagcaaaaggcgtggtagctgcggcggtggaatgagacagttgtcaacagctggcgcacgtgccgccgtgcgcaccgggactggcgagtacgcagcccaggtactgccccttcccagtgacgtctctgcagggggttataaaagcctcgtgcgcagctaactcgcgagctgagcaacccgaaccgagaggtgcccgcgaaactgcaggcggcggcagcggcagcaaaagagaaggaaaaatctccagctggatacgaagctccagaatcctggccataggctcagaacttttacaggtcgcgctgcaatgggcccccacttcgctcctaagtcctcacgcagcacagggctttgcctttccctgcggaggaaggagaaataggagttgcaggcagcagcaggtgcataaatgcgggggatctcttgcttcctagaactgtgaccggtggaatttctttccctttttcagtttaccgcaagagagatgctgtctccagacttctgaactcaaacgtctcctgaagcttgaaagtggaggaattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtgagattagcctttgtgaaaaggcgagaaagtgctcatagaggaccatggcattgctgtgaggtttggaactgggtggggtatgggtcaagtggaagattggccactctgagggtttttttactgatca

SEQ ID NO: 2637 - DNA, 594 bp; single-stranded, linear
agaatatggaaaaggaattggaaaataattgtacaaatcatcaggaatcaaagggtttctatgaattttcttattggcaggaaaaatatggaatctctgatacagattttggtgaccagatcagaactttgttctttcttctctgttccaggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtgagtagagatgactccccatgccaaagaaacgatggtgcaggctgccttcctggccccttcttgctctttctttctttccatattcttttgttggtacagatttaatgtgtatctgcaagcatttctcacatataccctcatatcaggttgatatgtccacagttgtcaggggactatagtatcccaaatactattctgagcattgaaagataatttttgaagtgtaagatctagatcctgttata

SEQ ID NO: 2638 - DNA, 371 bp; single-stranded, linear
gagggggatgtgctggtggtctcacctgtctcaccctcttgccaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggcatctaaatgagtaaacccagctgtgagacaagagggacaagtggggactgcagctaactt

SEQ ID NO: 2639 - DNA, 3929 bp; single-stranded, linear
ccgtcccaaaggtcacctcttcatctgctcgctctccaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggatgaattctgcagcacagctgcggacccggaagactcattttcctggagccccgtgttacttcaataaagttatctcagattagcctcctgcagctggaggctcctatcaccccagcctacgcttgacagggtgaacaaaagaaggcaccacataacatctaaatgaaaaatttagccctgtcttctaagcatctgtgaaaagaaacatatgtattcccctttttggcatctcagtatttcagtacatttatacatcatgagattgagaacctcgggcttccacattatgtccccggtgactgtcctgagcagccgacgcaagcagaatatgtccactgatacctgctagttctcttacagaccaggaattgggagacttgcactacatttaatgtgtagttgaccctcttttcctacttgtaaacaaggggactgaactagataatctaagtgttccttcgaatcttaacatcccgtggttcaaggattgtatgagttttttgtttgttttacaaaaaaaaacaaaacgaagaataaaagaatagaaaagaataggagcagtgagtcttgtaactaatacccagttcctggagatgtagcaactgctaaggccatctgtaactatccatctcagacattctccgatttatcttaaaatcctgagtacattccttctcatggaaggttttggcttttgacagagcagaggacttcatgccaaggcctgcatccatccagctttagcaggcagaatttcatagctgcagaacactgtcagagaagacaaatgtgggctccctgctttaaccttttgggtattttagggtgggggccctaaccttcattcttagttttacactagcatcgtgctcatatgtgcgacaagcaagaaggctgcactttgcagctgcacttctgggaagagggcatcttgcatcttcccttcagactctctgaatgtctcctccctgctccatggctttgccagcttcctgtctctaaggggtagaatgactcatcaaccctaaaggacagtcagtcttccaagagccatgaactgaatgctttatatcctaatttagatttagagtttccagaaggtgagcatgcagttttgttttgtttttttttctgtctcccaaatctgtgttttttccagatatggctggaagcagaagcttcatgtaacatccatgaatgtcctcctggtagtttgcataatggatgcacatgtgccgcatccataacattaaggggagaataatgcatggtttacagcctttgccagccctgctggctctaattctaccagggcatccacaggcctgggggaagaagaaacagtataagccagaaaacctcaagaactacattctctaaagcagcatggaaagttttaaataaactaagtgaagccagatcattgcagatatataaatggaagacaaaatttagaagcaacaaaagttagtgccctaagcattagtcatacttccaatagagaatcttgctgtgtatggattactcactttggaagaatgtaaagagctaacatgattatgagaagtacctgagaagatggtgtcaagaagttggggacaccccatctatggaagagaaggttagagttgagctcaacgaggattaactgagtgcctcctctggactttgccctgaactgggaacacacagcccctgcagctcttgaagagcctaccttattggccatcactaactaactcaccagtcctagtgagtctaagctgcccagcagtcttggaggcatctgagaggacagattctccacagaattctaaaaacccacactcaacatgggcagtcaagcaaagactgggacctttggagagcctctggaatgagagttctctggggtacttccaaagggagctggcagtcagtccaggggacctaaaggaatttggttgaacagtatcatctctgtgcatagtaagagggaatgttgggtggtccgggcagtttccaatatggcaaagcatctgcttggacagtgccagcaagccttcctctgacccagtctccaatgtccactaacttataaaaatgtcatcaactcccacatgtgagaaacaccatgatttgtactgtgcatgggtcacattcttattctagaaatgcatcaccctgtgtttatccaagtgtgtttacttggtgtaatgtccagtagtaatagaatatgaaatatcaaggaaccatctttgttacgtgacttccaaaatgtgagatctcattgctgtcactgtgatatttgtattgtgtgaatctcttcctcctcttcctcctcatgctttctcagggaggagccctgatgtatatcatgaactcacagttcctagaccacagtaattgaggggcggtgggggggcctttatcggagaagctagagaacaagagtccttctcctccttatcccccaacaggacactaagagacaaggactgagtggaatcctggagaaaggggactcaggaactgacctcattggcctgatttgtgaggagaggagtataagtggagaggggccattcctgaggtttccgtgttttccagcctggtctcctggaaagaatctttatacagaaataaagtatgtgtttcactctctcgtgcctctgtctcttctctaggggtcctaaacatcctataggatgctaaatgggatggtactagaaaccctaataacttgcatagctagaaggatggaatcaatgttcagtaaactcttgactctgtgatgaaatgggttgggaagatgtgggaacagttcccaggttgagatctgggaagggaggtgggattatgcgaaatcacagtgatgttgcctatgaataaagctgtgtcaggatgcagacacaacagagttataagcacaagggagttttcgtaggacaggaggttggggggaataacatctgagaaagacaaaggggaaagaaagcagaagtactcagggacagccttcagaccaccatgccaatctgacacctgggaaaaaaggggtggttaggaagagcctcagactgtggtgcagctcccagcccaacacgtgcaaagattgcccagagagacattgcacgttaacagaatggccaggcctgatgccctgccgtgctcagccgctggctggggctctctagggaaagtgttctgtgtttgaacaccatggtggatgctgaagccctgcagctggaggctgtcagccaagtgccctgcagttcttcctaaagaggga

SEQ ID NO: 2640 - DNA, 12447 bp; single-stranded, linear
gaaaaagccttccaccctcctgtctggctttagaaggaccctgagccccaggcgccacgacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggataattcagagccaccgcgggcaggcgggcagtgcatccagaagcgtttatattctgagcgccagttcagctttcaaaaagagtgctgcccataaaaagccttccaccctcctgtctgctttagaaggaccctgagccccaggcgccagccacaggactctgctgcagaggggggttgtgtacagatagtaggctttacgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcctcaagagcccaatgcattccatttctggaagtgactttggctgcatgcgagtgctcatttcaggatggaaaaagccttccaccctcctgtctggctttagaaggaccctgagccccaggcgccacgacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggcatcctaaatgagtaaacccagctgtgagacaagagggacaagtggggactgcagctaacttatcatcacacaactcagcctggctgattatcaccatccaggaatgggagcccggagtagactgattttctttttttcttttccaatgctgagaaaggtagctgccaaaccttgactgcaataacaataacaaaaattaaaaacctaaaataataagtatatcatactgacctttcctgtttaccttgctgtaggtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtgagcaggggacaggcagaactaacccaccctggcacagacaacaggctgtcgagaagggatggcacacttgtgagccccagaggcagctagcacaaaatatccccaggtatggatccaatttttgcccggcataagtgtatagtaaatttcccagccttaaagcacttcccgagagatgctttgagcgctcgcggtaccagtgcgtaaacgccgctccccggctggcgcgggtgtgcgccaactccaacctgcgcgcaagtctgccggtgcgcgctccagtcccacagctccgagtccccgcagtgaaaggagggggcggtgcaccggggtagatgggcccctgaggactcccggggttcagttttccgcggctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataaactgacctaactcgaggaggagctggaatctctcgtgagagtaaggagaacggttccttctgacagaactgatgcgctggaattaaaatgcatgctcaaagcctaacctcacaaccttggctggggctttgggactgtaagcttagagactgtcacttcccaggtgaatcagctagccaggtaactgagctagatattttgtgggggtgtttcctaaacacagcctcaggaaagttgttttcgggacacctggaccagggagtcgtcgcctctggcttctcggtagctggagcgcggcccggagcgcggcgctggcacatcgcccccacacatgaccgtttcccattgccacaggcaagccgcctctgcagagctgtctcagggctctgggcttcattccctggaagttgattgtcctccactccagctgtttcccaaatccttccttcctcccagcacccctcgtgcaacgacgattccagctgcggaccgcatctgtgtcagttacttccaagccacctactgccccctcgcggagtgcgtggggctcccggctcgcagactcccacggcaagtagcaagcagcaaaaggcgtggtagctgcggcggtggaatgagacagttgtcaacagctggcgcacgtgccgccgtgcgcaccgggactggcgagtacgcagcccaggtactgccccttcccagtgacgtctctgcagggggttataaaagcctcgtgcgcagctaactcgcgagctgagcaacccgaaccgagaggtgcccgcgaaactgcaggcggcggcagcggcagcaaaagagaaggaaaaatctccagctggatacgaagctccagaatcctggccataggctcagaacttttacaggtcgcgctgcaatgggcccccacttcgctcctaagtcctcacgcagcacagggctttgcctttccctgcggaggaaggagaaataggagttgcaggcagcagcaggtgcataaatgcgggggatctcttgcttcctagaactgtgaccggtggaatttctttccctttttcagtttaccgcaagagagatgctgtctccagacttctgaactcaaacgtctcctgaagcttgaaagtggaggaattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtgagattagcctttgtgaaaaggcgagaaagtgctcatagaggaccatggcattgctgtgaggtttggaactgggtggggtatgggtcaagtggaagattggccactctgagggtttttttactgatcaagaatatggaaaaggaattggaaaataattgtacaaatcatcaggaatcaaagggtttctatgaattttcttattggcaggaaaaatatggaatctctgatacagattttggtgaccagatcagaactttgttctttcttctctgttccaggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtgagtagagatgactccccatgccaaagaaacgatggtgcaggctgccttcctggccccttcttgctctttctttctttccatattcttttgttggtacagatttaatgtgtatctgcaagcatttctcacatataccctcatatcaggttgatatgtccacagttgtcaggggactatagtatcccaaatactattctgagcattgaaagataatttttgaagtgtaagatctagatcctgttatagagggggatgtgctggtggtctcacctgtctcaccctcttgccaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggcatctaaatgagtaaacccagctgtgagacaagagggacaagtggggactgcagctaacttccgtcccaaaggtcacctcttcatctgctcgctctccaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggatgaattctgcagcacagctgcggacccggaagactcattttcctggagccccgtgttacttcaataaagttatctcagattagcctcctgcagctggaggctcctatcaccccagcctacgcttgacagggtgaacaaaagaaggcaccacataacatctaaatgaaaaatttagccctgtcttctaagcatctgtgaaaagaaacatatgtattcccctttttggcatctcagtatttcagtacatttatacatcatgagattgagaacctcgggcttccacattatgtccccggtgactgtcctgagcagccgacgcaagcagaatatgtccactgatacctgctagttctcttacagaccaggaattgggagacttgcactacatttaatgtgtagttgaccctcttttcctacttgtaaacaaggggactgaactagataatctaagtgttccttcgaatcttaacatcccgtggttcaaggattgtatgagttttttgtttgttttacaaaaaaaaacaaaacgaagaataaaagaatagaaaagaataggagcagtgagtcttgtaactaatacccagttcctggagatgtagcaactgctaaggccatctgtaactatccatctcagacattctccgatttatcttaaaatcctgagtacattccttctcatggaaggttttggcttttgacagagcagaggacttcatgccaaggcctgcatccatccagctttagcaggcagaatttcatagctgcagaacactgtcagagaagacaaatgtgggctccctgctttaaccttttgggtattttagggtgggggccctaaccttcattcttagttttacactagcatcgtgctcatatgtgcgacaagcaagaaggctgcactttgcagctgcacttctgggaagagggcatcttgcatcttcccttcagactctctgaatgtctcctccctgctccatggctttgccagcttcctgtctctaaggggtagaatgactcatcaaccctaaaggacagtcagtcttccaagagccatgaactgaatgctttatatcctaatttagatttagagtttccagaaggtgagcatgcagttttgttttgtttttttttctgtctcccaaatctgtgttttttccagatatggctggaagcagaagcttcatgtaacatccatgaatgtcctcctggtagtttgcataatggatgcacatgtgccgcatccataacattaaggggagaataatgcatggtttacagcctttgccagccctgctggctctaattctaccagggcatccacaggcctgggggaagaagaaacagtataagccagaaaacctcaagaactacattctctaaagcagcatggaaagttttaaataaactaagtgaagccagatcattgcagatatataaatggaagacaaaatttagaagcaacaaaagttagtgccctaagcattagtcatacttccaatagagaatcttgctgtgtatggattactcactttggaagaatgtaaagagctaacatgattatgagaagtacctgagaagatggtgtcaagaagttggggacaccccatctatggaagagaaggttagagttgagctcaacgaggattaactgagtgcctcctctggactttgccctgaactgggaacacacagcccctgcagctcttgaagagcctaccttattggccatcactaactaactcaccagtcctagtgagtctaagctgcccagcagtcttggaggcatctgagaggacagattctccacagaattctaaaaacccacactcaacatgggcagtcaagcaaagactgggacctttggagagcctctggaatgagagttctctggggtacttccaaagggagctggcagtcagtccaggggacctaaaggaatttggttgaacagtatcatctctgtgcatagtaagagggaatgttgggtggtccgggcagtttccaatatggcaaagcatctgcttggacagtgccagcaagccttcctctgacccagtctccaatgtccactaacttataaaaatgtcatcaactcccacatgtgagaaacaccatgatttgtactgtgcatgggtcacattcttattctagaaatgcatcaccctgtgtttatccaagtgtgtttacttggtgtaatgtccagtagtaatagaatatgaaatatcaaggaaccatctttgttacgtgacttccaaaatgtgagatctcattgctgtcactgtgatatttgtattgtgtgaatctcttcctcctcttcctcctcatgctttctcagggaggagccctgatgtatatcatgaactcacagttcctagaccacagtaattgaggggcggtgggggggcctttatcggagaagctagagaacaagagtccttctcctccttatcccccaacaggacactaagagacaaggactgagtggaatcctggagaaaggggactcaggaactgacctcattggcctgatttgtgaggagaggagtataagtggagaggggccattcctgaggtttccgtgttttccagcctggtctcctggaaagaatctttatacagaaataaagtatgtgtttcactctctcgtgcctctgtctcttctctaggggtcctaaacatcctataggatgctaaatgggatggtactagaaaccctaataacttgcatagctagaaggatggaatcaatgttcagtaaactcttgactctgtgatgaaatgggttgggaagatgtgggaacagttcccaggttgagatctgggaagggaggtgggattatgcgaaatcacagtgatgttgcctatgaataaagctgtgtcaggatgcagacacaacagagttataagcacaagggagttttcgtaggacaggaggttggggggaataacatctgagaaagacaaaggggaaagaaagcagaagtactcagggacagccttcagaccaccatgccaatctgacacctgggaaaaaaggggtggttaggaagagcctcagactgtggtgcagctcccagcccaacacgtgcaaagattgcccagagagacattgcacgttaacagaatggccaggcctgatgccctgccgtgctcagccgctggctggggctctctagggaaagtgttctgtgtttgaacaccatggtggatgctgaagccctgcagctggaggctgtcagccaagtgccctgcagttcttcctaaagaggga

SEQ ID NO: 2641 - DNA, 5441 bp; single-stranded, linear
gggtctcaaggaatctttattctgcgtcttcattctgaactggatggaaccttcctgagcgcagagtcctttccactgtgaattatgggtttgttatcgtttttgttcgttgctggttgtacgtgacgggagttcagctttttgctgcgggacggcagagataggatgcggggcttcctgagaggcgccggggcagggccgcacaggtccatccacctcccctgggaccccagccctgcagcagccccaggggagcggccggggatcggggcggggtgcccaggacgcgccctgattggcccagtgttagccaatcaaggctctcgcatccccatggtgctgattggtccgcctcccaggcctgacccaatcggagcattcctaggaggagcggccccagagcgcctgactcgggggtcccagagccctctgcacaccacagccccggtgtccccgtgtgtccctgggttctcccagccctggtgtcccctgagtctcttcttcaccgtcagccctggtgtctcccgtgtccctgccacaccctcatccctggtgtcccccgtcaccccatcccctcacctcctgggctcctgaaggtcccatcttgtgggcctcattcatggaaccaggacggggcaggtggaggcctctggggagtttgtccagagaatggaggagaagcagggtcatgagcaggagcggtctgggccacccctgcctgtcccccggggggtgcagcccggaaggagtccagatggatatggccccgcagtgcagagtcagccccaaaccaggctggtcccaggcagggtgggggcaggaggagccccggagtggccctgtgttgggggtcggggggcaggcagggggtcctggggctcagaagcggaggaggtgggctggaggccccagtgaccaacaggcccacgggagtcgggaggtggggtggacggacctgcagggacagtgtcagcgctgaatgggatggagagcacagggagctggggccggggatgagaccatggggagctggggctggggctgggactagtccatggggagctggggctgaagttgggggtgagtccatggggagctgggctgggcctcctggggttgcacctgcactcctctctgctcttccctctgcgtatgaagctcagatcccatgataaggaggcacctgcagaccaggggacctgcacggacagccccagaggtggacattgaggactcgtaggaggacttgggtctcatacggcgggtggggagcagggccccttcctggctgaggacacttggtgctgtcccctctcaaggctgtttccccatctgacaaaggggtctcatgtgagcccccaaccaagtgagtcgaggagggctggccccacccccgtggatttggagtccgtaggaggggtgtcacccgtcacgtccccaccccgtgggcaccttcccgtctcttggagcgtggcccatggacatgagttcctcacccgtgtccctcttggggaaacaggtttcaggagcgacgggtcttgtagcctggggcagccaggccacctgggtgcagctatgcctgaaggcctcctggcaccgagacaggggcaggagcagatcccaccagcgggaaggtggtgcgttctgatgctgggatccaccagctgacaggtggagctgcgagcctccagtgctcagccctcggcggggcctgcctggcagccccacacacagagggcatcggggtggcgggggcacgtgttacacgggggccctgggtctgagtcatccacttcctccgagtctggatgggaggacccagcgcccctcctccgccccctcctgatctggaaggataaatggggaggggagagcccgctgggtagaaggaacagggagtggccagggtaagtccctactctcagagaccctgacatcagtgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgagcctgctgctgctggcgctgcccgtcctggcgagcccggcctacgcggcccctggtgagtcccagccggggtccaccctgcccctcaccacattccacaggtcagggcctgggtgggttctggggaggctgggctggcccccacacagggaagggctgggcccaggcgtggggctgcttcctggtcctgacctggcacctgccccagccccagtccaggccctgcagcaagcgggtatcgtcgggggtcaggaggcccccaggagcaagtggccctggcaggtgagcctgagagtccgcgaccgatactggatgcacttctgtgggggctccctcatccacccccagtgggtgctgaccgcggcgcactgcctgggaccgtgagtctcccagggcctggaggggtgggcaagggctggatgtgagccctggctcccgggtgctcctgggggctgcccagggccctgagtgggatcctccgctgcccagggacgtcaaggatctggccaccctcagggtgcaactgcgggagcagcacctctactaccaggaccagctgctgccggtcagcaggatcatcgtgcacccacagttctacatcatccagactggagcggatatcgccctgctggagctggaggagcccgtgaacatctccagccgcgtccacacggtcatgctgccccctgcctcggagaccttccccccggggatgccgtgctgggtcactggctggggcgatgtggacaatgatggtgggtctggggacagtgggaggtggggccagggtcttagccacagcccagcccctgggctccaggtgggggttgcccggccccctcctcaggctgcaccctcttccccacctgcagagcccctcccaccgccatttcccctgaagcaggtgaaggtccccataatggaaaaccacatttgtgacgcaaaataccaccttggcgcctacacgggagacgacgtccgcatcatccgtgacgacatgctgtgtgccgggaacacccggagggactcatgccaggtgggccccgcgtgtcccccgccccccgcaccccaacccccactcccaggcctgttcggcgagcgctgacctctgaccttcccagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgcgaggtcctagccctcaaggcacagccagtcaccgtgggacggggcctcctgggcagccctggtccccggggctggcttctccccacacgatgcatccagcattcgggtcacacagagccactcgggcaactcagttgattataaaggacagccaagtccctgcaaccgggtcaagacagagaatggtcgccgggagccccagggctgcccatcacgagcccctaccccacgcttcccacgagctcttctcccggcccctctgtccactgcttgtgctttgccctagttgtttgctttgagacaggatctcgctgtgtcatccaggctgaagtgcagtggtgtgatcagggctcactgtagccttgaactcctgggctcaagcgatcctcccatcttggcctcccatatagctgggccacaggagtgagccaccacgcccagttaatttttgtattttcagtagagatggggtttcgccatgttggccagtctggtctcgaactcctgacctcaagtgatctgcccgcctcggcctcccaaagtgctgggatgacaggcgtgagccaccgcacccagcctgagtttgacattttcaaattcattttgaggtctttctctacatcaatacatgagccctccgcgtccggcgagtgttgcattttatcccgggctcttgtttgcattttatatttgaacatgattacattcaggaatgaaatgcggggctgttctggttgaaaacaactctctaaagaaacattcactctttccttccaactgtcagatgcagagatgtgcatttagtctctccaatctctgcaaatgacctctgtcctcacaaggggtggactcgacttccagcgccctctccagccccacgtgacctctgcctctgcagcccctgaaggcccatccctcggctcctgttctgcaggcccagcgtcttgtctatgaagatggacctggaactcgggccctccttcctccctctggcccatcccaccttctagggatcacagagacagcacggggtgacccccagggaacactgagcccctagaagcacttccacacgcccactggaggttttgcggggtgggagtcggagggatgagaccccgaagggaagcaagacggcccctcaggacagggctgccggtgtaaggaaaggtggacagcaggggccggtcactgggtggagggggagggcaggctccagccccagagcttcccaaattagatctaagatccctgggaagctcagtgaagctcagcgcagtgacactggcagatgtgagcgtcagcttcagcaggaagggtctctcaggacgtgacaggcaggctgctggccagggctgcagccacctgcgttttgactgggacgggggcacctgatccaaggtcacccacgtggctgccggcaggaggccctggttccccgtcacaagggggtgtgagggggaaggccaagtggtggccacanggttnccaccgagagggacagtgcccaagttggccaagccaccctnggacaagaaacaatnccaagtcttnccaaggtccttggacaacaaggagaancccccccagcttgggggcnattaaccaagggccangnccccccttcccggttc

SEQ ID NO: 2642 - DNA, 388 bp; single-stranded, linear
tggacccaccccggtccccccgtcccagcttccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggccgggctggcccccacacagggaagggctgggcccaggcctggggctgcttcctggtcctgacctggcacctgccccagccccaggccaggccctgcagcgagtgggcatcgttgggggtcaggaggcccccaggagc

SEQ ID NO: 2643 - DNA, 1167 bp; single-stranded, linear
cagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcgtgtcccccgccccccgcaccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacaagccagtcaccgtgggacggggcctctgggcagccctggtccccgagctggctt

SEQ ID NO: 2644 - DNA, 1143 bp; single-stranded, linear
ccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggtgtgccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgctccggccctcccctgcccaggcagctggtggtgggcgctaatcctcctgagtgctggacctcattaaagtgcatggaaatca

SEQ ID NO: 2645 - DNA, 1145 bp; single-stranded, linear
ggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaa

SEQ ID NO: 2646 - DNA, 1137 bp; single-stranded, linear
tgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatc

SEQ ID NO: 2647 - DNA, 2197 bp; single-stranded, linear
accagctgacaggtggagctgccagtctccagtgctcagccctcagcggggcctgcctggcagccccacacacagagggcatcggggtggcgggggcacgtgttacacgggggccctgggtctgagtcatccacttcctccgagtctggatgggaggacccagcgcccctcctccgccccctcctgatctggaaggataaatggggaggggagagccactgggtagaaggaacagggagtggccagggtaagtccccactctcagagaccctgacatcagcgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggccccccacacagggaagggctgggcccaggcctggggctgcttcctggtcctgacctggcacctgccccagccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccgtgagtctcccggggcctggaggggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggtccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacagccagtcaccgtgggac

SEQ ID NO: 2648 - DNA, 1154 bp; single-stranded, linear
ggaattccgtggccaggatgctgagcctgctgctgctggcgctgcccgtcctggcgagccgcgcctacgcggcccctgccccagtccaggccctgcagcaagcgggtatcgtcgggggtcaggaggcccccaggagcaagtggccctggcaggtgagcctgagagtccgcgaccgatactggatgcacttctgcgggggctccctcatccacccccagtgggtgctgaccgcggcgcactgcctgggaccggacgtcaaggatctggccaccctcagggtgcaactgcgggagcagcacctctactaccaggaccagctgctgccagtcagcaggatcatcgtgcacccacagttctacatcatccagactggagcggatatcgccctgctggagctggaggagcccgtgaacatctccagccgcgtccacacggtcatgctgccccctgcctcggagaccttccccccggggatgccgtgctgggtcactggctggggcgatgtggacaatgatgagcccctcccaccgccatttcccctgaagcaggtgaaggtccccataatggaaaaccacatttgtgacgcaaaataccaccttggcgcctacacgggagacgacgtccgcatcatccgtgacgacatgctgtgtgccgggaacagccagagggactcctgcaagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctgggtgtgccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgctccggccctcccctgcccaggcagctggtggtgggcgctaatcctcctgagtgctggacctcattaaagtgcatggaaatc

SEQ ID NO: 2649 - DNA, 1081 bp; single-stranded, linear
gctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccagcccctcctgtccaaaacaccactgcttcctacccaggcggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcc

SEQ ID NO: 2650 - DNA, 2280 bp; single-stranded, linear
atctggaagcataaatggggaggggagagcccactgggtagaaggaacagggagcggccagggtaagtccccactctcagagaccctgacatcagcgtcacctggagcagagtggcccagcttcagactcagagcaccaagacccaggcctgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggcccccacacagggaagggctgggcccaggcctggggctgcttcctggtcctgacctggcacctgccccagccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccgtgagtctcccggggcctggaggggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacagccagtcaccgtgggacggggcctcctgggcagccctggtccccgaggctggcttctccccacacgatgcatccagcattcgggtcacacagagccactcgggcaactcagttgattataaaggacagccaggtccctgcaaccgggtcaagacagaaatggtcaccgggaaccccagggctgcccatcacgagcccctaccccacgcttcccacgagctcttctcccggccctcccgtccatgcttgtgctttgcctaattgtttgcttttgagaacgggattg

SEQ ID NO: 2651 - DNA, 17133 bp; single-stranded, linear
gggtctcaaggaatctttattctgcgtcttcattctgaactggatggaaccttcctgagcgcagagtcctttccactgtgaattatgggtttgttatcgtttttgttcgttgctggttgtacgtgacgggagttcagctttttgctgcgggacggcagagataggatgcggggcttcctgagaggcgccggggcagggccgcacaggtccatccacctcccctgggaccccagccctgcagcagccccaggggagcggccggggatcggggcggggtgcccaggacgcgccctgattggcccagtgttagccaatcaaggctctcgcatccccatggtgctgattggtccgcctcccaggcctgacccaatcggagcattcctaggaggagcggccccagagcgcctgactcgggggtcccagagccctctgcacaccacagccccggtgtccccgtgtgtccctgggttctcccagccctggtgtcccctgagtctcttcttcaccgtcagccctggtgtctcccgtgtccctgccacaccctcatccctggtgtcccccgtcaccccatcccctcacctcctgggctcctgaaggtcccatcttgtgggcctcattcatggaaccaggacggggcaggtggaggcctctggggagtttgtccagagaatggaggagaagcagggtcatgagcaggagcggtctgggccacccctgcctgtcccccggggggtgcagcccggaaggagtccagatggatatggccccgcagtgcagagtcagccccaaaccaggctggtcccaggcagggtgggggcaggaggagccccggagtggccctgtgttgggggtcggggggcaggcagggggtcctggggctcagaagcggaggaggtgggctggaggccccagtgaccaacaggcccacgggagtcgggaggtggggtggacggacctgcagggacagtgtcagcgctgaatgggatggagagcacagggagctggggccggggatgagaccatggggagctggggctggggctgggactagtccatggggagctggggctgaagttgggggtgagtccatggggagctgggctgggcctcctggggttgcacctgcactcctctctgctcttccctctgcgtatgaagctcagatcccatgataaggaggcacctgcagaccaggggacctgcacggacagccccagaggtggacattgaggactcgtaggaggacttgggtctcatacggcgggtggggagcagggccccttcctggctgaggacacttggtgctgtcccctctcaaggctgtttccccatctgacaaaggggtctcatgtgagcccccaaccaagtgagtcgaggagggctggccccacccccgtggatttggagtccgtaggaggggtgtcacccgtcacgtccccaccccgtgggcaccttcccgtctcttggagcgtggcccatggacatgagttcctcacccgtgtccctcttggggaaacaggtttcaggagcgacgggtcttgtagcctggggcagccaggccacctgggtgcagctatgcctgaaggcctcctggcaccgagacaggggcaggagcagatcccaccagcgggaaggtggtgcgttctgatgctgggatccaccagctgacaggtggagctgcgagcctccagtgctcagccctcggcggggcctgcctggcagccccacacacagagggcatcggggtggcgggggcacgtgttacacgggggccctgggtctgagtcatccacttcctccgagtctggatgggaggacccagcgcccctcctccgccccctcctgatctggaaggataaatggggaggggagagcccgctgggtagaaggaacagggagtggccagggtaagtccctactctcagagaccctgacatcagtgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgagcctgctgctgctggcgctgcccgtcctggcgagcccggcctacgcggcccctggtgagtcccagccggggtccaccctgcccctcaccacattccacaggtcagggcctgggtgggttctggggaggctgggctggcccccacacagggaagggctgggcccaggcgtggggctgcttcctggtcctgacctggcacctgccccagccccagtccaggccctgcagcaagcgggtatcgtcgggggtcaggaggcccccaggagcaagtggccctggcaggtgagcctgagagtccgcgaccgatactggatgcacttctgtgggggctccctcatccacccccagtgggtgctgaccgcggcgcactgcctgggaccgtgagtctcccagggcctggaggggtgggcaagggctggatgtgagccctggctcccgggtgctcctgggggctgcccagggccctgagtgggatcctccgctgcccagggacgtcaaggatctggccaccctcagggtgcaactgcgggagcagcacctctactaccaggaccagctgctgccggtcagcaggatcatcgtgcacccacagttctacatcatccagactggagcggatatcgccctgctggagctggaggagcccgtgaacatctccagccgcgtccacacggtcatgctgccccctgcctcggagaccttccccccggggatgccgtgctgggtcactggctggggcgatgtggacaatgatggtgggtctggggacagtgggaggtggggccagggtcttagccacagcccagcccctgggctccaggtgggggttgcccggccccctcctcaggctgcaccctcttccccacctgcagagcccctcccaccgccatttcccctgaagcaggtgaaggtccccataatggaaaaccacatttgtgacgcaaaataccaccttggcgcctacacgggagacgacgtccgcatcatccgtgacgacatgctgtgtgccgggaacacccggagggactcatgccaggtgggccccgcgtgtcccccgccccccgcaccccaacccccactcccaggcctgttcggcgagcgctgacctctgaccttcccagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgcgaggtcctagccctcaaggcacagccagtcaccgtgggacggggcctcctgggcagccctggtccccggggctggcttctccccacacgatgcatccagcattcgggtcacacagagccactcgggcaactcagttgattataaaggacagccaagtccctgcaaccgggtcaagacagagaatggtcgccgggagccccagggctgcccatcacgagcccctaccccacgcttcccacgagctcttctcccggcccctctgtccactgcttgtgctttgccctagttgtttgctttgagacaggatctcgctgtgtcatccaggctgaagtgcagtggtgtgatcagggctcactgtagccttgaactcctgggctcaagcgatcctcccatcttggcctcccatatagctgggccacaggagtgagccaccacgcccagttaatttttgtattttcagtagagatggggtttcgccatgttggccagtctggtctcgaactcctgacctcaagtgatctgcccgcctcggcctcccaaagtgctgggatgacaggcgtgagccaccgcacccagcctgagtttgacattttcaaattcattttgaggtctttctctacatcaatacatgagccctccgcgtccggcgagtgttgcattttatcccgggctcttgtttgcattttatatttgaacatgattacattcaggaatgaaatgcggggctgttctggttgaaaacaactctctaaagaaacattcactctttccttccaactgtcagatgcagagatgtgcatttagtctctccaatctctgcaaatgacctctgtcctcacaaggggtggactcgacttccagcgccctctccagccccacgtgacctctgcctctgcagcccctgaaggcccatccctcggctcctgttctgcaggcccagcgtcttgtctatgaagatggacctggaactcgggccctccttcctccctctggcccatcccaccttctagggatcacagagacagcacggggtgacccccagggaacactgagcccctagaagcacttccacacgcccactggaggttttgcggggtgggagtcggagggatgagaccccgaagggaagcaagacggcccctcaggacagggctgccggtgtaaggaaaggtggacagcaggggccggtcactgggtggagggggagggcaggctccagccccagagcttcccaaattagatctaagatccctgggaagctcagtgaagctcagcgcagtgacactggcagatgtgagcgtcagcttcagcaggaagggtctctcaggacgtgacaggcaggctgctggccagggctgcagccacctgcgttttgactgggacgggggcacctgatccaaggtcacccacgtggctgccggcaggaggccctggttccccgtcacaagggggtgtgagggggaaggccaagtggtggccacanggttnccaccgagagggacagtgcccaagttggccaagccaccctnggacaagaaacaatnccaagtcttnccaaggtccttggacaacaaggagaancccccccagcttgggggcnattaaccaagggccangnccccccttcccggttctggacccaccccggtccccccgtcccagcttccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggccgggctggcccccacacagggaagggctgggcccaggcctggggctgcttcctggtcctgacctggcacctgccccagccccaggccaggccctgcagcgagtgggcatcgttgggggtcaggaggcccccaggagccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcgtgtcccccgccccccgcaccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacaagccagtcaccgtgggacggggcctctgggcagccctggtccccgagctggcttccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggtgtgccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgctccggccctcccctgcccaggcagctggtggtgggcgctaatcctcctgagtgctggacctcattaaagtgcatggaaatcaggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaatgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatcaccagctgacaggtggagctgccagtctccagtgctcagccctcagcggggcctgcctggcagccccacacacagagggcatcggggtggcgggggcacgtgttacacgggggccctgggtctgagtcatccacttcctccgagtctggatgggaggacccagcgcccctcctccgccccctcctgatctggaaggataaatggggaggggagagccactgggtagaaggaacagggagtggccagggtaagtccccactctcagagaccctgacatcagcgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggccccccacacagggaagggctgggcccaggcctggggctgcttcctggtcctgacctggcacctgccccagccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccgtgagtctcccggggcctggaggggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggtccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacagccagtcaccgtgggacggaattccgtggccaggatgctgagcctgctgctgctggcgctgcccgtcctggcgagccgcgcctacgcggcccctgccccagtccaggccctgcagcaagcgggtatcgtcgggggtcaggaggcccccaggagcaagtggccctggcaggtgagcctgagagtccgcgaccgatactggatgcacttctgcgggggctccctcatccacccccagtgggtgctgaccgcggcgcactgcctgggaccggacgtcaaggatctggccaccctcagggtgcaactgcgggagcagcacctctactaccaggaccagctgctgccagtcagcaggatcatcgtgcacccacagttctacatcatccagactggagcggatatcgccctgctggagctggaggagcccgtgaacatctccagccgcgtccacacggtcatgctgccccctgcctcggagaccttccccccggggatgccgtgctgggtcactggctggggcgatgtggacaatgatgagcccctcccaccgccatttcccctgaagcaggtgaaggtccccataatggaaaaccacatttgtgacgcaaaataccaccttggcgcctacacgggagacgacgtccgcatcatccgtgacgacatgctgtgtgccgggaacagccagagggactcctgcaagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctgggtgtgccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgctccggccctcccctgcccaggcagctggtggtgggcgctaatcctcctgagtgctggacctcattaaagtgcatggaaatcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccagcccctcctgtccaaaacaccactgcttcctacccaggcggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatccatctggaagcataaatggggaggggagagcccactgggtagaaggaacagggagcggccagggtaagtccccactctcagagaccctgacatcagcgtcacctggagcagagtggcccagcttcagactcagagcaccaagacccaggcctgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggcccccacacagggaagggctgggcccaggcctggggctgcttcctggtcctgacctggcacctgccccagccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccgtgagtctcccggggcctggaggggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacagccagtcaccgtgggacggggcctcctgggcagccctggtccccgaggctggcttctccccacacgatgcatccagcattcgggtcacacagagccactcgggcaactcagttgattataaaggacagccaggtccctgcaaccgggtcaagacagaaatggtcaccgggaaccccagggctgcccatcacgagcccctaccccacgcttcccacgagctcttctcccggccctcccgtccatgcttgtgctttgcctaattgtttgcttttgagaacgggattg

SEQ ID NO: 2652 - DNA, 1324 bp; single-stranded, linear
ttctccttctccccaacagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaattgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgctt

SEQ ID NO: 2653 - DNA, 16310 bp; single-stranded, linear
tacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggnccggacgcccaggaccccatggcagtgggaaaaatgtaggagactgtttggaaattgattttgaacctgatgaaaataaagaatggaaagcttcagtgctgccgataaagatgctgagttgcgacacacgtcttaattcagggtgggtgcacgggtgcgggttaaatattctcagtactcttctggttgcttgaaacaattcatcacaacacagtgtatggcctttgctcctagggatgatggtctgcctgtcccaccccctccctgcctctgaatggccaggccccaccattagcccagttggagggtgggaggaagggggacttctcaaactccgaagcttctctaggcatcctgattttcagggccacatggtcccaaccagactctgcaccatactcttttctcttgggtaccccccaacagtgagaggggtcattacagagcccagcaagcaccactcagaaaggcccagcagcagagtaagcccctatcatgacagaggaatgaagcctggaggggccccgcacttctccccctagagctgcctgaaggcctctctgtctcctacccgacagtcaactcttctcctccaaggagcttaattcaaggctcatggggtctgaagggaggaggctgaaggagaaagaaggggagaatattagagagagatggggatggcaggaaggagcctgtggtgcctgaaaacaccaggaagttctggggaggaggaaaaaccgatgccccacttagggtgtcccatttagggtgagacggaaaatcctcacctttttttcacactttaggtcccccttcccaaaagtgagtaagtgtgggtgcttctgggatgagtaacagtgtcccccattacttcatggctgactttcagccacaggctggaggaggcagagggtgacccaaggccctatctaggtcaccccaatgggtcaccctaccccctcagcctaccacatggttttctcctgcctggcaccccagggctggaggtaaagcctaattttccgaacttcagttggggctcccagtctaggggggctcaatttccgtctccatattttgttttggaattattatttttttgagacagggtctcgttctgtcacccagacgggggtacagtggcatgatcatagcttactgtaacctcaaactcctgggcttgagtgatcctcctgcctcagcctcctgaggagctaggattacaggcatgcaccactacacctgactaatctttaattttttttctagaaacaaggtcttgctatgttgcacaggctggtcttgaactagtgggctcaagtggtcctcccacctcagcctcccaaagtgttgggataacaggcatgagccactgcgccccacccttatttgtctttgactctctccagaagagccttcatccagggagggggtgcttttctctttccggattacccacctctcacctctcccctccttcaccacaaagaccagtgggaccaagccggcatgtgagtccttcacccacatcttattcctatgtttcattcttttttaaaaaatagagacaggatctcactatgttgcccaggttgctctggaactcctgggttcaagcgatcctctcaccttggccttgcaaagtggtaggattacaggtgcatgccaccacgtccggcagttcggttccttgttctttattgtcctcagtctcttcgatttcacccactgagagaatggaaggggatagaacagctggaaactggttgaaggaagccagaattcactaagtgcccactgtgccaagggctgagtgaggtcctctgatggaggtcaggccttctctcacatgccctatgtgtggtggacattcctatccccattggatagataggttaagtggctggttcaggttgcagagttaggacagggtgatttgaagcctagacacccgaatctctggaagtcccttggctgtgtgattcaggtacctgagaatgcggctcctctccagctctctccggactgctggccagctgcaacagccggaaatctcacctgagctgcaggattttcccagcaaggattggaattcccagagttggaaattcccatgccctgagggagaggtaattaggttcaggctcttgtttcctgggggatggggaatattctgttgggctttgtttatgtagggtctccagggccctaggagtctaaggatgggactgggtccgagggatcttaaagcctgtggagagaggacttagggagcttcttcccacccacaagaagaggcagatgcagaattaattccaagaaggagaccatgtttcttttctaagcaaactttatttctcgccactgaatagtagggcgattacagacacaactccctggggagcagaggcctcagcaatgagtgacagttggtcaccaaatcagcattgtttagacaacttaatcagataatattttaaaaaacataatcaaaagaaggcacagaggccagggggctacatgggaacagcctattgttcagcctccgttttcacggaaaacatgtctgagccaaggcagctcctacattgggtcccccaggataccccggtctcccaaataaatacattcatctgtaaataaataaataataaataaataataaataatcacaagtgcaaacataaatagagggagctggctccatggggagggctgggctccgtgtctcaaggaagtctggaaacatctggagagaggaaggcctaaggtccacttgtgtcaatttctaggtgaggtcttctcaagtcctgcagcattctggccagaaccaaaggctccctggtctccagattccagatgtcagggatcaaagctgtaggccccagtgagttctggaggccccagtttgaattcttagtggttgccagcacttcactgtgcaggccacacattcctgaatcccaggtttcgaagtggtggtcttgttgcttaaagttctaagcttgggttccgaccctaagcccccaattctctttttgagccagaagaggttgagggtgtctgaaggagggggtaataaagggattggggcaggggaggcgtttgggaaggttggatgttcgtcctcctcacagggcaatgatcccaaagtagacctgcccagactcggcaaagtcgagatagtcgggccgattgatctcagcgctgagtcggtcacccttctccagctggaagacccctcccagatagatgggctcataccagggcttggcctcagccccctctggggtctccctctggcaggggctcttgatggcagagaggaggttgaccttggtctggtaggagacggcgatgcggctgatggtgtgggtgaggagcacatgggtggaggggcagccttggcccttgaagaggacctgggagtagatgaggtacaggccctctgatggcaccaccagctggttatctctcagctccacgccattggccaggagggcattggcccggcggttcagccactggagctgcccctcagcttgagggtttgctggagggagggagagagggagaggagagtcagtgtggccatgtcggttcactctccacatcctggccctcgagctctgcccaccccacatccggttcctgtcctctctgtctgtcatcccacatcccacctggccatgacgttctgagtatcccactaaggcctgtgctgttcctccacccttcccttgagctcagcgagtccttctcacattgtctccaagttctgcctaccatcagccgggcttcaatccccaaatcctagccctccaagttccaagacacatcctcagagctcttacctacaacatgggctacaggcttgtcactcggggttcgagaagatgatcctgaagaggagagagaaaagaaaaagctgagacccttaaacttcctagaaaatacccccctactttcacctccatccatcctcccccaagaccaaaactttaaatttcccccactgctttccataccggtactaaccctaccccccaaacccaaacccagaattaggaaagaggtttggagacacttactgactgcctgggccagagggctgattagagagaggtccctggggaactgttggggagaaggagaatggttaacatcgagggagtcacccttaaaggaggaacagctggctgcctgtctggcctgcgctcttagccctgaggtgtctggttttctctctccattcatctgtgtattcaccttccaggcattcaacagctctttccctgagtgtcttctgtgtgccagacaccctatcttcttctctccttatctcccccatctctctccttagctgtcatatttcccgctctttctgtctcaccatctttattcatatcacttgtttcttcccccatctctcttctcacaccccacatctgtctccatatcttatttatatatctgcttgttcattcattcattcattcattcactccatacacacttagtgagcaccttccatgtgccagacatcctgtctctccatctttctctctctctcttccccatctcttgccacatctctttctgcatccccgtctttctccacgtttttttctctccatccctccctatcagcgcacatctttcacccatcccatctctctccctctcttgcgtctccatttccccttgggtgggagagtggatgaaggctggccaggcactcacctcttccctctgggggccgatcactccaaagtgcagcaggcagaagagcgtggtggcgcctgccacgatcaggaaggagaagaggctgaggaacaagcaccgcctggagccctggggcccccctgtcttcttggggagcgcctcctcggccagctccacgtcccggatcatgctttcagtgctcatggtgtcctttccaggggagagagggtggagccgtgggtcagtatgtgagaggaagagaacctgcctggcagcttgtcaggggatgtggcgtctgagggttgttttcagggggggtctgtagttgcttctctccctcttagctggtcctctgctgtccttgctgagggagcgtctgctggctgggtgtgccaacaactgcctttatatgtccctggggcgagaggagggcggggaaagaatcattcaaccagcggaaaacttccttggtggagaaacccatgagctcatctggaggaagcggtagtgggccctgcaccttctgtctcggtttcttctccatcgcgggggcggggatttggaaagttggggacacacaagcatcaaggatacccctcacactccccatcctccctgctccgattccgaggggggtcttctgggccactgactgatttgtgtgtaggaccctggaggctgaaccccgtccccatgcccctcaaaacctattgcctccatttcttttggggaccaggtctgtggtctgtttccttctaacttccagacaggatgcaggaaaaagatagaactagaactgggaggggcttcagaaagctgagtccgttgagggagagaaaacggggttggagggaaaagctgtgttgagtcctgaggcctgtgtttgggccctgcggggagaaggagctgggggcttggtggcaggcttgaggcctcaggaaaggctgggtgcgggtagcagggacaagcctgggacagccccggggagtgaaatcacccccgggaattcacagaccccactggggcaggccctcttctttcattctgacccggagactcataatgcttggttcagtcttggcttccaaggaactctggggtccctgatttttttcatgaagctctcacttctcagggccccagtgtgtggccatatcttcttaaacgtcccctgtattccatacctggaggtcctggaggctctttcactccctggggccctctacatggccctgtcttcgttaagtgggggtccccatactcgacttccatagccctggacattctcctacccattgctgtggtcacatctccccagaggtctcctgtaacccattcctcagagccgctacatgtggccatatctcccaggagctccctgacccccgcccctccagaccctgacttttccttcgtcttctcagcttctcctttgcttcccctgcagcagtctggcggcctcacctggtgagtccatcacatatccctgaagctctctgagcccttatccttttgttctccccacagctcttgctccctttgagccctctgtccctccctccattccttagatagactgggaagttctcactcccagacacacacacacaagcagacagcatttcagagaaaagaggtttattgggcttcatcgagggtgcagatgcctccgtgtggggctctggtcggcagctggctttcagagcctttccctgccttctggggccctgtgatccctcatgcctacttctttctctcttggtcagccttgtgcgcatgccctctcactcttcatctcttgggcctgtctctgtttctccttggatgttcttctattattcccctctctccatcctccataaataaataatttaatttttttgccttcataaatagtcccctccctgcctctagtcatcccccaagctcctccatgtgcctgctcttcctctgtgtgtggatctaggccccacctagctggtgggacagaccaacagctttgggctgggaattcctaggcaggcttgaaatcctcagccagacagacatcagggatggttcagggaggtgtggtcccctgggatgcctagaattccttctttgaaagctccggtgacttgatcagggaagacttgagctgttggaatggccaaaggagaggtggtgacgacccctgaaatggtcagaatggaggcagaatggggagaaggtcttgaaatcaattattttttctttctggatttttccaagttctacagagcgaaggctccaaagaagacagtactagggctgaggactaggtgggggatgccatctgtgtgggtggatagctggtctccctgggtgagctggaacgcagccccgtggtacatcgagtgcagccagggttcctgcagccctggatacaccatcttctgggagctgaggagaggcacatggaaggggtactgggaggagaagagctggacctcatgggccaggtagagtggggaggaggtggccttgggagagtaggctttcccagagaagaccacctgggagtagacgaagtagatgccactggtggggaccaggagagaattgttgctcaaggagaaaccatcctggaggaaggcacggtccgtgtttgctctccagagcagtgagttctgcttgctggggtctcctaggaagagccataggggatgggggtgggagatcaggggtctggatcagaggtctcaatccctgaggaagtgggcactgaacaactgagttcctgggggatggcagggggaggcataggagtgggctccctctgttttttttagcgtgggggaagttgggggagaggggtggatgcttgggttcctgaggcaggggtaggaggagagctggtggggacatgtctgggaggtcaggtggatgtttaccaatgaggtgagcagcaggtttgagggtgctgtgggcaagatgcatcttggggtgctgacgggcagtctgggcagctgaaggtgtgaggccaacaccagggagcccctaggggagaacagagttgaggggggctctagggctcaaggtttggctgagccaccccagcagcccccattctcctgctgcctcacctgggccccaggcagcagaaccagcagcagccccagaaggaggaggtgtagggtggtgccacgcacccttgggaggaagagacgttcaggtggtgtcatggggagaacctgcagagaaagagagagagagagagagacagtgagcggggcggggcacgcggcggaagacagacctcccgccctgggagacagcaccccccgacccccgagagagagatcgacagagaaggggacaagatgcagtcagagaaaccccaaggtgagcagagggagacagagagagacaggaagggaacagagaggaatcatggcagaaacagagaatgtgtgacagagacaatgagactgacagatggagagtcagagacagagaaggaaaccaaaaccaaacccaccaaggcccaggcccaggcaggccggggatccaggcagcaggtgcaggagggaccgaggcccaggcagagggcaggacactgcggggcggtagtccaaagcacgaagcacgggcagcccaaggagatggggcaggagagcctcacctgctgtgcggacccctgggcccggacgctcaggtccctttatagaggaagcggcagtggcagcgtggcaggcagcgggcgggttctaggtcggggctggggcccggggaagcccccagggcttagaagatactgctgtttcagtcaaaggcaggaaaggctgaggcctaggagagaaccacaggctgggggttcaggcgactgagttctgggaaagggagtcgggtcaggggaatcgtgggctgggagggccagggagtggggtcaggcctagagttccaaagaagggacagtcaattcagagaggaggcagttgagcagctggggtgtgagctggaggcccggttccctgaagagcaatcatatataacatctctgcacccttggctgagtacaggcttctctctttgcccatttccttctcttgtacccctgtccttgtcccaaacaactcaaatcatacttgtcccagtatacggactttccagcccatctggcaggtttcacatcaagaaggtccattatatatccccttcatcggggacattctggtgtttgcctcttgtccaggtgaaaatattaatggatcccccttccactcttgaaagtgtcctagtttggaagataaattttttggtccccttactcagagatgatgctggacagtcaagtatgatgaggtctcatctcactcctgaaggatgccctccatctcttcctgacttcaggtggcttccacagaacagatttatataaccccaaataaacacacattccaggatcaatgtggcagacaccttccaaagttttctacaaaggaagtttgcagaattccacatgggtgaggcttaagggtggtgacttagggtggggtggggacagctaagggacttgttctgaagctgcatttgcagagccaatacattattttaaaattgttccaggcctggtgcagtggctcacacctgtaatcctggcactttgggagtctgaggtgggcggattacttgaggtcaggagtttgagaccagctggccaacatggtgaaaccccatctctataataaatacaaaaattagccaggcgtgctggtgcgcatctgcagtcccagctactcgggaggctgaggctggagaattatttgaacctgggaggcggaggctgcagtgagtcaagatcgcaccactgtattccagcctgggggacagagcaagactctgtctcaaaaaaaaaaaaaaagtttccaaaatttttttcctttttattgatatgtaacttaggtatgaggtggacacctcttaagtgtacagctgatgaatttttccatctgtatgtagccaccacccagctccacgtattttcaggtccccagcaggttccctcatgccccctccctgctgataccctccaaagataaccaaccactctctcacttttatcaccatagattatttcctcctggtttggggcatcatataaatgaaatcacacagaatgtactcatttctgtttgacttctttcagtcagcattatgtttgtgagattcatatacgtggttgtatgtatcagtaatgttttttaaaaaaattatgatgtaatattctattgtatcaatatattctaatatattctgttgatggggatttggtttgtttctagtttttgtctaacacaaaaatgtctacacgaacattctcatacatgagcccatttcacttagcttgcaagttacaaggtttaaaaaaagcagtttctaaagatgactttattcacttttcctaagtttgagataataccaacttgtcacctcaaatattattactgctactcatgtgattttacttggagagtgttagaggggttggagctggggctggtggtgacccggggtaaagcccactgttgcatggggcagaccacttctctccccaggcacaaggtccctgaggggtcttggtgtaacatggagggacatgtaagtaacattctgggtgtgtatgagctatttctcctgttcttctctacttgaggacctgcccctttgccttttatgctttactagtcttagctattatttctgtaggggcagaaaggggtgatcccttcctgacccatcataagggttatggccaatactcctataataaaagacagattaacaagagaaaagcataatacatttatttaatcaaagttttaggtgacatgggagccttcagaaatgaagacccaaggacccaggggaaaactatttttatgcttagatttgatgaagaatgaacagctgtgcagaaatgtaattgaacaaaaggagtatcatctaatggtcacagactgggactggggggatcccagcaaggcctggccatattcttcttggtctctctgtacagcattccttcctcccaggtatagggcagaacctcttctggaatgagggtcttataacctactatcagatgagataagtcagaaaatttcttttcctttttttttttttgagacagtttctcactgtcgcacaggctggagtgcagtggcacgatcttggctcactgcaacctctgcctcccaggttcaagctattctcctgcctcagcctcccgagtagctgggattacaggcacacgccaccaagcccgccaaatttttttttgtatttttagtagagacggggtctcaccatgttggccaggttggtcttgaattcctgaccacaggtgacccaccagccttggcctcccaaagtgctgggattatgggcgtgagccactgcgcccaaccttcttctcattcttttaaccttattatctcttgtgtcagtgtgggtttcccttttagcccctgctcctttctttttctctgtgttgccctttctctcagggtcctttttgcttcctgttgtctctttctgcttctctaatggtatgagctgatggactgggaccccagctgagctatattaaaatataaaatgttattacaaggccaggagcagtggcacatgcctgtcatcccagcactttgggaggctgaggcgagcagatcacaaggtcaggagatagagacaatcctggctaatacggtgaaactccatcactgctaaaaatacaaaaaattagccgagcatggtggcacgcgcctgtaatcctagctactagggaagctgaggcaggagaactgcttgaacccaggaggcggaggttgcagtgagccgagatcgtgccactgccctccagcctgggcaacaaagtgagactccatttcaaacaaaccaaccaaaaaacaaaacaaaacaaaacaagcaaacaaaaaaaggtattgcaattaacagtgagacacagagagaaatttaaattaaagaggaagaatgggacattgaaagacaaaaaagggaaggcaagaagggtgatggggagacatgagagacacagaggaaggaagggtaagactgggctgaggctcagtgtcacgtgcatgtgagatatgcgaaggatgctccttgagatgggccaatcttggtttcaatctcagtttcggaggttgtatgaatttggtttctttcttggcaggccagcagttggtttgggactttccctgggtgggagagctgatgactggagtcttgtgccccagactcagggaaatacagtctttatagtggtctttgtggagaaactagtgaaatctctgaagcctccaaatgagactgaaatgacattagcttcaaacttgaacttagcctcaaaacctgaattgggatttaataccaacatcaaccctaacccaaatttaacctcaacccaaatcacaactcaaactcaaccccaactgtaaccctaacctcaaatctaaacacatcccaattaataaccccctaaataaaacttctcctctaccccaacccaaccctgtttctagggctaatcttgaaaccagtttaccaccactcctaacactaaacttaaatctgactctaaatgtaagtccaatctgagccacaagcctaaagttgaactttatcctgctttatgaattattcatccattcctccatttagtgagtatctgcgtgcctaacacatgctgggcattgtcctaaggcaggagggacatggagggcaaagggatcagagaaggtaccagcacctgtggagcttgtattccagtgaggcccagacggaaaaagaaagaaacttgaaggaaggaaatttggtactatgagaaaataagacaggctgatgttgtaagagtggcagggagctacttttaaatacagtagtcagcaaaatcctctttgagtgtttgggtggcactggagctgagacccaaatgacaaaaaatagtgaccaggtaaaagtttgggagcaaagcatttcaggtaaagggagcagctactgcaaaggctggaaggcggaaccaagctgggggtgttgacgacaaacagaaggccagtgtggctggagcagagagagagactgggaggcgggtgggagatgaggtcagagaggagggcaggggccaggtcatgcagggccatgcaagaagggtaaagcctctagatttcatccagccacaggaagcctttaaaggtcgtcagagtgtgtggtgcgtgcgtgtgtgtgtgtgtgtgtgtgttgcaggggagagaggnggagggagagagagagagagagaagagggaggtgagcagaggtgattggatttttttttcttttgacatggtgtcttgctctgtggcctaggctggagtgcagtggcaccatcatagcccactgcaacctcaaaaccatgggctcaagtcatccttccacctcagcttcccaagtatctaggactacaggtgtgtgccactgtgcctggctaattttaaaaaatattttaaaatttttgttgagacagggtctatgctgctcaggctggtctcgaactcctggtttcaagtgatctgcccatcttggcctcccaaagtttttttttgttagtttgagaggcggtttcgctcgttgcccaggctggagtgcaatgactgatctcatctcactgcaacctctgcctcctgggttcaagcgattctcctgcttcagcctcccaagtagctgggattacaggtgcatgccaccattcccggctaattttttgtatttagtagagatggggttcaccatgttagtcaggctgatctcaaactcctgacctcaggtgatccgcctgcctcagcctcccaaagttttgggattacaggtgtgagccaccatgctgggccagcctcccaaagttttgggattacaggcatgagtcaccacactggccctggattttttttctttcttttttttggagacggagtctcactctgttgcccaggctggagtgcaatggcgtaatctcagctcactgcaacctctgctgcccgggttcaaacgattctcctgtcttagcctcctgagtagctgggattataggtgcatgccaccatgcctggctaatttttgtacttttagtagagaaagtacaccatcttggccaggctggtctcgaactcctgacctcaggtgatccacttgcgtcggcctcccaaagtgctgggattacaggcgtgagacaccgcacccagcctttttttttttttttttcttttaagacagaatcgctctgtcacccaggctggagtgcagtggcacaatctcggctcactgcaacctctgcctcccaggtttaagcaatccacctatgtcagtctcccaagtagctgggattataggtgcatgtcaccatgcctggctaatttttgtacttttagtatagaaagtacaccatgttggccaggctggtcttgaactcctgacctcaagtgatccgcctgcctcagcctcccgaagtgctggaattacagacatgtgccactgcacccggcctggttttttttttctaagagatggagtctcacttttctgcccaggttggagtgcaatggcaccatcatagctcactgcagccttcaactcttggcctcaggcaatccttgcaccttagcctcgcaaagtgttgggattacaggcatgagccactgagccttgcctggacttttttttttttttgagatggcgtctcgctctgttgcccaggttggagtgctacggcatgatcttggctcactgcaacttccacctcccaggttcaagcgattctcttgcctcggccccccgagtagctgggattacagcatgcgccaccgtgcctggctaattttggtatttttagtagagatagggtttcatcatgttgggcaggctggtcttgaactcctgacctcgtgatccacccacctcggcctcccaaagtgctgggattataggcatagccaacgcgcccagcctggacttgtttttaaaagatcactgtggctcctgtgtttaggctggctggtaggagacaggtggcagtgacattgatggtgaagagaaaatagtggcagccatggagatggagagaagtagacaagtttgggatatattatacattccaggggtagaaacaacaggactagatgatggattgatgggtgggagatgtagatactgggagagaagcaggattctgatggatggaaaaactaaaaaattctattttgggtgtggtaagtctaagtctattagacatgcaagtagagatgtcactgggcagatacacatctggatttcaggggcaaggtccaagctagagaaagaaacctgggcatggtcagcatgaggatggtgtttaaagccatggaacttatcttgtgcatccctataagacccctttgaggcacttgtttcccctcacaatggatgcagtgcatcttccattctgaattccagaggcaacaacctcctgctcctagaagctaaactctccagacttagtcttctgaattcccactgggatttaacctccctggattcaattccctaccccacaaggacccttctaccaatccatttcacaatatttggtggaactcttcacattttcaaatcctgtcttctatgtttgaaagcattttcctctgggcattttgaaacctggctttcccctaatgatgctactcctctctgtggtgaaggttgctctttcttcgactccatcactaggggaatgaaggcagaagagaggggtcgttatcccctctcccccaggaccactgataaactcctcctcatctcccaaagcacgtgccttctggatctgccatgctctccctgccttcacagcacaatcttatccatcaaaatatttattatgctcttaacaacttgtataactagctcagtctttctccacatcttatccctaccatcatccttgtttgtttgttttttgagacaaggtattgctctgtcacccaggctggagtgcagtggcgtgatcttggctcactgcagcctcgacctcctgggctcaagtgatcctcccacgtcagcctcctgagtagctaggactacaggcgcataccaccatgcccggctaagttttgtatttttttttttttccagagatagggttttgctatgttgcctaggctggtcttgaactcctgagctcaagcaatccacccgcctcagcctcccaaagtgctgggattacaggcatgacccaccgcacccggcctcctaccaccatctttagt

SEQ ID NO: 2654 - DNA, 17634 bp; single-stranded, linear
ttctccttctccccaacagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaattgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgctttacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggnccggacgcccaggaccccatggcagtgggaaaaatgtaggagactgtttggaaattgattttgaacctgatgaaaataaagaatggaaagcttcagtgctgccgataaagatgctgagttgcgacacacgtcttaattcagggtgggtgcacgggtgcgggttaaatattctcagtactcttctggttgcttgaaacaattcatcacaacacagtgtatggcctttgctcctagggatgatggtctgcctgtcccaccccctccctgcctctgaatggccaggccccaccattagcccagttggagggtgggaggaagggggacttctcaaactccgaagcttctctaggcatcctgattttcagggccacatggtcccaaccagactctgcaccatactcttttctcttgggtaccccccaacagtgagaggggtcattacagagcccagcaagcaccactcagaaaggcccagcagcagagtaagcccctatcatgacagaggaatgaagcctggaggggccccgcacttctccccctagagctgcctgaaggcctctctgtctcctacccgacagtcaactcttctcctccaaggagcttaattcaaggctcatggggtctgaagggaggaggctgaaggagaaagaaggggagaatattagagagagatggggatggcaggaaggagcctgtggtgcctgaaaacaccaggaagttctggggaggaggaaaaaccgatgccccacttagggtgtcccatttagggtgagacggaaaatcctcacctttttttcacactttaggtcccccttcccaaaagtgagtaagtgtgggtgcttctgggatgagtaacagtgtcccccattacttcatggctgactttcagccacaggctggaggaggcagagggtgacccaaggccctatctaggtcaccccaatgggtcaccctaccccctcagcctaccacatggttttctcctgcctggcaccccagggctggaggtaaagcctaattttccgaacttcagttggggctcccagtctaggggggctcaatttccgtctccatattttgttttggaattattatttttttgagacagggtctcgttctgtcacccagacgggggtacagtggcatgatcatagcttactgtaacctcaaactcctgggcttgagtgatcctcctgcctcagcctcctgaggagctaggattacaggcatgcaccactacacctgactaatctttaattttttttctagaaacaaggtcttgctatgttgcacaggctggtcttgaactagtgggctcaagtggtcctcccacctcagcctcccaaagtgttgggataacaggcatgagccactgcgccccacccttatttgtctttgactctctccagaagagccttcatccagggagggggtgcttttctctttccggattacccacctctcacctctcccctccttcaccacaaagaccagtgggaccaagccggcatgtgagtccttcacccacatcttattcctatgtttcattcttttttaaaaaatagagacaggatctcactatgttgcccaggttgctctggaactcctgggttcaagcgatcctctcaccttggccttgcaaagtggtaggattacaggtgcatgccaccacgtccggcagttcggttccttgttctttattgtcctcagtctcttcgatttcacccactgagagaatggaaggggatagaacagctggaaactggttgaaggaagccagaattcactaagtgcccactgtgccaagggctgagtgaggtcctctgatggaggtcaggccttctctcacatgccctatgtgtggtggacattcctatccccattggatagataggttaagtggctggttcaggttgcagagttaggacagggtgatttgaagcctagacacccgaatctctggaagtcccttggctgtgtgattcaggtacctgagaatgcggctcctctccagctctctccggactgctggccagctgcaacagccggaaatctcacctgagctgcaggattttcccagcaaggattggaattcccagagttggaaattcccatgccctgagggagaggtaattaggttcaggctcttgtttcctgggggatggggaatattctgttgggctttgtttatgtagggtctccagggccctaggagtctaaggatgggactgggtccgagggatcttaaagcctgtggagagaggacttagggagcttcttcccacccacaagaagaggcagatgcagaattaattccaagaaggagaccatgtttcttttctaagcaaactttatttctcgccactgaatagtagggcgattacagacacaactccctggggagcagaggcctcagcaatgagtgacagttggtcaccaaatcagcattgtttagacaacttaatcagataatattttaaaaaacataatcaaaagaaggcacagaggccagggggctacatgggaacagcctattgttcagcctccgttttcacggaaaacatgtctgagccaaggcagctcctacattgggtcccccaggataccccggtctcccaaataaatacattcatctgtaaataaataaataataaataaataataaataatcacaagtgcaaacataaatagagggagctggctccatggggagggctgggctccgtgtctcaaggaagtctggaaacatctggagagaggaaggcctaaggtccacttgtgtcaatttctaggtgaggtcttctcaagtcctgcagcattctggccagaaccaaaggctccctggtctccagattccagatgtcagggatcaaagctgtaggccccagtgagttctggaggccccagtttgaattcttagtggttgccagcacttcactgtgcaggccacacattcctgaatcccaggtttcgaagtggtggtcttgttgcttaaagttctaagcttgggttccgaccctaagcccccaattctctttttgagccagaagaggttgagggtgtctgaaggagggggtaataaagggattggggcaggggaggcgtttgggaaggttggatgttcgtcctcctcacagggcaatgatcccaaagtagacctgcccagactcggcaaagtcgagatagtcgggccgattgatctcagcgctgagtcggtcacccttctccagctggaagacccctcccagatagatgggctcataccagggcttggcctcagccccctctggggtctccctctggcaggggctcttgatggcagagaggaggttgaccttggtctggtaggagacggcgatgcggctgatggtgtgggtgaggagcacatgggtggaggggcagccttggcccttgaagaggacctgggagtagatgaggtacaggccctctgatggcaccaccagctggttatctctcagctccacgccattggccaggagggcattggcccggcggttcagccactggagctgcccctcagcttgagggtttgctggagggagggagagagggagaggagagtcagtgtggccatgtcggttcactctccacatcctggccctcgagctctgcccaccccacatccggttcctgtcctctctgtctgtcatcccacatcccacctggccatgacgttctgagtatcccactaaggcctgtgctgttcctccacccttcccttgagctcagcgagtccttctcacattgtctccaagttctgcctaccatcagccgggcttcaatccccaaatcctagccctccaagttccaagacacatcctcagagctcttacctacaacatgggctacaggcttgtcactcggggttcgagaagatgatcctgaagaggagagagaaaagaaaaagctgagacccttaaacttcctagaaaatacccccctactttcacctccatccatcctcccccaagaccaaaactttaaatttcccccactgctttccataccggtactaaccctaccccccaaacccaaacccagaattaggaaagaggtttggagacacttactgactgcctgggccagagggctgattagagagaggtccctggggaactgttggggagaaggagaatggttaacatcgagggagtcacccttaaaggaggaacagctggctgcctgtctggcctgcgctcttagccctgaggtgtctggttttctctctccattcatctgtgtattcaccttccaggcattcaacagctctttccctgagtgtcttctgtgtgccagacaccctatcttcttctctccttatctcccccatctctctccttagctgtcatatttcccgctctttctgtctcaccatctttattcatatcacttgtttcttcccccatctctcttctcacaccccacatctgtctccatatcttatttatatatctgcttgttcattcattcattcattcattcactccatacacacttagtgagcaccttccatgtgccagacatcctgtctctccatctttctctctctctcttccccatctcttgccacatctctttctgcatccccgtctttctccacgtttttttctctccatccctccctatcagcgcacatctttcacccatcccatctctctccctctcttgcgtctccatttccccttgggtgggagagtggatgaaggctggccaggcactcacctcttccctctgggggccgatcactccaaagtgcagcaggcagaagagcgtggtggcgcctgccacgatcaggaaggagaagaggctgaggaacaagcaccgcctggagccctggggcccccctgtcttcttggggagcgcctcctcggccagctccacgtcccggatcatgctttcagtgctcatggtgtcctttccaggggagagagggtggagccgtgggtcagtatgtgagaggaagagaacctgcctggcagcttgtcaggggatgtggcgtctgagggttgttttcagggggggtctgtagttgcttctctccctcttagctggtcctctgctgtccttgctgagggagcgtctgctggctgggtgtgccaacaactgcctttatatgtccctggggcgagaggagggcggggaaagaatcattcaaccagcggaaaacttccttggtggagaaacccatgagctcatctggaggaagcggtagtgggccctgcaccttctgtctcggtttcttctccatcgcgggggcggggatttggaaagttggggacacacaagcatcaaggatacccctcacactccccatcctccctgctccgattccgaggggggtcttctgggccactgactgatttgtgtgtaggaccctggaggctgaaccccgtccccatgcccctcaaaacctattgcctccatttcttttggggaccaggtctgtggtctgtttccttctaacttccagacaggatgcaggaaaaagatagaactagaactgggaggggcttcagaaagctgagtccgttgagggagagaaaacggggttggagggaaaagctgtgttgagtcctgaggcctgtgtttgggccctgcggggagaaggagctgggggcttggtggcaggcttgaggcctcaggaaaggctgggtgcgggtagcagggacaagcctgggacagccccggggagtgaaatcacccccgggaattcacagaccccactggggcaggccctcttctttcattctgacccggagactcataatgcttggttcagtcttggcttccaaggaactctggggtccctgatttttttcatgaagctctcacttctcagggccccagtgtgtggccatatcttcttaaacgtcccctgtattccatacctggaggtcctggaggctctttcactccctggggccctctacatggccctgtcttcgttaagtgggggtccccatactcgacttccatagccctggacattctcctacccattgctgtggtcacatctccccagaggtctcctgtaacccattcctcagagccgctacatgtggccatatctcccaggagctccctgacccccgcccctccagaccctgacttttccttcgtcttctcagcttctcctttgcttcccctgcagcagtctggcggcctcacctggtgagtccatcacatatccctgaagctctctgagcccttatccttttgttctccccacagctcttgctccctttgagccctctgtccctccctccattccttagatagactgggaagttctcactcccagacacacacacacaagcagacagcatttcagagaaaagaggtttattgggcttcatcgagggtgcagatgcctccgtgtggggctctggtcggcagctggctttcagagcctttccctgccttctggggccctgtgatccctcatgcctacttctttctctcttggtcagccttgtgcgcatgccctctcactcttcatctcttgggcctgtctctgtttctccttggatgttcttctattattcccctctctccatcctccataaataaataatttaatttttttgccttcataaatagtcccctccctgcctctagtcatcccccaagctcctccatgtgcctgctcttcctctgtgtgtggatctaggccccacctagctggtgggacagaccaacagctttgggctgggaattcctaggcaggcttgaaatcctcagccagacagacatcagggatggttcagggaggtgtggtcccctgggatgcctagaattccttctttgaaagctccggtgacttgatcagggaagacttgagctgttggaatggccaaaggagaggtggtgacgacccctgaaatggtcagaatggaggcagaatggggagaaggtcttgaaatcaattattttttctttctggatttttccaagttctacagagcgaaggctccaaagaagacagtactagggctgaggactaggtgggggatgccatctgtgtgggtggatagctggtctccctgggtgagctggaacgcagccccgtggtacatcgagtgcagccagggttcctgcagccctggatacaccatcttctgggagctgaggagaggcacatggaaggggtactgggaggagaagagctggacctcatgggccaggtagagtggggaggaggtggccttgggagagtaggctttcccagagaagaccacctgggagtagacgaagtagatgccactggtggggaccaggagagaattgttgctcaaggagaaaccatcctggaggaaggcacggtccgtgtttgctctccagagcagtgagttctgcttgctggggtctcctaggaagagccataggggatgggggtgggagatcaggggtctggatcagaggtctcaatccctgaggaagtgggcactgaacaactgagttcctgggggatggcagggggaggcataggagtgggctccctctgttttttttagcgtgggggaagttgggggagaggggtggatgcttgggttcctgaggcaggggtaggaggagagctggtggggacatgtctgggaggtcaggtggatgtttaccaatgaggtgagcagcaggtttgagggtgctgtgggcaagatgcatcttggggtgctgacgggcagtctgggcagctgaaggtgtgaggccaacaccagggagcccctaggggagaacagagttgaggggggctctagggctcaaggtttggctgagccaccccagcagcccccattctcctgctgcctcacctgggccccaggcagcagaaccagcagcagccccagaaggaggaggtgtagggtggtgccacgcacccttgggaggaagagacgttcaggtggtgtcatggggagaacctgcagagaaagagagagagagagagagacagtgagcggggcggggcacgcggcggaagacagacctcccgccctgggagacagcaccccccgacccccgagagagagatcgacagagaaggggacaagatgcagtcagagaaaccccaaggtgagcagagggagacagagagagacaggaagggaacagagaggaatcatggcagaaacagagaatgtgtgacagagacaatgagactgacagatggagagtcagagacagagaaggaaaccaaaaccaaacccaccaaggcccaggcccaggcaggccggggatccaggcagcaggtgcaggagggaccgaggcccaggcagagggcaggacactgcggggcggtagtccaaagcacgaagcacgggcagcccaaggagatggggcaggagagcctcacctgctgtgcggacccctgggcccggacgctcaggtccctttatagaggaagcggcagtggcagcgtggcaggcagcgggcgggttctaggtcggggctggggcccggggaagcccccagggcttagaagatactgctgtttcagtcaaaggcaggaaaggctgaggcctaggagagaaccacaggctgggggttcaggcgactgagttctgggaaagggagtcgggtcaggggaatcgtgggctgggagggccagggagtggggtcaggcctagagttccaaagaagggacagtcaattcagagaggaggcagttgagcagctggggtgtgagctggaggcccggttccctgaagagcaatcatatataacatctctgcacccttggctgagtacaggcttctctctttgcccatttccttctcttgtacccctgtccttgtcccaaacaactcaaatcatacttgtcccagtatacggactttccagcccatctggcaggtttcacatcaagaaggtccattatatatccccttcatcggggacattctggtgtttgcctcttgtccaggtgaaaatattaatggatcccccttccactcttgaaagtgtcctagtttggaagataaattttttggtccccttactcagagatgatgctggacagtcaagtatgatgaggtctcatctcactcctgaaggatgccctccatctcttcctgacttcaggtggcttccacagaacagatttatataaccccaaataaacacacattccaggatcaatgtggcagacaccttccaaagttttctacaaaggaagtttgcagaattccacatgggtgaggcttaagggtggtgacttagggtggggtggggacagctaagggacttgttctgaagctgcatttgcagagccaatacattattttaaaattgttccaggcctggtgcagtggctcacacctgtaatcctggcactttgggagtctgaggtgggcggattacttgaggtcaggagtttgagaccagctggccaacatggtgaaaccccatctctataataaatacaaaaattagccaggcgtgctggtgcgcatctgcagtcccagctactcgggaggctgaggctggagaattatttgaacctgggaggcggaggctgcagtgagtcaagatcgcaccactgtattccagcctgggggacagagcaagactctgtctcaaaaaaaaaaaaaaagtttccaaaatttttttcctttttattgatatgtaacttaggtatgaggtggacacctcttaagtgtacagctgatgaatttttccatctgtatgtagccaccacccagctccacgtattttcaggtccccagcaggttccctcatgccccctccctgctgataccctccaaagataaccaaccactctctcacttttatcaccatagattatttcctcctggtttggggcatcatataaatgaaatcacacagaatgtactcatttctgtttgacttctttcagtcagcattatgtttgtgagattcatatacgtggttgtatgtatcagtaatgttttttaaaaaaattatgatgtaatattctattgtatcaatatattctaatatattctgttgatggggatttggtttgtttctagtttttgtctaacacaaaaatgtctacacgaacattctcatacatgagcccatttcacttagcttgcaagttacaaggtttaaaaaaagcagtttctaaagatgactttattcacttttcctaagtttgagataataccaacttgtcacctcaaatattattactgctactcatgtgattttacttggagagtgttagaggggttggagctggggctggtggtgacccggggtaaagcccactgttgcatggggcagaccacttctctccccaggcacaaggtccctgaggggtcttggtgtaacatggagggacatgtaagtaacattctgggtgtgtatgagctatttctcctgttcttctctacttgaggacctgcccctttgccttttatgctttactagtcttagctattatttctgtaggggcagaaaggggtgatcccttcctgacccatcataagggttatggccaatactcctataataaaagacagattaacaagagaaaagcataatacatttatttaatcaaagttttaggtgacatgggagccttcagaaatgaagacccaaggacccaggggaaaactatttttatgcttagatttgatgaagaatgaacagctgtgcagaaatgtaattgaacaaaaggagtatcatctaatggtcacagactgggactggggggatcccagcaaggcctggccatattcttcttggtctctctgtacagcattccttcctcccaggtatagggcagaacctcttctggaatgagggtcttataacctactatcagatgagataagtcagaaaatttcttttcctttttttttttttgagacagtttctcactgtcgcacaggctggagtgcagtggcacgatcttggctcactgcaacctctgcctcccaggttcaagctattctcctgcctcagcctcccgagtagctgggattacaggcacacgccaccaagcccgccaaatttttttttgtatttttagtagagacggggtctcaccatgttggccaggttggtcttgaattcctgaccacaggtgacccaccagccttggcctcccaaagtgctgggattatgggcgtgagccactgcgcccaaccttcttctcattcttttaaccttattatctcttgtgtcagtgtgggtttcccttttagcccctgctcctttctttttctctgtgttgccctttctctcagggtcctttttgcttcctgttgtctctttctgcttctctaatggtatgagctgatggactgggaccccagctgagctatattaaaatataaaatgttattacaaggccaggagcagtggcacatgcctgtcatcccagcactttgggaggctgaggcgagcagatcacaaggtcaggagatagagacaatcctggctaatacggtgaaactccatcactgctaaaaatacaaaaaattagccgagcatggtggcacgcgcctgtaatcctagctactagggaagctgaggcaggagaactgcttgaacccaggaggcggaggttgcagtgagccgagatcgtgccactgccctccagcctgggcaacaaagtgagactccatttcaaacaaaccaaccaaaaaacaaaacaaaacaaaacaagcaaacaaaaaaaggtattgcaattaacagtgagacacagagagaaatttaaattaaagaggaagaatgggacattgaaagacaaaaaagggaaggcaagaagggtgatggggagacatgagagacacagaggaaggaagggtaagactgggctgaggctcagtgtcacgtgcatgtgagatatgcgaaggatgctccttgagatgggccaatcttggtttcaatctcagtttcggaggttgtatgaatttggtttctttcttggcaggccagcagttggtttgggactttccctgggtgggagagctgatgactggagtcttgtgccccagactcagggaaatacagtctttatagtggtctttgtggagaaactagtgaaatctctgaagcctccaaatgagactgaaatgacattagcttcaaacttgaacttagcctcaaaacctgaattgggatttaataccaacatcaaccctaacccaaatttaacctcaacccaaatcacaactcaaactcaaccccaactgtaaccctaacctcaaatctaaacacatcccaattaataaccccctaaataaaacttctcctctaccccaacccaaccctgtttctagggctaatcttgaaaccagtttaccaccactcctaacactaaacttaaatctgactctaaatgtaagtccaatctgagccacaagcctaaagttgaactttatcctgctttatgaattattcatccattcctccatttagtgagtatctgcgtgcctaacacatgctgggcattgtcctaaggcaggagggacatggagggcaaagggatcagagaaggtaccagcacctgtggagcttgtattccagtgaggcccagacggaaaaagaaagaaacttgaaggaaggaaatttggtactatgagaaaataagacaggctgatgttgtaagagtggcagggagctacttttaaatacagtagtcagcaaaatcctctttgagtgtttgggtggcactggagctgagacccaaatgacaaaaaatagtgaccaggtaaaagtttgggagcaaagcatttcaggtaaagggagcagctactgcaaaggctggaaggcggaaccaagctgggggtgttgacgacaaacagaaggccagtgtggctggagcagagagagagactgggaggcgggtgggagatgaggtcagagaggagggcaggggccaggtcatgcagggccatgcaagaagggtaaagcctctagatttcatccagccacaggaagcctttaaaggtcgtcagagtgtgtggtgcgtgcgtgtgtgtgtgtgtgtgtgtgttgcaggggagagaggnggagggagagagagagagagagaagagggaggtgagcagaggtgattggatttttttttcttttgacatggtgtcttgctctgtggcctaggctggagtgcagtggcaccatcatagcccactgcaacctcaaaaccatgggctcaagtcatccttccacctcagcttcccaagtatctaggactacaggtgtgtgccactgtgcctggctaattttaaaaaatattttaaaatttttgttgagacagggtctatgctgctcaggctggtctcgaactcctggtttcaagtgatctgcccatcttggcctcccaaagtttttttttgttagtttgagaggcggtttcgctcgttgcccaggctggagtgcaatgactgatctcatctcactgcaacctctgcctcctgggttcaagcgattctcctgcttcagcctcccaagtagctgggattacaggtgcatgccaccattcccggctaattttttgtatttagtagagatggggttcaccatgttagtcaggctgatctcaaactcctgacctcaggtgatccgcctgcctcagcctcccaaagttttgggattacaggtgtgagccaccatgctgggccagcctcccaaagttttgggattacaggcatgagtcaccacactggccctggattttttttctttcttttttttggagacggagtctcactctgttgcccaggctggagtgcaatggcgtaatctcagctcactgcaacctctgctgcccgggttcaaacgattctcctgtcttagcctcctgagtagctgggattataggtgcatgccaccatgcctggctaatttttgtacttttagtagagaaagtacaccatcttggccaggctggtctcgaactcctgacctcaggtgatccacttgcgtcggcctcccaaagtgctgggattacaggcgtgagacaccgcacccagcctttttttttttttttttcttttaagacagaatcgctctgtcacccaggctggagtgcagtggcacaatctcggctcactgcaacctctgcctcccaggtttaagcaatccacctatgtcagtctcccaagtagctgggattataggtgcatgtcaccatgcctggctaatttttgtacttttagtatagaaagtacaccatgttggccaggctggtcttgaactcctgacctcaagtgatccgcctgcctcagcctcccgaagtgctggaattacagacatgtgccactgcacccggcctggttttttttttctaagagatggagtctcacttttctgcccaggttggagtgcaatggcaccatcatagctcactgcagccttcaactcttggcctcaggcaatccttgcaccttagcctcgcaaagtgttgggattacaggcatgagccactgagccttgcctggacttttttttttttttgagatggcgtctcgctctgttgcccaggttggagtgctacggcatgatcttggctcactgcaacttccacctcccaggttcaagcgattctcttgcctcggccccccgagtagctgggattacagcatgcgccaccgtgcctggctaattttggtatttttagtagagatagggtttcatcatgttgggcaggctggtcttgaactcctgacctcgtgatccacccacctcggcctcccaaagtgctgggattataggcatagccaacgcgcccagcctggacttgtttttaaaagatcactgtggctcctgtgtttaggctggctggtaggagacaggtggcagtgacattgatggtgaagagaaaatagtggcagccatggagatggagagaagtagacaagtttgggatatattatacattccaggggtagaaacaacaggactagatgatggattgatgggtgggagatgtagatactgggagagaagcaggattctgatggatggaaaaactaaaaaattctattttgggtgtggtaagtctaagtctattagacatgcaagtagagatgtcactgggcagatacacatctggatttcaggggcaaggtccaagctagagaaagaaacctgggcatggtcagcatgaggatggtgtttaaagccatggaacttatcttgtgcatccctataagacccctttgaggcacttgtttcccctcacaatggatgcagtgcatcttccattctgaattccagaggcaacaacctcctgctcctagaagctaaactctccagacttagtcttctgaattcccactgggatttaacctccctggattcaattccctaccccacaaggacccttctaccaatccatttcacaatatttggtggaactcttcacattttcaaatcctgtcttctatgtttgaaagcattttcctctgggcattttgaaacctggctttcccctaatgatgctactcctctctgtggtgaaggttgctctttcttcgactccatcactaggggaatgaaggcagaagagaggggtcgttatcccctctcccccaggaccactgataaactcctcctcatctcccaaagcacgtgccttctggatctgccatgctctccctgccttcacagcacaatcttatccatcaaaatatttattatgctcttaacaacttgtataactagctcagtctttctccacatcttatccctaccatcatccttgtttgtttgttttttgagacaaggtattgctctgtcacccaggctggagtgcagtggcgtgatcttggctcactgcagcctcgacctcctgggctcaagtgatcctcccacgtcagcctcctgagtagctaggactacaggcgcataccaccatgcccggctaagttttgtatttttttttttttccagagatagggttttgctatgttgcctaggctggtcttgaactcctgagctcaagcaatccacccgcctcagcctcccaaagtgctgggattacaggcatgacccaccgcacccggcctcctaccaccatctttagt

SEQ ID NO: 2655 - DNA, 2396 bp; single-stranded, linear
aattcgataattcaaaatgatatttcagtggggacaaggccaaaccatattatgtgctttatgctactaataaaaaggttaaaccgaacaagttcaaagacaaaactcagtagtactttattcagacaggttagtctaaatctgttaaccttatacttgcaactctgatcattcattaattctgcaaattttaataaatgctttattttaagctaaatgctgagatgaaaaaatgaaaccatatgagttagcaaagtagaaaatataggcatattaatcagtaaatgcagaatgataaatgctccatcaatatgcacttgttgtagtgaggccaccgaggagggtgcaatcctctcaacctgggaggagcaggtaggacttcagatgtcatccaactcaaagatatagtgagggacttgatcaaacatttgccaagaccactatgagttaaatgaatagattaggcatttctccaatgttgcaagcttcgaatcatatccaaactcagaacaacatagcttggtcataatgatcccaaggatcctattggccattgtctttgagcctcaaaggaacatattaaaactccataatacccttttgatctattctgaagttaagtagtgaatttacatgatgatgacacaaacactgtaaaggacctctgggttacttgtttataagctagtatttcctgaatcaatttttctgatccctagatatttggtaggtgaagtcatacctatatatccccacaccctagaacagcatctccaacttttttttccctccttgtcttttagtgggagccacatcagtatccaaggaggagatccagaagcctctccaaccaggtagggacagttatagattccagacctcagctatggcctttgttacagagtacaaatgttatatagtacaagtttattgtacacatcccattgagtctctgagctttagaattttcttgtagaatttaacagttttttcatgccgtatttacatattattgctagtatttagaattttcttctccaaatgtataacgtttattattgcattttttgtatccactaagtggaaaatcatgcattagatattgtagaagtagatacaacaatgaacaagaactggtcctgaccatgagaggaactgatgatccaatgggggagatagacctgcacgtgtttaataaaaggaagtggctattccggtttctttttgatgggcaagcattttgcaaggccttgggctatgtgtgtgcaaggctaagccagttagttaattgggatttttttaaaaaggcacttcactggggggaaaaggaacatagagttggttattgtccccttgcctataataaaaacctattatttttaattttttaactgggtttgcggttaaatctcacagcccaagagatttgccacttcagatggattccatacacttgcatttaagtatgcaaaaaaattccaattatccagcaatttaaccaaattattggtaacttttctaaaacaaaaaaaaattgtttcccttgttttggcagcaatttcagttacagtcctttactttctactcaagaaaatagtttcaaaaagttgatgtttgttgctaaaagaactatttttatgaataaatataaaactaagaagttatggtgtcccttttttaaaaaatgactcatcaaaagaaataactttttcctttctcttgtaagagaaaaaaattaatctcttttagaattgcaaacatatttccttgatggagaaaatcaattcacatggcatagtcgttatttatccagttcaaaaaccagagtagaatttactactctgtctccattttttctctccccacccccttaacccacattggattcagaaagcttcattctgcaatcagcattgtcctttatctttccagtaaagatagccttttggagtcgaagatgaggaaaagcctgtattttatagtcttggaagtgtcttcttttgccaggacagagagaggagcttcagcagtgagagcaactgaaggggttaatagtggaacttggctgggtgtctgttaaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttgtaagttatttcccttcatctgtttcaaatgtt

SEQ ID NO: 2656 - DNA, 2220 bp; single-stranded, linear
atgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtag

SEQ ID NO: 2657 - DNA, 4616 bp; single-stranded, linear
aattcgataattcaaaatgatatttcagtggggacaaggccaaaccatattatgtgctttatgctactaataaaaaggttaaaccgaacaagttcaaagacaaaactcagtagtactttattcagacaggttagtctaaatctgttaaccttatacttgcaactctgatcattcattaattctgcaaattttaataaatgctttattttaagctaaatgctgagatgaaaaaatgaaaccatatgagttagcaaagtagaaaatataggcatattaatcagtaaatgcagaatgataaatgctccatcaatatgcacttgttgtagtgaggccaccgaggagggtgcaatcctctcaacctgggaggagcaggtaggacttcagatgtcatccaactcaaagatatagtgagggacttgatcaaacatttgccaagaccactatgagttaaatgaatagattaggcatttctccaatgttgcaagcttcgaatcatatccaaactcagaacaacatagcttggtcataatgatcccaaggatcctattggccattgtctttgagcctcaaaggaacatattaaaactccataatacccttttgatctattctgaagttaagtagtgaatttacatgatgatgacacaaacactgtaaaggacctctgggttacttgtttataagctagtatttcctgaatcaatttttctgatccctagatatttggtaggtgaagtcatacctatatatccccacaccctagaacagcatctccaacttttttttccctccttgtcttttagtgggagccacatcagtatccaaggaggagatccagaagcctctccaaccaggtagggacagttatagattccagacctcagctatggcctttgttacagagtacaaatgttatatagtacaagtttattgtacacatcccattgagtctctgagctttagaattttcttgtagaatttaacagttttttcatgccgtatttacatattattgctagtatttagaattttcttctccaaatgtataacgtttattattgcattttttgtatccactaagtggaaaatcatgcattagatattgtagaagtagatacaacaatgaacaagaactggtcctgaccatgagaggaactgatgatccaatgggggagatagacctgcacgtgtttaataaaaggaagtggctattccggtttctttttgatgggcaagcattttgcaaggccttgggctatgtgtgtgcaaggctaagccagttagttaattgggatttttttaaaaaggcacttcactggggggaaaaggaacatagagttggttattgtccccttgcctataataaaaacctattatttttaattttttaactgggtttgcggttaaatctcacagcccaagagatttgccacttcagatggattccatacacttgcatttaagtatgcaaaaaaattccaattatccagcaatttaaccaaattattggtaacttttctaaaacaaaaaaaaattgtttcccttgttttggcagcaatttcagttacagtcctttactttctactcaagaaaatagtttcaaaaagttgatgtttgttgctaaaagaactatttttatgaataaatataaaactaagaagttatggtgtcccttttttaaaaaatgactcatcaaaagaaataactttttcctttctcttgtaagagaaaaaaattaatctcttttagaattgcaaacatatttccttgatggagaaaatcaattcacatggcatagtcgttatttatccagttcaaaaaccagagtagaatttactactctgtctccattttttctctccccacccccttaacccacattggattcagaaagcttcattctgcaatcagcattgtcctttatctttccagtaaagatagccttttggagtcgaagatgaggaaaagcctgtattttatagtcttggaagtgtcttcttttgccaggacagagagaggagcttcagcagtgagagcaactgaaggggttaatagtggaacttggctgggtgtctgttaaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttgtaagttatttcccttcatctgtttcaaatgttatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtag

(The sequence listing continues in the following parts.)

What is claimed as novel & unobvious in United States Letters Patent is:

1. An in vivo method of delivering a pharmaceutical composition to a subject comprising administering to the airways of said subject a pharmaceutical composition comprising a respirable or inhalable pharmaceutical composition having a particle size of 0.5 µm to 10 µm in size, comprising at least one antisense oligonucleotide effective to alleviate hyper-responsiveness to adenosine or increased levels of adenosine, wherein the antisense oligonucleotide is 7 to 60 nucleotides long and contains up to and including about 15% adenosine or less adenosine, pharmaceutically or veterinarily acceptable salts of the oligonucleotide, mixtures of the oligonucleotide or their salts.

2. The method of claim 1, wherein the antisense oligonucleotide comprises 10% or less adenosine.

3. The method of claim 1, wherein the antisense oligonucleotide comprises 5% or less adenosine.

4. The method of claim 3, wherein the antisense oligonucleotide comprises 5% or less adenosine.

5. The method of claim 4, wherein the antisense oligonucleotide is adenosine-free.

6. The method of claim 1, wherein the antisense oligonucleotide is 10 to 36 nucleotides long.

7. The method of claim 6, wherein the antisense oligonucleotide is 12 or 21 nucleotides long.

8. The method of claim 1, wherein the pharmaceutical composition is administered by inhalation directly to the lung of the subject.

9. The method of claim 1, wherein the pharmaceutical composition further comprises a surfactant.

10. The method of claim 1, wherein the antisense oligonucleotide is administered in an amount of about 0.01 to about 150 mg/kg body weight.

11. The method of claim 1, wherein the antisense oligonucleotide is antisense to the initiation codon, the coding region or the 5' or 3' intron-exon junctions of a gene encoding bradykinin B2 receptor.

12. The method of claim 1, wherein the antisense oligonucleotide comprises at least one mononucleotide is linked or modified by one or more of phosphorothioate, phosphorodithioate, methylphosphonate, phosphoramidate, bomraophosphate, 3'-thioformacetal, triformacetal, carbamate, phosphotriester, formacetal, 2'-O-methyl, thioformacetal, 5'-thioether, carbonate, 5'-N-carbamate, sulfate sulfonate, sulfamate, sulfonamide, sulfone, sulfite, sulfoxide, sulfide, hydroxylamine, methylene (methylimino), methyleneoxy (methylimino), methoxyethyl, $C_5$-substituted nucleotide and methyloxyethyl.

\* \* \* \* \*

UNITED STATES PATENT AND TRADEMARK OFFICE
CERTIFICATE OF CORRECTION

PATENT NO.       : 7,034,007 B1
APPLICATION NO.  : 09/543679
DATED            : April 25, 2006
INVENTOR(S)      : Nyce et al.

Page 1 of 1

It is certified that error appears in the above-identified patent and that said Letters Patent is hereby corrected as shown below:

On the Title Page,
Item 22 should read -- Filed: April 4, 2000 --

Column 965,
Line 30 should read -- 3. The method of claim 2, wherein the antisense oligo- --

Line 33 should read -- nucleotide comprises 2% or less adenosine. --

Column 966,
Line 30 should read -- boranophosphate, 3'-thioformacetal, triformacetal, --

Signed and Sealed this

Nineteenth Day of September, 2006

JON W. DUDAS
*Director of the United States Patent and Trademark Office*